United States Patent 7,868,149 (PLANT GENOME SEQUENCE AND USES THEREOF) - sequence listing, part 26

SEQ ID NO: 12963 - DNA, 51489 bp, Oryza sativa
  unsure (1)..(51489): unsure at all n locations
ttttttttttgagtggaacgatgatttatcgcttcatttttctctctccctgcagagaaccgaatgtaactaatcgattagagagcaatcctgcatgcaatcgaccaaaacccaattagcgtggtcgaaaccatcttgccgactccggtggcgcaattggaacagctgcacgggagatgcaacgacaagcggctcaattcccaacacactcactatttcttcttgaaaaatgtttgaagcaacgtctctccatccaaatctcttttttttttttggaacagctgcacggcagcaagattgtgatcgacccatcatcacccagggcgacctgcagcagaagaagagtgcctcattttatttttttttcgcgcagctcacttctgcataagagcacctataattgttttttttttaaaaagaattctactaggagggtcggagataaatattccgacagccaaacaaatagagagcagagcgtggcgagttcggtgattccataagaggggattgttttttcttttcttttcttttcctgaagacgaacgaatgcaaccaatcgatcagggagcaaattcgcatgcaatttacccgatgaatctgaccgaatcccatgaaattgacgaactccgacaggtcgggcacggcaagccataggaacctctgtcctctgcacggcgaagattgtgatcgacgccactgttcttgattccttgtgaacatcagaagagaaacctatctattcttgtaggtttcagctcgccgacaacctgaacctgtacatctagccatcaggaagtaatagggaaagagataatcaatcaatttgcactgctagatacatatagactgattaagatcaaagaaaggatgagattagcagcacattctcttctgcactatatactgaatgaagtactgaaaacattgcagcgacgacaagaacaatgcaatcgaaagcattggttccatttctgcaaaccgatgaacagtcaactcaagtagagagtagaatatttggcttggaaatcgtccacgtaggtgtcatcaaaaatcaaaaagtcgtgcaagacttccagatttccaattcagagacattcagtgggctaaactactccaaaaccagaggcatgtcccctgattcgccttctctgacttcaattctcctctcctctcattgtataaatccacccgtctgatgtctcctcctgctttgccggtgccgaccacgctttcatatcttcctctttgtccccctcctgtactgaaaaagaaagggagagcccgagaagaagctcgaatccggctcaaaagttccatcttttgttgctaattcagctcaaaattcgatctcctcagcttgcatcgagactgatggatgcttggtcgtcggagctggccgggaggattcggagctgcagaaagatcctcgaggccatcagatcggcgccgtcgccgtcgccgccaagcgatggatcggtgtcagacaaagggctcgactgcggcggcggcggcgatggtgccatgccgccgccggcgagctcggcggctggtggtggcggcggcggcttgggcgcagagaccgccctgtccatcctcgtcgactgcttcggccactgattatattccaaattggagtatttctttttagttcatgttttatacttttgatatgtataatcgctgcagcgaacgagatgtatatatggatcatggatgagattattcgagatctcttatagatataggaatttgagttaatttgatttgattctgctattactctgagatacatgtctcagttctactcccgtgttggctctcgttgcaagcaagttggcaacacgttttttgcgttgacatctttaattttgttttttttccagtcctaaaccatgagcaactttcacatctgatttagcagcctatttgaatccaccaaattttattcaaaaacaaagcaaacatcaacagaaaaaaaaagacatctgaaaatttgagatgaaccaaagatacagtattttggcgaaatttgggcatccctccatattccagaacattgccaaactgaataaggctgtgttcgtttgagcctcttcccaacccctctccctcgttttccacgcgcacgcttttcaaactgctaaacggtgtttttttttaaaaaaaagtttctatatgaaatattagcgtagaaatcgatcaaatttgcataaaattctcacaaattttgtccttggaatccattccaaatgaaacatgcgaaagcgcatgtagtatagtggttgtagtgacttgagtagcattataaggtttgagttcaaattcaattggatgtagaggccctaaaaaaaacccttctctaaaaataataaaaaaaaaacaaacgaaacgaggactaaaatggcatgaacaagatttgggcctaagttggaaagcccaactaggcccactattgcagccatgtaggcccaagtaggcccagtcccaatacgcggaacccgttggcggcaactcctacatatccccgagaattcgcgcttccgaccccaaaatttccccatttccttcctctctctctctctctctctctctctctctctctctctctctctccccactcgctgcttccgccgccgccgccgccgccgccgcagcccatggcctcctcgtcggagaacgtggaggcgccgcgagacgagcagcgcgacccgccgccgtcaccgccgaaccctagcgaggaggccggggcgggcgaggagatggaggcggagggggagggggaggaggaggtgaaaaccctagagcgggcggaggagctgttcgagagggggtccaaggccatcgaggagggggacttcgtcgacgccgtcgactgcctcagccgcgccctcgagatcaggtgaggggctttctccgctacaccccctccgcttctacggttccatttcccgacctggctggttcgatgtgggggaataacgtaatatttggttcagtgatgctgtggatttgattgtgttgttgctgtcatgtggagtttgttattttgccttgtgtaattggggaggtgagtcgggtagggtttatgaggttctacagcaagctgtttgttattttgtcttgtgtaattggggaggtgagtcgggtagggtttatgaggttctacagcaagctggaggccatgattggcgattggatttctcttgtttatcaacgtggcgcaatggattgggctatcgtgttgaggaatcagtcaattctcctcttagcctcgtgttaattgatagcactagctaggagtttgttttatctcttgttattgtgtgtgaattgcgactaccatagcagcaaagtgcgattactcaattcttgatatctcagaaatatgtatgtatgctgctccactactgactagttggaaatatttcactgaggtcaagttatattagtttgtggttgtgcttggtaaatagacagagcagctaccaatctcgaactactgatccatctcagtttacattatgtctcaatgaacttgtactataacttcagtgcttgcgccctaacaaatttatgccttttgttgtcatcagggttgcacatcatggagaacttgctccggaatgtgttagcacatattttaagtatggatgtgccttgctatacaaagctcaggatgaggctgatcctttgggtaatgttcccaagagttcatctaataaggagtccatgaagagtactactaacaaggatgatagtggaagctcaaagacccccggtagcaatactgaggatgctccatccacggataaagctgatgctgaagaaggtataccattattgtaccatgtacctatgtagttgttattgtacacttatggccttttgtcttaccctgttcttatatactatgcataaaaacaatatcattaatatgttcttgttataaagtaatggtattttttggaaagtgttcagacttatttcctccattagtcaaattatcattatcattccataggaggccatttggtcacagtggatatattggttggtctgaaagggcaattatattttgtgctattgataatgcgtgattccagaggcagaaaaaatgttttgcggtttgtaaaaaaccattatatggccaggccatattttgaatacacctaggtttatttatctgtattcctttcttacttgtgcacttggaatagaaatggcagcttaaacagattaagcacttgcacaggatgcttttgcaaatttacgagtttcctttatttgagtaattatagtagcgtgcaataatgtaaatagttcttcttactttgctcaagattaaataattggtcttgcatttctataagaaaccttactagtttaattttaattgaacaaacttattggtcactatttggttgggtgggatcatttgtgcatctatatgcatctaactgctccctgtagcaggttgctattgtactataataaatgatggccacactccatgtgcttttcttcctggtttctgtggtaagtactgatatagttttggttagggcaaaactcaactggaaaaggtcaagaggaggaaaacggtgacagtgacaaggatgatgatgagatggtgggagatgaagatgattctgatttggatcaggcctggaaaatgttggatattgcaagggctatagttgagaagagcccagatgacactttggagaaagcaaaaatcttttctgctctagctgaagtctccatggaaagaggtctgtctccactatcttagttactctctagttttgatggtaaatggttttggtgctaatgccccatatttcattttcagaggacattgataactcactcggtgactactttaaagctttagccatattggagaaattgtttgagcctgatcatcgtcgaattattgatctgtatccttcttgtttggtaaacataatactaccaaattatctgcctgcaacctgcatccttctgccatatagcaagtataaaacaacatttgcaacccaatgctgtagtgcctgcaacctgcatccttctcgacttaaagagttaggcagctgaaggtgtgttttaaatattgttatacatgtatattttcaatgggagttccacccaaatctgcatggttaccttcattttcttacatgtacgtgtttgtctaaatgtggacatgaactgtggtatccagttcataggaaaggtgacactagtatcttttattttcagtttttattcctttgcttgccttaattcagtcctagaaacttccgcatatgtttggtctatgagttggtgtcgaagatttcagatgcaattccatattgcgctaaggctatttcattatgcaagtcacgcatacaaagcctaaaaaatgacaaagatgctttgttggctggtaaagatgataacgcatcagctgctgatggaggctcagaaaagtccgctcctgagggtgagatagagcagctcagtggcattttgagtgaacttgagaagaaggtaaaataaacttgattttgtctatatgaatactcctttgacattgccatcttattttcttctttcatatatgaatgctaaatacgttcatttgtgaaaataagctttattattttcttcatacaaatacgcctttcacattgccaacttcattttgttcttgaatatgtatgaattgtttgaattcagctggaagacttggaacaagcaatgtctaccccaagctctgttatggatgagattatgaagaggattgcctcaaaggcaggtggtgaacagaatgctactgacacaatgccagcggctgcttctttcaattcttcttcacagatggctggatcaagcaacggctttgattcgtcaactctgtctacggcagctacaaccggaagtactggaagcactgtaaccgatcttggggttgttggtagaggtatcaaacgtgctaatatcaagccaatctctgctgaacctcctcccaagagagctgcagctgattcgctctcagtaaaaggtgatagcagcaacaactcagatgttcataccccagcacaagagggcgatgattctgtatcaaagtaatgcattttaccctaggtagtaacttaatggaatctattcggtgccaaaatcctgtcttgcttaatatgtactgctgcatgtccattttctcagaagaactgccaatagggattgcatgaaccttttaccttttcagagctcaaaccgtgtcttaaattgatggttgacttgattgttgagtgagttcatggtggactaccatccaactcaattgtatctgatcatagtatttccccgtttgaaatctgccagtgataccgtatcagcgttgctaaacttgcaaggcctattacgattcgatcgctgtcaatgttgtttgtacacaaacagatcagaggattgccggcgtgaactcatcttatctgatggtatttatggggtatcatcctattctatataccacaaaaatacagctgaaattctctcctctgagatcctggaattattggaactcaaatatccaatttgcgtgcaaatctcctctcaacaaatattcaaacattcaccaaacaattccctgtggaaaatatgaaggaacactgcaattgggtcacactccaacccatctccttcttccctttacttccctcaccggtccactacctccgtcacttctccccagcccaatcctttctccccttccttccccctccgcttgggcctcaacctcaacagcccagccctttcccctctctctcactcggcccagccaagggccgcctgcctggaagagctagcaaatctctctcttctcttctcttctcttctctatctctatctctatctctactattataaaaagggaaaagtacggtccctcaacttgtcatcgagttacgaaatcgtccccaaaccgcaaaactgggtatatgacatccctcaacttacaaaaccgttcactttaggtccttcggcggttttgatcccggttttgtctaatgtggcggcagagtcagcgtgggacccacgtgggctccacatgtcaggctgcgacgtcacaccccctctctctctttcccctctcctctcccttcctcttcctcctccactctctctcaattttctcctcaacggaaagccagccggcgggtggggagagggtcgtcggggcaaggtgggagaggaggttcggcggcgggcgacgaggcggcggaggcagggatgggcgacgcggcggtgggcgtcgacgggcgccgctgcggggggcgacgagtcggcggaggcggggccgggcgacgtagcggtgggcgtcgacgggtgccacggtgggcattgcggtggtgggcgcagaggcaaaggcggggccgggcgctgcggcggtgagtgcagacgcgggcaccgtggcggttggcacggaggcgtgcgtcgcggcggtggatgcggaggcgggcgccgcggcggttggcatggaggcgggcgtcgcagcgatggttgtggaggtggagcgggcgccgtggaggcggcctggctacggggatgacggcttccccgttttcttcactgagaccaagtgcacgtcagcaccgacgtggtcctagcactcctcaatgggttcctcttcgccgctgcatcgacgggcttcgcttcgacccttcgctcctccacgcttggccgccgcgtccccgaccttggtggttcacggcgtggccggtggccggcaggggagaagaacggcggcggcactcggtgttgaagacggggagaccggaggccgccgccgccgccatgctccccctgtgctcccgccgccgccaccctccccttctcccgcatcgccggctaccggacatcctctccagccttgccccgatgaccatctctccacccgccggccggatgcccattgaggtgaaaagtgagagagaaagggggaagggagaggaggagaaagagagagagaggggtgtgtgacgtggcagcctgacatgtggagcccacgtgggtcccacgctgactcagccgccacgtcagacaaaaccgggatcaaaaccgctgaaagacctaaagtgaacggtttcgtaagttgagggatgttatatacccagttttgcggtttggggacgatttcgtaactcgatgacaagttgagggaccttcggtgtacttttcccttataaaaattgaagatgttttcgcggtccgtcatccgtgtttaagtcggttataaaaattgaagatttttccgcggttcgtcatccctgtttagtcggttttaattttatgttttggttttaatctatatagagaactattataaaaattgaagatgtttttgctggtattttggtacgtcatccgtgtatgagttggtttttaaattttttttgcttttggaaatacatatttgtatttgagtcggtttctgtaacgctccgcttttcgtcagacattaaaaactaattcggcaaaatcctaattgcgaaaatttcgttctttgagtgtgagtttaagtcgtgccatagatctcaattcaatctccatcgttgttccctctcgtcgccatcaaaatcgcccacctcaagattccaattccgattcaagtctccaaatgaaattccgaaattcaaatcctatcttgaaatcctcgccaaatacatgtccccgttcccaaaaatatcaaaatctcattttgaatctcttccttgacttctcctcgagtctcccttgattcctccctaaaccctcgagttcgaatatcaaattttgaattcgaatccaaaccctaacctcaaccattcaatccctctgaaaaagtctatttgcctccctcaagtttagtgggccgatcatgttccccctagcccatctcccctctgcctatctcctccctcctccttgcacgtgctgtgcatgtgcgccgcccgagagagcgtcatctctcttcctctctctctcacctgtcgaccaccgccgccttgccgattcctgccgccgcggtttgaaccctcccaccgccgccattcaattttcgccgcctccgccgtttcccacgtgcgcatgcccttgtggtggtcgtcgcccgaacgccgctgccgtcagccctgccacgcatgcgctgcgctgccgccgacccccacagtcctgctaccgctgtcgcaccacgccgcgtgcttccaaaaccgagaggcagagcgcctctctcacgcgccctctctcctcccttttgcacgcccaaatcggcaaggagcagagctcccttttccccctccttttctactttgaccatgccgcgcagctcctcccgctcccgggattcgattttcgccgtccgatccaccgccttcgccgcccaacgcatcctcgtcgtccgccgttctcgcgtcgcccgtgatcaccagccgagcaccaaccaactcgcccacgcctcccaaaccgacatcgcctccactataaagccgagccccctctcaatccctcctgcttcactctccaccgctgccgcgccatcgttgccgcctggctgctcgccgctgtcgccgctccttctgccgacaagcgcgagaagccgagacactccgtggtgccgaccgccccatcctcgcgcccctctcttcttccccggccgcgccgtcttggcgccgtgccgctcccgtcgcggcgaccgtcctgccacgagcggacaacgccatccgccccgcctcagcgtcgaacccgccgaggacatccctgccgccggcgcgttccttccttcccggtgagctccgctccccttctcccctataaacggcataaattctctaggcatgctcatttacacgggagattacggagctgggtcgtcgccgttgctctgtttccgccgccggccttcccactcgcttacgcgccgcgctgccatggccgtctccccttcctctcgctccctcgccacccgcctttttcgccgccgccgtgcgcagttgcgttccgccgtcagcctccctcctctccttgattcccggcgccgccaccatccccgaaccccctcgaaccttcccagcgcgccgccgcggccgcccgcctcgccggccgcgcccgcgccgtgccacccatcccgccgtcgcgcctcctctccatgatccgcaccgttgaactagttccccttgacctccgcttgcttccagtgcacgccgcccctccaggttcgccgccgcccgccgccagccgtcggatcggccgcccggcctcctccctcgcccgtgccaacgtggctgtccacgtggacgccacgtctacctgcccggccccgcagagaccggtcaaggtctcccggtcccccgacccaccccgcggctctcgcgtgcacctattcctcgtggaccaggccgccgccatgtgggccccgtccctggaccccacgcggtggatccggtccaccgaaccgcctctctctccccacccgagccccattgggccgcctcctagcgcccgcgtccggcccaatcagctcggccgcgcatgcaaatccccttgggccacaccaatgccgcccgaggaagtctgattgacatccctccttccttttcgtttccaaagggattattaaatccttttccctcgttccataaatcaattctttattccatgaatcatttcctttggtccctcatatcaatgaccatcaataatattcttgagaatattatttctataaattccataaaccatttctcgtaatctagaaaattccgataaatcatttccttgtccggaaaatcccattcgagcttccgaaattcatatatctcgatccgtaagtccgattgactccgttcagcttccagtatttccgtaaagttgagatctatttaatggcactattatttagtctaaataggacctttattttggtcttttgtttaggttttcgattgtttgcgtatagttgcggttaccggatttttcgtcgatcgtggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctctgtttgcgtgccaaaccgacggacctacccagtagtcgcactaatttccgtaggtcgtactaccctgattccttgttgctccacccttgtggtacctcggtattcgtgctctctgagcgcgtataccaaatatcccacatacaccgttgtttgttgaaaacttgggaaatgggtttgtgaagccttcaaaacccgacatgtggtgtcggtgtgtttgaaaataaaatgaattgtgaaaactcgcgatgcgggggttgtggctatgtggcactgtcccgtattcgtatataaggaccgattcctgtgggaaactcatcgaacataatcaaagtgcaaccacaaggtggaatgggacaccctggctaaataactagttgattcagggaaacctcgcatgccaatagttgggaacgccggggcggggtcggttggagccaaaccgggttcctggtaatgtaagaacgagaagcttgttgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacatcgtccagtgtctggagtaagttcgtgtcttgtgggtaaagtgtatccctctgcagaggttaactaactgttcgaacagctgtgcccacggtcatgggcggatgtgaggtggttcccgttgcgtagatttgattgcatgtgctttgtgaaaagttgttgtggtgtgggaatcgttaccagaatcagcctatgtggcagatggatgacctgagtggtcggaaacaaatctgtgtgattcgggatgtctgcgggcatcatagactaggcttcctgagtggaagcagattgttgtgctactgggcagctggactctgggagtccgagaaaatgaaaaaggctctgggagccgcttaatcaagtgaaatggctccgagagccgagaagtaatgatctgacccaggaggtcggtacattatcaattgagttgttgaaaagcatctcttaagtcgaatcgagatgaaagtctcctttcgacccaaagttaaaaagaaataaatcacttagtgatttcaaaaatgatttcaaacaaaggatttgcaaaacaaccttgcctctcttccaagcttgcattaaacacctaaattcttgtgacttgctgagtacgaaagtactcacccttactctatataaatatatatatagttcctctgcctttaagtgaagatgaagtgaagtgaagattagggtttcgtcctagttcccagccgtcgcctgtagtgttgggtgttagtccgttggttccgctgctgctgctgttgttggtgtttcctcgtctgcgtcgtcggttgcattctcgggctgttctgagctgcaacctaagttaaggtaaataagtcctctatttattttaaggattgcaatgattcatatttgtcaccgtgggtaccagcgctatgtcctgggactggtactgagatcgcggtttcgtaggaagcggttcataccgtttttcctacgacacgctcctgtcaggtgccgttgtacggcgatgccagattggggtgtgacagtttctaagatcgtttacttttggtaatatagaaagaatcatataagaaatatgtttaaaaaaaactcgcatgctaacttgagacgatcggactcctaactgcagctgatgattttctaaaaaattatatatccaagcgaactcccacagtgaatttcatcttaactaaaccatataacaataataaaattaaaatagacttcagccgttgcaacgcacgggtattttttctagtcaaattaaagtgataacatgttgtaaaccacgcgtctattagcggatcaccggatccgttccctatcccttctatagtagtagagacgtgagatgatgtaaaacacccgtgcccttctttttgccctcaagaacattgcagaagtagacaatgaaaatatatatagagaagagctatgtcttcattatatatctcgtctggagtacatgacaactttagatgtctcactctgtccttatatgtataggggttctaggaggagataaatcttatctctactctagttccgattgatccacctgaatggatcgagaaaatattgcatataaaaaaaactgcttaaaaaaaagatgagatctgtgaaagcctgaaagtccaaaatttgtcaataggttccgttcctcggtatactgatcggatctcctcgctgcgacatggcggcgccggcgccggagctaatggacgacgtcgtggaagagatcctcctccgtctcccgctggacgatccctcgtgcgccgcccgcgcgtccgccgtctgcaagcactggagccacctcctcgccgacgccggcttcctccgccgctaccgcgcgttccaccgccgccgagcacctccgcggctgggcttcatctacgacgccggctcccccttggcccggttcgccccgaccaccgcattccgccctgccgatctcgaccacgatggctggaagcccatggactgccgccacggccgcgccctcttccgcacatctggtgcgtctccgactccggcgacgacgagctcaccgtctgggatcccatgtcgggcgacgtgcagcggctgcgctcgcctgctgacacccttgccttgcgcaccaacatcgaagccagtgcggtgctgtgcgccgtgtccggctgcgaccacggcggctgccatggcggccccttcgccgtggccttcgtcgccaactatgtcatggagggggaggaggaggagatcacgtcgccgacgtcggcatggctgtactcgtcggagaccggaacatggagcgcgccttccaccgttcgccaccacaacgccgaacccttccccaagcccagcgtcctcgccggcgacggcgccgtctacttcctcacctggcacggtaggaacatcctgcgctacgacctgcgcaagctggacctgacggtgatcgcctcgccggagatagacgacgacgactttgagaatcatctcctcatgacgacggaggacggcgggatggggctcgcccgcttggtctcaggtcactccctccaactctggtcgtggaagccggtgtcggcggcggcggcgtgggtgcagctcagggtgatcgacctcgacctcgtgattcccggcgacgccatgcgacctcgtctgttgggcttcgcagagggcaccgacatggtgttcgtggacactacgtatgatggtgcccaggttgtccagcagattgagctcagcacactcaaggtgacgaaggtgttggacgagtgctacgcctcttgtgttcttccttacatgagcttctttctcccaggtacatgatcgatcgactcatatgttcgattcaatgattttattaaatattgttataaaattttttagcattgtttatattcatatagatgttaacgaatctaggcacatatatatctagatttattaatatatatatgaatgtgtacaatactagaaagtttaatttataatatgaaacggagtaagtaggtttcttttttagtgattttggttaagtattgtcactgtattttttttctttttcttttttattatcaggtcgtcaaaaaggcaagttgccaccttcagcaattacactgtaattgattaatctggctggcaaacaatgtcactcacgcgccgatagacaatgtgtgaaaaaggagggaatatatcctcaagagcggatgttttgaggcttcagctgtttatgttttctgcttggatgtattggtgatatgaggaaaatgcaatactcttggttaatgcaatgaccaatggagaagttttcagtccctattcttctcaaacttctctattctttgataagtcattttagtatttttactgtacgtccttgactcctttgagaggcatcaggaggtataactaaatttgctagctccaactatttgagatatatattaagagtactaaattaattttataattgaaaatttactactccctctattttatgggagtggattttgatcctcgaagggatattttcttgttatttacatgtcatttaaatggttatgaaaaaatttgaaaagatgtattaatatgtgatatatcacttcgtaaacatataagttcaaatttcaaattctacgtctcgcaacgaaaaaagcaaattaaactatagctagtgaactaaattttttggtgtagtatatacaatagtttagttctcgttaaacattatgaagtttagttctcgttttccttttttctattttgtttgctgggtgatcttcactgcctggcgtattttccaaatggcttcttaatactaatatttgagcatcaccaacggaataggtaacatcaatctccaaaaatctgaatttgataatgctaatcagaatttgatactcccaccgtttttttaatagggtatatgacatcgctgatttttttaatacgtttatatgacatcgctgattttttttatacgtttaactattcgttttattcaaaaaattttatatgcttatcatttatttattgtaatttgatttatcatcaagtattctttaagcatgatttaaatatttttataacaaatagtcaaacgtttgtcaaaaaaaaccaatgacgtcatatattaaaaaacgaaggtagtatgtcaaaaaagtgatccttccaaaagatcttataaaattgaatctctaacccagaaagtgaaacccatagtaaactaccaactaaaagttaggcctgtttagattcaaccctaaaatttttcaccatgtcacatcgaacatttaaacacatacataaagtataaatataggctaaaaaataactaattacagattgcgactaatttgtgagacaaatctttgaagcctaattgctacatgatttgacaatatggtgctacactaaacatttgctaatgacaaattaattaggctaaataaattcgtctcgtggtttactaacggattctgtaatatgttttttattagtgcccgaacatcccatgcgataccctatgtaatacaacatgtgacacgctaaaattttacacccctagatctaaacacccccttattcctcctcatccctgattgtgattttctttccacaccacccggacgcttgcgccacatcgctcccccttgattttctttccacaccaccgggacgcgcgtgccacatcgctccccctcaaatgaagagagcgatggatgtgatgatatggttttcaaaatattagcatcaaaataggatagctgttggatttcttttttcaccaaaatcccaaaagaataagattagggattgaataagggcatggctggtgatgctgtaagaattgcctgtgttggtgtatgtacgccgtgtttagtttattggacaattttttttttacgtatacggacacatatttgaagtattaaatatagactaatatcaaaacaaattatagattctacctgtaaactgcgagacgaatttattaagcctaattaatccgtcattagcaaatatttactgtagcaacacattgtcaaatcatggcgtaattagactcaaaagattcgtctcgcaatttacatgtaaactgtgcaattgattttttttgtccacatttaatacttcgtgcatgtgtccaaacatttgatgtaacgtttttggtcaaaaaaattttttgaatctaaacacagccgtagtcgtaaatatcgagttttatagggtctaagctgaaacatacaacccttctcttccccaaatcatctggaatccaacgcctgacctcgccgcgcggcggcatggcgccgccggagttgacggatgacgtcgtggaggagatcctgctccgcctcccgccggacgatccctcgtgctccgcccgcgcctccgccgtctgcaagccctggcgccgtctcctctccgaccccgtcttcctccgccgccaccgcgcgttccaccgccgacgagcacctccgttgctgggcttcatccaccacgtctccgacgaacccgcccgccgcgtccccagcttcgcgcagttcgtcccgaccaccgcgttccgccccgccgaactggagcacaagaattgttggccactcgactgccgccacggccgcgccctcttccagtccagcaacgtcgagctcaccatctgggaccccatgaccggcgacgtgcggcggcagcgcgagccctacggcaccctctgcacgttcgccaccgccgccgtgctctgcgccgtgcccggctgcgaccaccacgactgccacggaggccccttcgtcttggtcttcgtcggcaacgacgaggacgacgacggggaggagatcgcgtcggcatcctcttactcgtccgagaccgggacatggaccgccgcttccaccgtccaccatgacgattccctcgaactcgaaagcaagcccagcgtcctcgccggagacgcggtccacttcctcacctacttcggcaaagccatcctgcgctacgacctcaccaagctggaactctcggtgatcctcccgccggtggcgtacggggacggcgacgctctcctcatgacggcggaggacggcgagctggggctcgccctcttcgacggcgaggcctccatccacctctgggcgagggtggcgggtgcagggtgggtgcggcgcaatgtgatcgacctctacgctgttctccccttctttgatcctgtacactcgctgtccctggttggcttcgcggagggcaccgacatcatcttcctccacaccattcatggcgactacaggatggagctcaagtcactgcagatcagcaagctgtgggagaaggacagatgcttcaatatcttcccctacatgagcttcttcgttccaggtacatcctttaccaatttgctagcattaggatttggggatcgttcagttcaaagtttcagaatggagcatgcctcttgctcaattcaccaatcgtgattcagggatatcttttctgtgtgtctcagaccttccgaaaggaaaaaagaatgttcagtatgtttctgacggtgacatgaaaacaatgttgaatatacttgtttggctcataattagcatcaatcagatagttataaaaagttctgaaaataattgataacactgataaaagagagattcattgatattcagtactagattcagtatgcttcagaattcagagagtgacatgaaaacatttttttggatatttggttggttcacaagtaatactagaatgggcgacgataatggattgagagaagtatatgtgacacttggaactttaacttgttaaggatccactagaatgggcagatatattattctgataaaccttttttgtgtgttgacaataacgattataacttgtctgcacccttttcaggtcgtgataggacaaattgccatcgccagcaattgcagcagtaaactagtagcaaacaatgtgtccaaattttgctaatctgttgggttcaattaagcgtcttgttgttggtatcctaggaggtcttgtttatttacttgaagctagtgatatggaaaactctggactgaaggtgatgcatcccatctttgctgatcttggccttagttcaagttggttgttttcactttatttcatgtcaatcttgctgtcaagctgtaataatttgcaaaactagcacaatgtcttcaggatgtcgaagaatgtaagacgttctggctgtttgctaaaactgatgggatatggttggttcataagtaatactaattcagcaacattaacaaaacggtgatgataatgtgcttggggaaaagtatatgtgacactgggtactttaacttgtcgaggatcaactagaatgggcaagatattttgttctgttatcattttctgtctgttgacaatgcttgtttttggtaccttttgtcagtagtaggaatgctctctcaaaatactttgtgaatattggttgtaaaacgattataacttttctgcatctttttcaggtcgtgatagaaacaaattgccatctccaacaattatagcatcaatttagcaaacaaaatgggtccaaattatgctaatacgtcagatcgagcctctagctgttggcctcttggttgattacttgaagctagtgatgtgcaaaactgttgactgaagctgatgcatcccttctttgctgcttggttagtagtcataagaaatttgataggttgagaggattcttcagaaatttcttttggtgttgctgtgagtgctttattacactgctaaatgaagagacgatttcttatttttggtgtgtgtgtactgtgtgtctgtgtggtgtgtcattccattaaggagttcagacacagacacacaaaagcatggtgtgtcattccattaaggagttcaggccctgtttagttcccacgcaaaaaattttcaccatgtcacaatgtttggacacatgcatggagtattaaatatagaaaaaaaactaattacacagattacgtgtatattgcgagataattttttaagtctaattgcccaatgatttaacaaagtgatgctacaataaacattttctaatgatagattaattaggcttaataaattcgtctcgcagtttacaggcggaatctataattcgttttgttattagtctacgtttaatacttcaaatgtgtgtctgtatatccaatgtgacacgccaaaacttttctccactggatataaacacagcctcgtaacaacgatgaggttcccctcatcaaggcacagggcctgtaggaataaagaagggacaatttcgaataaaaattgaaaagatggtttatgatactacaaatgtagaattctaagttctctcagatacagagaggaaaaaaaacaatagtattttgtttacggttggccttaccaacagttattctaaggaagcagttatttagccttaccaaccgtgtttcttccctccatccatttgtgccaagccatgactttcagagctatggttcatgtttacttctaggcttatcgttacacagttacacacctttcagtttcagctttcaatccttgtaccaggcttttgggctaattgttaacatctaaattcattaacatctaaatgaatgtgagtaatgctagaaagtcttacattgtgaaacggaggaagtacctcacattttagttgaaatgcaagcaaaccgtgcatatttgaaatgaaatttttcactcacatgggaagaagcaatcggctctctcccatgtccaaacatttccctgccatttttactctgacgcagacaacaaaatgctgcagagctcgctgcccattgccagcaccatccttgtaggtggtctttggccgtcacggctgtcgccccttgtggctcttgccgttggattgcatacctgttgccacatcgccttctcttagttccagcaaccgcttcctactgaactgaactctgttttgctggagatggacgcctgcaagcagtggcagagcccagatttgagtgataaaggtgcgaacttaggttacacatctaaaaaaaagttcaaactataataaggaagttcaaagtgacaaaaaataaatgctgtcaaccgaaatcatcaatatatgttagggaaatgtcacaattcaatatggcgatccttcacaccttaaaataggctgatcacatcattgtgaccaacttgtagaaaaactagtgcagaatgaacgtagcaaatcaaaccattcaagtgtgcatcacccatgtcactcattagtttgttattcacatattcactgcaataaaagcttgctcaacagattattcattcaaatggaaattggtacaatgagctgcgcctcatcgatgtgatgggattggtctgccacttaggatgaacacatttttaggccaagccaattctggtgaaatatattcctttattactcggccaatttgaaagcaaacaaacaaactattcctgaatcgtgcctaagaaacatgtagaagtcgaaattttacatcaagatagagtcaagtacctggagtgcagaagctcgtataggggaagacggctttgaagtatcctctctcgcaaaccttcctaacacacattgatttgagctcaatcatgaagatgccagcatctgttctaacgaaaacgatatcagcaccatccacaaagccaatcggtgctggttgtgcaagctcacatgctactgcctctacgcaatcgatacttggtagcaagctctctaacttgataaccctgttcttctcccatctgacaccaccatccaggctcacatcactagaccacattgagaggatggaaccctcgatgccgccgagcccgagcagattgccccccattgccatcaccacaatgcctcccttgtacacaacaggtggatggatccgagaaagcgagcactctcccatgttgtacttgatgattccagaaccttccgcaagggcgaagtggagcgcatctccgacgagggcggcgggcttcctgtcgacgtcgcaattgggggttagggttaggttgaggtaatcggaggtcgttgggctccacgaatcggaatccgacgagtagacggtcgcccacggccgcgagttctgctgctccggctcgtcgatgcccacgacgacgacgaggaaggggccgccgccgcggcagtcgaggtggttacatccgacggcggagcagagcaccgcggcggcgtaggacatgaagtaggggaggtccggccgggggagccggcgccgtcgtcccgccatggggtgccacacggtgaagtcggcgctgaaggggaactcgtcgaggagggcgcggccgtggcggcagtcgagggcgacccagcaagggcacgcgatgtccggcggggagaccggggaggcggtgaaggggacgtaccggtcttcgccgccgccggcgacgttgtggaggaaccccagcaggggaggcgcgccgtggaaatcgcggtagcggcggaggaaggcctggtcggtgaggagacggcgccagggcttgcagacggccgaggcgcggacgaggcacgccggctcggacggccggaggcggaggaggatctcggcgatgaggtcgtccgtcaagtcatcgactccggcggcgccgccgccgacgcaatggttgctcatgtcgctggggattcgtcgaatactattccttttttttttagaatactttgagattaatataagtgggccttttgggccatggcttcgcatacgatcttgtgggcctaatgggcatcatacgaagcctaacgggctgaaatttgaacgaaggccgagtgtagcgaagctgatatcttcgcgtaattttagtattttacaggaacatatggagctcaaatcttgatctaaaaacatagggcaaattactgacactgatgtgagtgattctgcgatatataagaagttatttttgccagtagttattaaatacttaattaagcattcaccgcaaaagaatgatcctcgttaaccagtagatattttatctttcttttcggcctttactttcatgacgcttatagagtagaaatataaaatccttttttgctgtctcgtttacttttatacggcggtccagccaaacaaatatgacatttttttgttgcgagtgtagtgaagcaaaacaaaaggtcagcatacatgccacacagtccacagacttccgttgtcgtttggcagcatattgcaaataccacacgtggtattcccctcaacaataaagtataaaactacgtaccacactagtggcaagtaggagtacactatactccgtagagtagatgagcatctccgtctgtttctgctttttttttctttttttttttaaaaaaagaacccgtctgtttctggttgcatttgcactgtagctgcatagtagtacagcgttttgcgtactcgcgtgtgtatgcgctttccaggctggttgtggtggcgcccgcggcccgatgcagctacctgccgaactgcaagttgcgctacacctgggcacgccacgccacgaccctcctatgggcccgaccactttggggcccaatgggccaggcccgtctcccgctctcgtggactcttcgatgcatccaaataaccaggccaaattaatcagcataataatgcatacagtatgatttttgttttagatcctgctctgtttgatactagagtagtactactatcttctggtgacagatttagatcacgtatgtatgctatcttttgctttgctagatgattagcactactaccagctagatcgactttgctgctcactctgtcgatctgatatgatgatgaaccaaccattgctaacaactggtagctaccagatgatgccactaacaacaggaagcatgcaactaatctaaaccattagtgatcgactgggatacccatatcatgcacaaggattaaacaaccatcatgtgttaactaacctattcctaaaataaatctaggctgattaattcttaaggttccttgtttgttcttgcttaattatccatgcacgcatgtacagaacgtactccctccatccaaaaaaaggaaaaccctagtttccgtgtccaacgtttgaccgtccgtcttatttaaaaaaattatgaaaaaaattaaaaagacaagtcaagcataaaatattgatcatattttatcatctaacaacaatgaaaatacgaattataaaaaaaatttatataagacggacggtcaaagttaaacacagaaacccagagtttgccttttttttggacggagggagtacgtacaggtggtaggacaacataatgttggattcgatcgggtagctggctagctctagattaatcatattactccctccgtcctaaaatataagagattttgagtttttaattgcaacgtttgaccactcgtcttattcaatttttttttacaaatataaaaaacgaaaagttgtgcttaaagtactgtagataataaagtaagtcacaaataaaataaataatcatttcaaaaaaaatagaataagacgagtggccaaacgttccaaacaaaaaatcaaaatcccttatattataagacggagagagtaatatatatatatatacacacacactcctactaactagtgttgattctctcacttactgctcccgaacatttttttttaaaaaaaaagttattcccgggagatccaacagctagctagccacaaatattccaaacaatataaacacgaatgatcatctaagtcataacatgagcatctccccgcaaatcaaaattaaaacaattaaaaattattattattattattattattattattattattattattattattattattattattattattattattattattattattattattattattattattattattagcagctgttgaacgagctaggaccaaatcgatatattgtcggagatttccctgaaccaaatcgactggatcttgctagaatgctactccatactagtaaatacaaaatggcatacattgatacgcgtatatatacgtactactgtatgtacgttcacggaagctgcacgtatgtacatgcgcacgcttgcacacagtcacagtatctttgaatggtcagacagccagccacgcgtagccaaaatgcatgaggcaatacatgattagggtgactgattgatatatattggtcggttgttgctacagttaatcatccacattacgatttatttttgggaccgcctatgcatcactcgggtgcccagatttttttctttccttggatttacatccaacggactacaaaataaaataattaatacaaatttacttacacaatatttttatcaaaattacagtgcacttacatgttatatcaactaaatttacatatgtaattttagttatatagtaatgtaattttatatttgaaataaaataactaatgcaaatttacttacacaatatttttatcaaaattacagtgcacttacatgtcatatcaactaaatttacatatgtaatttttagttatataagactgtaattttatattttaaataaaataataaatacatatttacttacgcattatttttatcaaaattacagtgcacttacatgtcaactcagctaaatttataaatgtaattttagttatataggactgtaattttatattttaaagaaaataataaatacatatttacttacatattatttttatcaaaattacagtgcacttacacgtcaaattaactgaatttacaaatataaatttagttatataggactgtaattttatatttctgagagaaacgatgtctctcaccgatcagtgttggccgtgctaccggcggctggcggtcaaaggccaccgtgtcatcgtgcttctccgacacggtggccgacgtgctggtgtccgacgcgccggctgacgagcctgaaaaaaaaggtgaaatgtcagaaaaaaaatcacgcgagtgatcgttagcaaaatcgtttattttttgttatgtacgtatacaaaaggtatacgaattgttgtacccgtaccaattcgacatgacagtccaattacacgctcgatcacatatatatttctttcttttgtttctattttttttctttttttgcctaacgtttgcatgcacgcatgtcctttggacatatccatccatccaacccacaattattgttgttggcacgatgcactgccaccctgggtcggacccaggcccgagtcccacactcccgggacgagacgtgaccggatcggacccatgcgttcgcgtccggtccatgtgacccagcgacgacgtggccgaacatggtcgagacgccccccgcgtccccctagctagaccccccctactgcatgtgggccccactcggggaatctggaattggcgcgcattgggtggtggcgttaattggcgtagctgcatgcacgccgccacggacgtcgcctgctttgcaggctgctcgtcgacgtgtcacgccgctttacctgcgaatgaaattattgatcgatcgatcgatctgcttttctgcgtgtattttttggatcgtactcctatataatacttactccattccaaaatatatgttttaactatttatcttactaaaaaattttataaatatcatttattttattgtaacttgttttatcctcaaacaaaatataatcttaacttatactttttatatactccctccgtttcaaaatgtttgacaccgttgactttttaatatatgtttgaccattcgtcttattcaaaaaatttaagtaattatttattcttttcatatcatttgatttattgttaaacatactttcatgtacacatataggtttacatatttcaaaaaaaaatttaataagatgaatggtcaaacaagtgttaaaaagtcaacgatgtcaaacattttaaaacggagggagtatttatattagattttaataagacgaatggttagatattattaaaaataataacatcgtacatttaaaaaagaaatagtataatataagatatgattaaatttaatacaatctctaaaactaatatttaactgtatactatataaggttttttaataatattataaccatacaaaagtaaatttaaatattaatccgatgatattatttcaacaaacaaaaattaatttatattataataattgttagcctaatgttttgaaaattaaattttaaaatgtgcgcgtgtctggaggggatatttaattcgttttcagaatattattgtgttcattcacctggacacgcgtatatatacacaatataatagtacatgcatttgtatcattgtatggtggtggaattattggtggcctctcttggccttgcaggcaggggccgacagatcaacagtggtcctccagcgcgcgtactgcgtgctacagtgggtcagcagggttacaattattggcacatgtttttcattcctccaatccggagctctcgaactccctttttagaatttttaatatattccggatcgatgatgatgaattgtactgtacatcaggtctcgtcatccacaattgaacattatattgagtatgttattactgctactaattgggacactgtttgatgggatcgataaagtcgttgggtggtagtagttggattagtgatagacagattatataaaacatatcggcttcgtgcgacgcgagcagagacacgcgagctattgccgattgcaatgtaaaataacaaaggcacggtcacatggatgttagtatgtaggactaacatggataaggtagctatagctagcatagcattgtacatttgtatggatgcccttcatttttggagcctcaccatgtgaccggcgatttttccttttttttttgttgactgaagtttcaactttgaagatcgatcgatctgcgacctaactatacacgcagtgtcgcagggtattagcgtacatgctggagtagttattaggttaactgtagtggtagaataaaaagaaaacaagaagtcagaatccaaattcttaaaagttggcatatatatcaatcagttgtttttagaatcttatctatcctaaacagattctaagtattcttttcccatgattaaatgaatagctcaattgaacataacattgttttcagatgagctagtgcaattgcatgctgatacgtggcacagcaggagtagtggtaggccacagtgaccgaactaacgtaagtacgtgccagctatagcacgccgaatgcagcgcacctcgaagaaaagaaagaagcatatgcatatgcatatgcagcagcagagacctagctgaatgcatcgcacatatccatgttatgtaaccacaatattcgaatgcaccgaatttttgtgggcgcaggaccaatatatacaaaagcattgaaagcacagagacactgatatatcgatcaggtgccagcgtggagggcgggggccacgggggcagccacgtgaccctgcatctcaaggtccacatgcacaccgccacgcgtccgtctcagggccgtcgtcccctccatggctccatcgcatagttagatctcgtgcatgcggcatgcacccttgggacgtgtttgataggagtacccactttggtgcatgcatggattatattggtgcgccatatcatatttagatgcatgcacacaatttgcttcaccgtcgttgtctcgtccccactcggatccatatatggttgaaaaaactggaccagatttaaatactctctctgtatttcaatagataatgttattaattaacttttaaacacatattttattatatgtattatatgaaatgttgtgcaaatgtataagatataaatcatactagaaaaactcataataaaataaaccaaatttacattttttttaataaagctaattgttaaatatgtgtcaaaaagttaatggtgtcatttattaaaaaagacaaggcagtacatgtgcactcaaagatattcatataggtttatttcttctgctaaaaaataaaatacatttgatttgcaccttttaaaactcataaaaactagtaaaatataatattattgatttgtctggttcatcgcttcgaccgtggttgaaccaaagaaccatgaaccgatagagatagattgacctggttttctcaactagctagctgcatcgtctagtgacttctgctcccgaggaaacaaaccacaccagctgcaagcacgaactacgtatacctatggtgctttcaggtcaccttttggctagggtatgtacgtacagtacgtagctagcttatagctagcttcaacgccaacgattttctgcaaaaccatgtacgatatgatcgatcgacattgatgaatgtcctgactggcctccaatttggctatctatctgctaccttagctctccccattaattttggtactagctcgttaggctctattgacacacgtacggctttcgtgtttatacttttgtatcgcgcaatttgttgtgcccactgtttttcttttttttccatttcccactatatatatatatatatatactccctccttccctaaatgtttgacgttgttgactttttaaaacatgtttgaccgttcatcttattcaaaaacttttatgaaatgtgtaaaactatatgtatgcataaaaatatatttaacaataaatcaagcgataggaaaagaattaataattacttaaattttttgaataaggctaacggtcaaatatttttaaaaaaagtcaacgacgttaaacattttaggatggagggagtatgtatatatgtcgacaccattttttatcaactactatccctagctagttatagttatagagtgtgcaactgtgcatacacatacttgtagtagtacgtactgctacgtactatgacgacatcgacgaaccttgcttgccccaataaaaatcgatcgtgatacgatttgagatctgctgatcctttacgagtcaactagctacggagtagcaaagcaagtgccatggtatttccacgtttcttttgtaaagccggacgagtagctgagtagctagctgctaactccgtttcaggttataaaactttctagcattgtctacgttcatatagatgttaattaatctaggcacatacatgtctagatttattaacatatatataaatattgacaatcctaaaaagtcttataatattaaacggaggaagtagcagtacgtagcatgtatagcaccaccgcaatatactggcgccttcgtttttacaaaagctagctagctagcgcggctttatctcccattactctatttaacacatatagactgtgtttagtttcatgctaaaatttaaagtttaaaaaaattgaaataatgtgacggaaaagttgaaagtttgttgtgtaggaaaattcgacgtgacggaaaagttgaaagtttaaagaaaaaaaagttgaaatctaaacagggccataattcgaacataaagagtcctactacacatacaactataccttatatatttagtatccgacctcgtctaatccaccaattcatgcgttcaatttctcttcatatgagtttacgaaaacaacagccatatctatatacttgttgagtcggacatagatttgggaacggatccagcctagcttgacccaaggtctcggccaacccattacagtttaggataaacttgaatgaacatggtaaaattttatattgcataatgtgcattcaatcctaggactcggaccatgcatgggccggatgatccgaggcatggatccgctcctgcatacacacgtttcatacgtatagccatcttcaaagcataaaagttggtagtgtcttgtgccaaatgcatcactctttttactgcacgctatcttaattatcagctgcttaatttggaggataattagtactgccgctatatttacctttattcacctaagttaaccacctcagttattattcgctaactaatctacctcggttattctcgacgcatatataaaattaagtataatgaatttacttattttcagtgtaatttaaagctctctatgtttggcaccctttgctgccacgccgccatctacgctacgtgccgcccacgcaaccttcgtatccaccacgtatttacacaccggagcagtagcagtaaaacggtaaaaaaaacaaaaaaggaaaaaaggaaaagaaaaaaaaatccccgattcctcgcgcgcgctggccccaccagcaaaccgccaggctgtcatgctccccttctccaagcaacacgacaaaaccccctcgtcttcctcctcccccgtgtatataaagccgcgcccctccacctccacctctccatcgccatctcatctcacccatcaatctccattgctctctcctctttcttcctcaacctcctcacactacttgtactaccaacgcatcggcatggggctctgcttgtcgagcggcgtggcggcggcgatggccgaggcggggatggcggcgtcgacggcgatggtgctgctgccgacgggcgagctgcgcgagtacccgcgccccgcgacggcggcgcgggtgctggaggatgtcgcggcggcggagggggaggaggaggatgtggggcggcgcttcttcctctgcgacgccgacaagatgggcttcgagggacccgtcgcggccgtcgccgccgccgcggagctccgccccgggcagatctacttcgtgctcccgggcgaggtgcggaggcgcgggatgcgccgcgaggaggtcgcggcgctcgccgtcaaggcatccgccgcgctcgctgccgccagcagcagcagcaccacatccggatgcggcggcggccggcggcggcgcgggtccgtggcgccgctcgtgttcgctccgccggaggaggagtacgagtacgacgcgtctgattactgcaagagcaatgcgtcggcggcggcggcggcggcggggaagcggcggccggtggcggcgcgccgcggcggcgggaaggggaggcagttcgctaccgatctcaccgccattcccgaactcgacatgatcaccgagtgagcgagacgacgacacaattgaactgaatcgatcgaaaccaaatttggggattcaaatcccccaattcgatctccaaatgcgagctggattcgataaaatatgtcgaaccactccgatgggaacagccagcaaggacgcgaacagtggaaaacctctgatgctgctggtgggcccggcgctgctcggccgtcggatcccgatcggacggacgaggatatcatcggctgagatgctgccgatcgatgaggaaattgattagcactgcaaattactagtaattacctctcgaagaattagtagtaggaattttgttggtgatagatttgagttgatgtttgaacataaagagtatggagatgaaaaaaaaaatgtgaatagaaattctccggcgcttgatttctccacgtgtttgtctcaacctctcaaaatactggtccatacctagcaatactccactttgtatgcttttttttgaaacccaataatttgtatgctgaacaaacaaagaaacctgtagtgctacaagacaattgactaaacaacgatcaatttcgtcgtcttgtttgagctaatactccaaaaattgagggcagcgcatcatgacagattgacgggacacgtagagacaaaagttgtgatgaaacaggaagtgtttcaaattagtaattgtatacgtaatatttttagtatcaattggaggaaccagcgagtcatccaaggaaggacctagaaagtgagtccaacttttttctctttttgtgatgttttaattattaagagtagtatcgtcttaattttgaggggaaaaatgtgccaaaagaagagcattgtaaatgctgaattgggtgggataatcgatcgatcacagaggatatagtctagtccaaatcgttcgttttcagagcagggttaattagcgcgctgcagctatcaattaatctcccgatcgttttcagggagcaattaaagtacgtgaaaaaccatcgcgatctgacgatcgatcactttcatttgcctgacaaataatccatataagtacacacggagatcgacattttcggcgtcttggttcctccacacggttcattcgcgtgctgagtacagcggtgtgcaagcagagcaggagatgaaaaggccggcgttttcgtgttggagttgaacagtgtgtggtgtccagcttgatgggcattggtagctttgccagattcttcagcttattcactcgcaactaagatttaatttctaaaacttaagttttgaagagttgatttttgatgtttttaattataagtttatctcgtagtgttggtttttaaatcgttacggctcgttaagacacactgtatcatactccttccatcctaaaatatatttttggacttctatacagtcttcgagacgttactttaaccaacaacatctataaaaataagatattttaaataaaaagaattacatattatgatagtttgttgaatgataaatctagtaacatcaattttacatgattgatctttttttatattttgctattaatagttaaagttaaaaatgtttgactcgacacaatgctaaaaatatttatattttaggatggagaaagtaaattgtttttcattcgttattaaccgttttttcttataacgagcttcgattttgtgtagaatagttgctctgctgctggctattacagcaaggctgcaggctgcagctatggagtcgtagctactagccaggaggcgcgcgatttgtaccgtgtaagagcaagtataataaagagctataagaagagtgaatgctaaggtggatgagagagaagaggggagagatgagaaacgggctgtaagtttacagccggcttaggcacaggaaccaagaaaatatgtgagacagataggtggaccatatatttatagtgaagagttaaccactatatgagtgagttgatagataggctataagtaagcagttggctttattattatccttgctctaacgcggctacctgttgctggtgaagcggtaacgtcagtggtgaggtcaagtataatagagggctataagaagactgaatgctgaattggatgagagaggagaggggagagatgagaagcgggctgtaagtttacagccggcttaggcacaggaaccaagaaaatatgtgagatagacaggtggaccatatatttatagtgaagagttaaccactatatgagtgagctgatagatagtaagcagttggctttattattatccttgctttaacgcggctacctgttgctggtactatacagcggtaacgtcagtggtgaggtcacgcaaaagcgacctgtaattacagctgagcgagcatgtctcgtctggttcttttttccgtaaaagaaaaaccaacttaaaattaagatgaagtttagatttgttgtatatttgtattatattatagtatcttcttcagttttacatttggacttttatggaacgaaacgagtaggcgcgtgcaaaggcacacggggatgtgaaccgacggacggccggccggccttgtggtgtgtgaaagtgtgaaccacggccacttttgcaagttgttgcattgcacggatatgggatctgatcgatcagcaggtcaatggcgtgcatgctgcctatatatcactcccaacattgctatagatctcttaatttctttcgtgtttgcggtggacatcacacgatcgatgctgcccgcgcctgaattgaaggctacatcggtcgtggcatcaatggtttagcttagctagggtgcggcgaacagacgatgcagcaacccgctttaatttttatgtcaagtggtttatttctcacggtttctcattgctcccaataaatagtgttcatagcaatcacaataacaatattatagaggcgacagattaaacatgatatatagaaacttagcggtcgctatagcgcttaatgattgctactgattttttttggccactacagtgcttaaatggcatttttcatgtatggattagagaaatttttatgcttcgaatttatagatttttagtgatacaatctaaatttatgattattttttaatttcatatgaaaattaatccgctacaacctctatccgagaatataagagattttctctatataaccattcattatattgtcggacggagatagtatttattactagcttactcccaattaggcatgcacgtatagagtcccagcctagatcgctagcgagcatccatggaattccccatccatcatccatcagatgcgctcgccggcccatgttctaaatctacctatgctacttagccaggcccatatactctctactcactaatccattggacatcggtttaattactagtgcttcgcaagttcacatgcttaaggttataggcaaagcaacacgagtttttacctgctgttcaaaacaatgtataactcgatcgatcctgtcaactgtgctgtaacttgatggaaactcgttcatccatctagcttagttccttcacttggaaatggaataagttatttggaaataaaaattaaccaagttcagaaaaaaagaactgccattgctgttctgcagctagcatatgcgcaccagagtttgtatgtaagtactgtaatacgcagcttcattccgttggcagcaaacagcttaatttcctgtgcttcacacagcgattctactacgacacatgacagcgaagagatgagattcctcgaaaggatcgtcagaaacatgtactactaccttgtttcctcctggtgagaaattttgtgctggattcagattcttgttgcacagcttcgaaggcacaggttggcccttttcgagcctcaatatgccgtgccttcaggacctgacatagacatacaatgacaggtactaacatactcccttcgtcctatcctaaaatataaaagatttggttgaatgacacacatcctagaatctgaacatgctcatagaatatgccaccctctaaccaaaattcctcaatttttgagacggagagagtaaaatcgccatctatccctccaccgcatcaccaatacaagagacaacatacacaacacatgaaaccaaactgctgatgacataatactggtatcaactgagcagcatactgatggagttcaccaacgagggcaattagcaagacatggacgatcatagatagatataatacataggcttcaatctttagacaagtgtgctcggcacattctacagaagatcatataaagggcctcaaagactagctaaatcctaatattgacaaaagcccaatttcagcctaacccataacttgcatttggagaggcgaggttggtgtcgaaaggtatctcgactctttccttcacaacacagtgagccctgccatcttcgagaaccattactttaccaggagggcattggacagtagcctgatcttttccactggttgcctccttactgaacaaacctgccatatccaattttatgctgtgtcttcctatcactggctcgtaaccagcagccttcatgatagatacagcacctacaaccattactgcagttttagcaagccatccaacaaaagatctaattcctccttgtgaattgccgtttggcatgctaccattcctgttctccagcctgtttgtctttgtaacatcttggttagtcccaccagaacccaatccgttgtgcatacactttaacttggccaagtaacttggaggatacagatcatcaagaacaaacgaattggtgacatgatttgagtacggaggtagcatgagaccatcatcatgttcaattttttcaccagcaaaagaagcagcctcatgtattacttcacagtcctgccccttgtattctttgagcttgttaagaagacatcctcggctgcgatcaatctggctcaaaatggtctctcgttcatatctttgttggtgttggaggtcctgggagtggcagcaagttgttcaggcatttagtatgtactccctccgtttcacaatataagtcattctagcatttcccacattcatattgatgttaatgaatctagacatatatatctatctagattcattaacatcaatatgaatatgggaaatgctagaatgacttacattgtgaaacagaggaagtagaaagcaaaatatttagcaatgaaaaatggcaatctagattgtaatagaacacattcaagtcctaacaattcaatgtgatagaagaagacttatttaaacttaaactcagatggaaataaataacagaactaaacaaactcatggggataatgcaatggaagccaatcctagttcttaggaaattcactaacacaagcaatagtaagggatgcatcttaaatagttaaataccaacctagtgcagcaaagcaagtaaacaggattcacaagttttacagttaaatttggccatttggttataactaaaagtgaaaatctgcatcccaacaactcatcacacctcttaccagaagcacccttctcccccgaaagcagagaaattcctagctaagaaatggcaggtttggtatatgagcttaactaatggacagcaacttcgttcgctctgcacaccttgcacagtcactccagtcataccctgttcctatgataatatcatttgtttttaatcatttcaaacttcaaaatgcccttatttgcaagtatggcattgatacctatctatcttttcccctctcataaaccttctactatgcgattattatagatttgcatcattcggagtatattatataatgaaaagtaataatgcagtacaaaattactaacccacaatcttcaatgcaagcctcaatctctactagaaaatgaggattagcatatttacacatggaacgaaacaccaagaatagatatgagatgagaatgacctgcagagaggcgagctgccgctcgagcgactcgagcgcgttgctgataccgaccaggctctccacctcctcctcctcctccccctcctccccatcgcacagccgcttcaccgcctccccgccctcgccctcgccctccggcggctccctggctccggccgcggcgacgcaggcggagatcctggagcggaggtcggaggcgcgggcgaggacgaggccaatctcctccccttccatggccgccgccgccgcaagcggaaaaccctagctaaacccccgcacggcgctaggagagcgcagacgcgacgcgagctgtggcggcggcgcgtcgtcttctcctcctcgtggctgtggtggtgaggaggccgtgggcgtatccgaatccgaagctttgcatgacacatccgcctgcaggtgggccccgagtcgatgctggccgttcgatctgatactctcgtgatgggctgctttgcgatctggtccatcggaacagaacattttcattatcatccctctcttggatttttaaggctgtgtttagttccgaagtttggggaaagttggtagtttggaaaaaaagttgaaagtttatgtgagtagaaaagtttttatgtgatgtgatgtgatggaaagtttagagttttagatcaccctaagcttcagtccctgtatttttcattttagtcacgaaaaggtcctatccaccgtcgccaccatcagcaggagcgcgcacgacatattttgtgttcaattgtctgcagtactgctgatgtagtagtagacactaaaggctgtgttctttgcttatcgttggaagctaattactctcacacataaaatagagtgacttattagtacatgattgattaattaagtatatgctattttttttaaaaaaatgtattaatatgattctttgtttggtgcatgattaattaagtatatgctagtttggaaaacgtgcacgagaaaaacgaaggtgagttggccacttgaaacacaacccaaagaactcaacctattgtgtggatccggaccctcatattatccattgcttactgtttcagcaattctgcagaggatctgcatgtcatgttattggatgtggcggtgaccacgaaacccgcacagatcgtagaaggaatttgaaacgaaagggggcgactttgatttgcatattcaaatctgaatttctgaactgtgtctggaactggaactgaactaaacgatacttatgtttctctttcagtttcagattaaagatttgaactgaactgaactgaactgacacttggtctcaactttcctctattttttttcctctctgtatctacaaaaataaaaaagaattttatctttacaagcgcacagatcacactctgcacagctcaattaatctctctccccccccccccccacacacacaaacacaatcctagataattaggtgtaacatcctagaaccaaatctatcaacacatgaactaatcatcttcttctaatctcactcactcagactcagcttgacacagctcaagccaagccattcatggcggacgccaagatcggtgagctaggtgaggtgggggaaggcgaggtccctggcgagcaggtagcggaagctgtggcggtagggggcccactcgacgaccttgctcgccggcctgctctggcggcaccgctgcaccgccgccctcaggctctccggcaggcacctctgcacggcgtcgacgagcctctccggcgacagcctcgcgtccctggcgtacgactccaccagcttcggcagcgtcacccgctgctccttcctcaccccgaccgtcgcccggatgtactcctccctcgccgcctccagctgctgcgacagccgcttcgggctcagcaccctcacctgccatcgccatgaacacacatcaccaatcatgaattcctcttctactactgtagtggagtatgcttacttcgatgcagaaatgatgatgaacaaagtgcagtggatgcagtgctgctgctgctgaaacattccatggtacaagtttccagcagcagcagctgctaggtaattaaggtaggtagctcatatcgaggtgaagaaatgagaaagaaaagagaggagatatactacttgtcaagtttctttcatgattgtgtcatgtcaggatttgctttgcatggatagctttaacactttgagaaacatgcgtactgtactctactaggattatgttcatgttcagaagttcagaagttcagatttagagtgttcaggaaatggcatgcctagcttggttactgtttctgtcaggtgaaaaaattaagagatgggatggtgtgttctttttttttaccgcgggatcggaatggcttcctgaacaaagcgcaaagcgcaaaagaggctccgattgatggatggcaaaggcttgccattcccctcctgctttgctcgctttgcttttgatccttgggtgaagcaaagtcctcagccactgcttgcattaaaaggatcaacaaaaattcaggttaaaaatttgtgtttaaacatctcatcaagtactatgtaggaacattctgttcttcactaggttcttgaccaaatgatgtccacacacacatacctgtcctggacagtgagtgctacatccaagaaccaacccctggatgactgctgcattgatggttctcccggcaatcttgcattcagcctgaaggaagcatttcgagacagtctcagaacaagatcaagaaggaaaaaaaacttttacttgttctcgaggtcattttgacgattctgccaggagtgaggtcccactttaccttgacaagaagtgatgtcttcttcagatggttctgtgggatgccatacttgagatatgcctgtggaagttagtgccaattgtcattatattcagacttcagagaatgagtaggcagaacagtagcagttacaattcactgtgcataatttgaaatgagaaggaacattacatgcatcaacaatgcgttgtgtatgttgatccagaaagcaatcttttcatcatttgtcattcttctcagatcaatggtctccaaccgatacaaaattaacctgaagaaccaatgctaattataagtgtatagtactacagatatcacagttcagagtactgaacccacttgaggattgagagtaaaaaagcaacgtgaaccattttcaagaaccactcacttgtaagtttggagcaaatcttctacttctcttaatcttcgacgatcacgggaaatcgatggaacttcaaccatggtgttgtacggtccactgaactctttctgcccctcgacgcgaaacgggttgatcaaccgggagtcgagagttgcttctttcctgcaattggggctccacatgtccccaagatactgtggggaaaccacactggttgaggagaatgatgatgccggagacgacgatgcgcggtggtgcaccagaggaggatcagcaagcttgcagtacacccctgccatgcacctgaccatctcctcagagaggttgtttggagtttcagggatatgatcagctacatttgtccccagatagtcagctaagcttaccactcctgatggtgctgcttctccttcctgcttatgaacacaaacactgtcagttaatagcagaattcagattcttaaaatgttacagtgctaatactgaacactagtcttacatattcagtttcagtgaagtttctgctaatacttttgttaatcttagtacttctgaacactagactgtaaaattagtttctgaaagaaatgcagtaatctaacaagtgcaatctgaatcccatggcatcctagaattatcaagataatttcttgcagaatttctttaaaaaaaatgtttgcagactaaacaatcagtgaagttaatttctgaaagaaatgcagtaataatctaacaagtgcaatctaagcaaatttcacggcatccttcctgctcatgaacacaagcactgtcagttaatatcagaattcaggatcttacaatgtaacaaaattcagtgctaatactgaatgctagttttacacattcagtttcagtgaagtttctgctaatacttttgttaatcttagtacttctgaacaataagctgtaaaattagttgctgaaagaaatgcagcaatcaaacaagtgcaatctgagcaaatttcatgaattatcaaagaaattcttacagactgaacagtcagtgaagttcctgctgatattttcttgtgtaaaaaaaaaaaacttctgaacactctgtaaagttgatttctgaaagaaatgcagtaatctaacaagagcaatctgagaaattttcattgcatcctaagaagagagaaaaaggaatcacctccaagaatgagaaaggctgagagtggcaggagcgaagagccctcgcgaggctgtcctcggacggcgagatcctggacgaacacactccccggaacgagagcgcggactggctgcggaggccactgtactggtcggacgaatccgtcgtcttcctcgggcacgtcgacggcgagcagtcgtccgccgcgccgccgccattattccacctcttgctcaccggcgccggcgggcagctgtaatggatcgcgtcgccgcctctcctgcctggagccgccgccgccgccgccttcgccttgggcgtctcctccagaagctgcgagcaccgcgagctcaccgacagcctcgccgcatctgaacacgccactgtcgctgcttgctgctgctgctgatcaaatgctttcctgtacagtgtcaggagatactgctccaggtgcttgatctctagctccaatgtcgcgacctccctaatcagctcgttcgcaggttgaacctgaaacatcaccatgatccgatgaacatgctgttcatggctggatggatcaagctaaaagagaatggaagatagtaaacacaggaaatgatttcacctttagcattgggctctcgagcgagagattgacaggagcaggatgatcaggatcagggcccagtgctttctccagtgcgccgcgcaccacctgctgatccttgaggtgactctccagctgcagaatctgcatcagaaaaaaattcagtaaaaaaattaagatggagattaaccaaatgtccttgcaaagacttgacttaggatttggttttttcagagagataagtacaggcaggtcaacattggaagtcctggagtgaactgttcttgatgtgagtacaacaaccaataataatggataggttcaatgaagaacagtaaatttttttcttgtccttgcctcttttctcaaggagttttgtgcctcactcctggatggctgaattcccttcttggtttcactcttcagatgagggtttgagtttctaccaggctggggaaaaataatagaaaacctcagaaatggctcaaatttacagcaacaagtaacagaaggaatcttgcaataaacacaagaacctaccagcttaggttgattgcatgctttcagtgaagaacacaacgcatctttagcattcttatcctccaaatcactgacattacaagaaccataaaaatttcttgattaacatttattgttggtaagataacaacaacaaaaaagcgagaaactttcagaagcaagttcatatgtccaacctctttgaacgattgtgctttgctgtggtattggagggcttcattgctttgggcaaggatttacgccctttcttctccagtatctccatctctgttcttcaaaagaacaccttctggaaccaatcaagaactgaaaccaacatggaaaaccaaaccatggcagtaagaaacaactgatcaagaaaagcccagaaaccaggtggagagaagcattcaggaagaacacaagaataacttacacaattattcccagcttgctcaaaactttgaggagagtttaagagagaaaagaagggaaggagagagagctcccaatgatgcaggcgagcagaatggtggattcagagagcagagaagccacactaaaatccaagaagccttgcaactgtacacagccatcactgccaatgtgccatctatctaccaccaccaactcctcctctccaggtcaaagtgttaggctaggtagacattttgcaaagggaaaaaaggcctctttaactgcatcttcagttacagaaaccccccaaaacagcatccacaactggcttgttatagtgtagtgtgttagcctgcaaaaaggcattgaccatgacacctaattaaaaaaacataagcttttgcctttgcttccttgttgtgagtagtagatggtacagtaatagtagtagatgataccatattaactactgcacctttttgccttggtcagaaaattttactcctgccatgcaatgcaagctcttaatactagtagtttttgttacacagctatggaaaactaggggaaaaggttgcactttttaaacttgtgcttggttatttgtgtgctgttatttttaatcactgctcctgacctggacataacaatagtttcaggtacagtggagcactgatataacaattaggttagtggaagattgttgtctcctcttccctaatggagccaatgctttctgacaaatgacaacgcaaacgatagaattagggacgcggatcatctctcttttcctaccaaactaatcaagatttcaacttcaaaatagtgagcaggactaaatggtcacatggtgacatgaagctatggaaaataaaggcaagaacattgataaagtatagcatattaaactcttgcctatgattaattctggtacttgttgtacacattttcactggtaggtttgcggatgtgacaaacagaagtagaatttcattcataattccagtattatttcatttccctttcacattgaaatctttgtgacattgatggacaagagaacaagagtaggatatgaatgcagggctggagtatgagttctaggtctttgactgtggcatttaagtaacctaaccacctcatatagcttcaagatttttgcactattctctcttttttgttaaaaaaatgttcataatttcaatgtagtactgtatgtttacatcaagagcaaaacaagtgccaaaaaaggggcgttttggtttgataccaaaatgttgccataccaattttttggtagtttaaatagtaaatgtgatgatttggtttgaagccaaatatttggtaatgcctatactcaatttggcacaattcttgaatattcttcactacaatttaaaatttggctcttaatttacataaggctgttttggtttagtgccaaatcttgccctaccaaatttttggtagtctaaatagtacttgtgtgatgtttggattgatgccaaaacttgccaaatcaatagaaatctctaccaaaatgttggtagtgacaaaacttgcctaaaatttggcactacaaacaaattggtatgatagcaatccaaacatgcccataaatccaaaagcacttatttacaattctaccctaccaatatattggtagtgccaaaacttgcctagagtttggcactaccaacatattggtagggtactaaaccaaacaagcccaaaatgtcttctgaactttggtggatttaatatatgaatttaaaactatgaatccaaatttatttttttacattttattcatttatttattcaaaatatttcttttttgccatattggtgaaggagtccatctagaactgttaaataaagacaccagaatatgaaaatagtagtaggccaacactacttaagagaaaatcagtcattaaagacaaaaccatgttttgtccaaagaatgtttaaaccttcttcaggtgcatgaaactaaaagaatggaagaaaaggtgcagggggtagcctcaaaagtgatgaaagtggggataaagggggcaatgtagctgtgccccaaggaaaacaagccttgccctgttgggtgcttcctcttgttttggactagaaaccactagtgctcacctcactcactaagctttctctcctcttctcttctcaaaagaaagccccaatacaactaagtacttgtcctctgccctaagggaccttcttgcttgtcacaagaataatccttgttgtggaatgttgtctctgcatgtctcatttggatgagtttgtggggctctgaatttgcatttcactttcaaacatgcatgggctaagtaggacaaataaattcggctatgtttggctggttggcctggacttacctgaacctaaattaagtttttaatatagcaaggttaattccacttgtctgattgtatagtagtagtactagattcagtaataatcccaatcaatttacaaccaaacatatgagattcacattattcatacaagtgtttatgtcctgcgaaatctcagcatatctaatttttcaacaaatatataacccaaggaccataatatacaatttctggaggagggggtgggaatattgataatataatagtatatattagaattcagatcgacagaatggaacaacaattcgagttatcattcatgttaccggtttatgtccattagcatcaccagtgtcctttaactgttctaatgattataagatgatgcgaaagaaatatttatttgccagccagccacaagaagataacaagatcgacagacaggaaaacagccggacatatgcctgcagtcagatgaggcttggaatctgtagaattataaatttacatcgtcaaatcacacatggatcttgttcagatctgaggtttgatacctaaactgaagaagggctatacctaattctgtttcataaacttgcggtcagatgctaaacaatccttaattcttcaggtgactcttaattaaagaaaaatatgttgaggtgaaggaccaaaaaagaaaataattactgatccgaaaatatagccaaagaagtaatacaactttaaatggatcagctcagatttaaccaatctatgtccaaactccaaaaactgaaaatatttgtttactataagcaaaagaagattcctctgtggttctctgcacactatgtttgataagcttgatcttatctaagtgcaactgcgttcaagtgtgcaaatttttagtctccccaaggtctccttctaggtttttgcaccgtttttcttctagtttacttcgaagtcaaatgacgggcgaatccaatgtcttctatcaaagtccactctaatgccatacaaccaagttgctagctaatagtaacgtaattaccatcccaaatgacaacccttcttaagtattttctatagaacacatgaaaaggggatggctttggctgatagcttttctccacattgcagttgcagtggcagttgttgtggatgagattgtttattttatttgtttcaattacactgaagacgcatatacacacgtcactacaaatatcacacctacaaatgcgtctccccaatactcgctcaaagagttggaaaccagcggcaaatccccactaaaattctattgaaaatgtacccatgcgtgttacttttgttattaggagtatagcactccatttggaacacagaaatttacgccgaaattacaaatagggaaatactccattttaacgattttaacctgtgtaaaaaaacataattaaacacagtaaccacaatagttaccatgagtcatgacaacaatattccattaattggaaatacttccaatactagtggaagcaaaacaattactccaaatgacattggtcttatgcttagcaagaacttttggctctcaatccgtacaattggcagcatgcttcaagggcctcgaaataaccactataattaaccctacaattaggaagcctaagtgaatcttaattagtactattagcattagcataggtctcaccgagaatcgtgctgcaccctacagtgtgcatgcatgcacgtaaaagcagaaaaggccaatgatacgtgcgcccaaacttttttcttgtgcacacactgtctcacagagacacatgaaaaaaaaaccaacaccaagaggagaaaaaaaaaatcaaaatgaatggcccatgcaacaaaagccaaaagggatcaagaggcttaaagggagaaagtgaaaaaagaagagtttcaatacatatacccacaagggagacagaaaagaaaattttgtagaaaaggcaaaaagaaggaacaatgtgagggaaaaaaggcccaaatttttcaatcatcttttcaccaaaagatgagacatgcttcaatattagcgggcgagggttgcatggttagatttaaaaacttcgaatgtcaggacagcagcacatgaccttaatttgctcttcggcttattagctgtatacaaaatttgaattttaaatcttatttttagagctaattttgatgttttatcgtagtttttttccggtattgatcgttaagtcgctaagaacacatatataaatgtttgcctataaattattttttatcgctaataagcttgacggcttataatcaataatgcctaacgatgtcactcaccgaatgtgcatcagttaagcatgagaaagttgatttgttaaagcataatgtgaaactattaggagctcttcttttttatataaaatacttcatccgtccctaaatataagggattttgattggatgttatataaaatcccttatatttagggacgaatggagtatgtattaatagatagtggaagaaagcataatgtgaaattattagaagctcttctttttcaaaaaaatgtattaatggatagcggaagctaattctgaattttaacaatggattgcatagcaacggccaatagatagtggtgtgtgagtgttttatgacatgactaatcccggttttattgcttcttaatctgcggccggcacaggtgaggtcggtggctcacggatgtgaattttgtcgtcagttttgttgcaagttacagagttacagcatggtcggtgagataattgccaaaagagtgaggcgtgttgctgcaggtatgcaccagtgcatcacctaatttgctactctccttttgctgaataattactaccacaaagttcttgtatctgaaagcaacaatttctaaggaaatacagctatttataacataaagtccaccgagtggaacaacggttatgtatattctcatcaaccatagacagaagtttgtgttatctcttatctttaggctagtgttctaagtagctcttttttgttgttaaccaagtagttaatttttgtgattcacactcattcgacctgcaacttatgtaataattggatatagttcttttgaagtaaaggtcgggataaattttattatctgaaataacatcatggtcacatagtagtgttagggagtgataggcaaacaaacgataaaaaacaatagatcaattacataaggcacgagatttaacgtggaaacccttccaaaacaggagaaaaaaactacggacatcagccagcaaaatatcttcactatatcgggtgaggttacaacgccgcacggcggcttacaagaggtatatatatgagatggaaccctaaaaggtattacgatccgtaccgcgggggctccaccctcgcaccccgggcgttcccaggtgcacagcccaatgggtctccggcagaagctggcctttattaagtgcaaataaatttggattacaactaaacaagtagcactatctttacactgttctgaacatgcatgctaatgcagctgaaaggataacatgtttctgcaaacacaattctagcatgcaagcatataggagtactacagttcaaaggtgacattgccctcttggcacttgctgattgtacatttggtggctgacgtggatggatgcagtcactgatgacgaacaaggagacctgtcagacttgcactgatgaccattttaacacaatgtcagagtgacagtagtaaagagggaacagagggatctccgggtggttaatgctgaagatcaagcattcattcattcatttttggctcaccaaccttcaggattcagtgaagtgaatgctcgcatgcataagcttgaatggcacgcgtatctggcaacctgatcaaattgcacaggagattcagagaagccgatgcaaaagcagagtgccaatggccacagtcaaaatgtattcaggcaataactgtacatgcatgctttgcatatatacagtgtagacacagatgtgattgcaaatggatgggagaaaaattggacagtagctagcctattctctgagacattgcaatagttcagttttcaggctgacagagtagtgagtgcacaagtttattttgcctgattttgctattcatggccaaaatgcgtagcagacaaactggttgtactcaacaagaacatcaagcaacttaagacataataattcacatccaagatagtagtagtattgctcacaattagtagatcatacagcaggattgattcctgtaacaagaaatcagagagctatcacatttcaaggcattacaacacatgaaagatagtagtattgctcacaattagtaaatcatacaggatttattcctgtaacaaagaaatcagagagctgtcacatttcaaggcattacaacacaagaacaatcagcaattcagcacacacaccctcagttcagttaaaagagcacctgcactattcctaatcctacacaatttttcttcttcccttactgatgttctcctaactaacaataccaccaagttcttacacatattatgcaacgtgtaagcaacatcaccctccatttttcatcagctccatcgcgattgcgacgaagaactcgcttgctgatcagtgtaaggcctgacaaaggttctcctccaccacacctcgaatgctctctgaagatttgggcagctatctccaaccttgagaaatcttccaagccaggtgagcagaatgctctgctgatcctccaatggcagcgtcaggatggtctgccctatcccttcctcgatgaccttccgatcaaaccacctgcagccatgctgcaaccagttgtaatcatccatcagaggctggagccacacatcaaggaggagctgcctcgtctccttagacggtaacgcctcgcctttccctaccgcgacgaagagccttgcagtgacacagctgatgagatgccggtgcatcactggtatcctgcaatgcagcttggccagctctccctggcttgcccaaattgatgtcagctcatcagctgcatttctgtcagctaagatctcagctaaccagaggaggttatcagcctctagagtgatctgtctaaagatcacctctttactgtctgaagattgctcagaaaattcaggttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12964 - DNA, 454 bp, Oryza sativa
cattaatatatattatgacagaatagttgatagcactagggtccaagcatcccacttttatcctaacagctccttcccccttcaaagatttctcatccacttctttaaattcacgccacaatatcagatattgctctaatgatttcctgctttttggcgaaacctggaagaccaaaaacttttacccagatcacaaagagctcatccacagcattgtcagtcatcttagattctattacactagctttgatggatgaggtcttaaacacaaaccccctgacttagtaacttgtcttctagcatcttcactcgggaaatcaatcaagaaattattactgctgatttgcttcacattccaatcccaatttttctccctaaatagatgagacatctcatttggccaccttttgcactgaaccagcccctttctccacagttaggattcctctgaatt

SEQ ID NO: 12965 - DNA, 1214 bp, Oryza sativa
ctattactgcacctgcatgtccattcaaaactctattagtgaaagctttgtatctacaataattcattccaacacaacacatacgctcgttccgcgcatgcgcaagcgcaaccaccgctacccaaccgcctccatagcctccttctgagtgctggccgaggcgcaacacaaaggggcacgttttttctgagtctcttcttcttcttcttcttcttctcccacacccacgccaagaaaagccaggaaccacaccatgcacaaaacccacgacgaacacaccccaccgcctccgccaactcaagctctccgatcgatcgatcttccaaccatatatataacccagccgccgcccgcttcctcgatcgatcccagcgctcggagcaaaaaaaagaacggaattgcttagatcaagagcgagctgaacagagccgcgtttgcttgcttgctttggaaggaaatcatatcgatcgatcaggagatgtcgtcgcggtacgtggagatgctggacatgggggtgcgcatcgcggcgaggttccactcccactgcccgcacacggcgcgcatgtactacaagccgccgcagaccacggcggatcacggcggcgctgcagcaggcaagcaggtggcggccggcttcaggttcgaggcggtgacgtcgtcgtccgccggcgccatggcggtggcggcggcggcggcatgggaggaccgcggcttcggcgccaccgcgccgtcggggttcgacttcgagtttgacaccgcgcaggccgtcgtcgtctacgaccacgtcgccgtcgtgtgaggaggagtttcgatcgatcgtatatatagtagctttggccggagaggatttgattttctcccggaaacaattttgacacaaagggattgaatttgattatgtgaatgtaatgtacctatgtacactccgttttattgttatttttgagatttgatagctgaaattaatggaagaaacattggttgatgcttctccgattttgacgtatacaactactgtctcatacttaccagcatatttgcgttggcatctacgattgtatagaaatgacgtggattttgataaatctcaaaaaaaaaatcttatatgaagatactccctctgttcgggaaagccagtcgttttaaggttggccggataaattaaccggaagtaaaatttaccatattgctcctatttagtggttgcatttgtc

SEQ ID NO: 12966 - DNA, 1539 bp, Oryza sativa
ttttaaagttaagtttctctatttttgcctcataaattgaatcatcagtgaaagaatgccaacattgggttaccaggcgtaagcacctgagatagagtaacagatatcataatgtggagaaggcacctctgttatgctgtttatatacaaggatttgtaggtacaaactgaccttaacagatactgtgcgcaatgcacacctacatctttagatatcagataatcaacaagcaccaagtgatcatagtgcagctgcagaatgacattaaaataaacaaatactattatcctcaagactcatattgtagagtggaatcagaagaagaaattggaaatctacagaaaagtaatggtgcatgagccagcaaatgcatgagactttattaagtttgtaatgtccctttacacattgtataaccctccatatgattgtctgaacttgaaagaacatggaacataaataagagtgtcttatttatttttttttgagtacaagctacggtaagaaggaatccgcaaccaaataaatagtaaaggatgcccccctatcttaaacagttttgaacactgctgattactaaagcttgctactatatttttactacatacagcagtatgcctgtgcagagaaatgaacaagaactgaaatttaaaatgccaccaatccaccatgcagagagttgtgcttcttataaacctagtgacatgaagtaaaagtattttcactgactcaccaataaaagcaagagatggaaaacatgaactgggtcaaaaatgctcgagaacagtttgccaccaatcagttcagaagcccatctattctccatgctatctctgcaagttcagaaaaaaaaagagcataacttttaactacacccagatctggataactttctaagacaaactgctttactctttgcttacattttcgaggaaatgagtggagcatcaagaagttgtaagagaacgttgaacagcatgtcatcctaaagtataaaggaacagatcagtattatgttaacacttaacactaggaaaattaacaaacttagctgacaaataacttaagcatctagatgaattggtttggaaaaacagaaagtgcagagaagacaaatacaactggaataaaagcattagcacctctctgtaataactaacatgccttttcactggggcttatgccaaacataacaggcaactctatagtagtgtagagtaatataaatgtatgagaaatatcctactgtaaggaaacaaattatgtccacaacaacccacttccgaagacaactacagcatacttgcaactactgccaaatccaagttaccaaaaactacttaaacaaaaccaacaagatgaaacatattttctaccttgaacattgatcaaggttaattagctaccaggcaattgtaacagatgcatacctcctccatatataactgcagaaagcacagagcattgtctgtagatgatttgaagccaaaaatcttatctaagaaacatctctgaaaccagtctgaaatttctgataa

SEQ ID NO: 12967 - DNA, 20352 bp, Oryza sativa
cttctggatgtaaggctttagccgcatcattatcatctgcattgaaaaataaatagcagactgatgatggtccaaaaacaaaatgtttaatttcatagaagaactttatatgcacctgattaatcaaaaactgttttacaattcttattcgtaaaaaatgaaaagcaacaaaaatgtcagtgcagtaatagaaaatctttgcatgtctgaaattaccagaaatttgtgctttaagtactgagagagacttttgggggcatcctgatgctctggtaatatagccactaacttaggaattacacctacaagcttagcatagatatcttgtccattgttgtcttccaggtcactttgctcaagtaaagagcacaatagttggaggagactgcttgaaagaaatcctaactgtttcaaatcatcactcaagctaaatgtgctatccttgacaaggtttagaggttctccaacattgagttgataatacaaatcccaatcaaccataagaatatgatgagcagatatacaaatgaagtcctctttcagttcattatcagtgtgtttaaggaactttaaaatagtgtgcagtactcgaaagagactggccaccatatgcccattgatatcaagacaccgtagctgaagtaattccacgaagcttgtgatattggtgcttgaaataataatgtcgtgacttagactttccataacagagcaatagcaaatcgagtcttttctgaaactgctgatggagtcaattaaagaaggtaaagcactatgagcgcatgttgatactgtatgtatagctatccagaccagctcaacaaattgaatccaaacaacctcctaaaatagagcaacaaccatggaataataaatatttttgagagagaagtgtggatcagattgaaaatgagaaagcatgagaagcttacaaacttcattagagagtcagagatgacaatcaggatattcccagctgagtgtttaacataactgctacagaaaccaaagaagccaacctgaaaaggatgatgtcatatactaacaaagtaagctgttgaagaaaaaaagcatgagggtacgaaatgtaataaaacagtatacagtcaccacaattgtcaataatatctaattctgaagcagtatacgtagtttaaaatttttgtggagccacagtttcaacaacttcctctggttaattttgttgttattttttcatgcctcccttttctattggtaagagtggatgacacattaacactacttacggatcaaatgacatgattcaaagttgttgatagagacccacaggtgatcgggataacgcctatgccctacttatatatcctgatgccaatatgcctgaacaaatgtaaaagattaaggttaatgaaaatgaagactaatccagtgttgctcattgtctttgtgttgctatataaacaatgaatgactcaggcagtcaggcactagcacccagaacccttcgcttcccaaagaccccaacaattacttattggttcatagtagcataaaaagtgccagatgtatttagtctaaagagccattgctcaatggcagggacgaagggtaatattgtgcacttcatatttaatactgtaacaggtggttatgaggaactgggaccatatgaggatcccgctgactatgattggaaagttgatggctgacgcaacaaagctgtatatgaaatattcttaccaatatggagataatattggccaggcagctaaatccatcatcaaaatgctggttagctggtaaactgcaactgtgaacttccgcggaacatgaaataatctcctaaagaaaaagggtaagaaacaaatgaatgtaatacttggaacctgagtgacagaatcaaacaaattccctcacaaaacagaaatcagttactacatgaactaagtaatttgatgccataaagacatttcacaagccattctacatcatcatcacaatcccaaaccactccctctctgctccgtgatgataccttacactacagggttaaagccatgtgctaataatagattttatcattacgttctaattcctcaaccccaatataaagcaaatgctcagtcagtcgcataatttcgactaaacctacagcagttcaacaatcaaactgaccaaaaaaaggctatcggaggcaatacctgatccaattcgcacccttcgtcgtcgtcctcctcctcctcttcctcctcttcctcttcccatcctcgaatcgccttacttacctaaaaaaatcccaaaaaaatcacggaagggaagggcaatagagcgcagcagtaacaatcgcgaaccctagtgagaggattactcgggagagcgcgaggaggatccgccgctcgtcctcccgtgtgagccgcgtggccggcggcttgggttcctgtgagcggcgcgcacggagtgataggctaggactaggagaccagagtcatcagaggccagtgcagagagctgcttacgaggtgggggaggagtgcgcaggcgacgaggtcgcagaggcgagcgagctgccgcctctcccgccgccgccgcgccattcgcgtcgcgccgcctctccccttccggtggattcgaattgggatttcaaattcggagaaaagtttttgatttttgcctgaaattctcggaaattcattcgaggttggtaaatttattggcccattgcgctaatgggcccggcccatcattacactacattagataaagcccatagtattataggccgtaagagtcacaaggggaagaaccggagagagagaggaacggcgatgaggaaggcggcggcggcggtggcgccgtcgaccacgacggggtacgggtccggcgaggcgaggcggtcctccggcggccggagaagccgcggaggcaaagggtgaagaggatgaaggaggcttcacctgccaccgcgcgtcaagtacatgcaccaactactatttctcaatttcattttccgcttgattcattctagtagtctcctataatttccactgagttttgggtctaataaattaatataagcgcgtgttagtttccactttggttttcatcgatgcgattatagcgtagtttcgcgttaattgagatcatttatctatagggtcttatcctatttatctatatgatcgtaaattgcagggaactaaggcaccttctgtcacatgatcccatcatcattaggtaacaacaaacaccagataaaagaagtggtagggtgggtgatgatcttaagaattcaagatttgttgtcgatgactgagtagcctccgccagcgagcatgataaggattggattgttttattttctttttgggagaacgattcaagtattgattactcctatcttggaaacgaaatgcggaaatggcatagttgattacagaatttttggctaaatgacgcgcttaagtagataaacacagattagacaaacccatgctaatgtaaatctaccctcgtttgcaacttcctacggttttgcgggtgaatgtgacatcttaattaggaactttcctcctccttcgtggaaacttttcatgtctctttctgtctttcatatgttcaacttcagtaatattacttttttgaatactcattatattattaaggtttagtaatattacaataatctcaatctgctctacttcttcatatatagacagttagttcatttgtaagacagctgcttactcctactgtcctacatgcatggtttgtccaggtccatcaatacaaatcaataacaccagtacgccactaggccaattctctgcatgtgacctggccagcttccaaatcttctcagagttgggatcagtggctagtatctcggttctttagtaagagcctaagaggcaaaggtgagaattttattatgcataccatctacctatacttatactaactgggtacttcaagaaaatatcttaataggaaaagcagtgaataaattgctgccactacatatctagtaatagttcctcctttctcactcaccttctatccattcatccgtctagtgggagtgaattataagcttagattgaaagaagaatagacatcaattacaatttgctaattgtcaatttttaatttcattaaattaataggataccactaaattgagagcccgaaattggtttccttttaaatcttataatttttaaatataaatcactttgtccttaacttcttaaaaacagcttcacacacacgcgcgcacatattgtatgtgtgtatgtatgtatgtatgtatgtaacataatttagaggatttccctgcgcaattttgagcagacctagatttcaaaagtaggatcaggtttagtaacaattcttagcttaagtttcttagattcaattgtaatttgtatataacagattctaacattagaattggatttgatacttgatagacaactcttactttctactatttatatagacatggctgtattttttatatacaactatatcgatcaatctatatcattataatttggacctatcacgatcaaatggccaatatctttactttttttttcttcaattaatgtgataatttctacgtcccttaagcgaatatggtgccccatttcgagctctctctgcaacctaatcactttcactttatgtcttctgtcaaaatgctcccttttttcttttttttttctgtagaaacagtcctcatggcagaaatggtggcctcaactgttgtccaagaggttttgggcggagccgtctcctacttgtccagcaaccgggagaaggtgtccgagaggcacaacttggagaagttggagatggcacacgctcaattggagcacgccctagagagatcttcaaagctacccatcacagatgtttccttgcttcgtcagaggaggatgttcaaacgtgcctatgaggagtgcagtgaagtggtggagaaatgcaaggtgcggattttggaagttgctgaagagcaaggggtaacacacagctattttcccaagcagtttgtccaagccgtaaaagccatgaaatcatatgtcttgtctttccttggcatgaacaagcaatatcttttgagttgctcccatgttcgcagattcgaatggtttgcaaagaaggctggtaagtttgcgagggatgtggagactggccgtacactttggcactacaacttttttagctctctcatcagaccacttctagaagggaaacatctcaagtatgacatgccattgcaaggaagcaaaacccttggtattacaatagtacctgtatctcttgaagggcgtggcgtagaggcattgatacagttaaataaggaggatagcagaatgccactgaaaaatttttgtctgttgctgatactacgactctcagagagcacggacatagttaggattatcatcaattgcttgcagttacttgggcctcatttcacgcgtttggctaaagatgcaattggtcaacttgctgctctacaacactcacatcctcaagacctcgaaccactgctagcacttcaggccgtggactaccatcggagctttcttgcctttcgagctacagttgctcgccctgatccattttgttgcagagaaaagaggctcgatccttgtgctgacaacaccatctcgcccaatttaccatatgatattccagaacaagttatctatgtgcgctgcagcagctacatttcggctgttgagtacaattacttgtacaactcaagcaatattgtgagggattggtctatcctgaagatggtgatcaatatttcgcctcatttctcgcaccctgaagccaatcgggggagttacagtagtcggggagcaactgataagtgtatgtatgctagtctgcacgaaatgcaggagatggcagtgttagtgcccaaggtaatggattgcttcgtctgtcaacctgacttggggttttattcactgtcttttcattcagttcatggttatggatacctttgtctgatgaagccgcgcatccggagctgcaaaaccaattctagttgcagatccaaggccaggagagtatcaaagacaagacataactagtgtaagttttggtaggggcggacagtttaatcatgtattatgtatatgcttactgaagatgttccccttcaaattaaaagatgtataatattgtactagtacgagccagtgtgtttaggtttagccaaggcccatcttagtcttgactcttgacaagccagtctatgttaattaatttcctgtatgttcaatgcaaatgtacatgttttacatctgctagctattgttcagttcttattttttttctgtcacagttagttattttttcatacacgaattttaaagcaaatcgaatggttcaaaattacatgatagttacatgtaattacaatgaaattacattgagattgtactaaaagtttgacaaatgtaaatatagtacaatctcaatataattacattgtaatttatatatagcaaaatttgttgacagaaaaaatttcattgtaatttcaatataatttttagaaaaaaacgtcgacaaatatataacaaaatcggcattactatctcattgctgaaatagatgagcaatatttatctcttgggccttatttggatgggcctcaattctggcccacccacgtgtattaatctatgtaagcgggctgtcatttcggcctagccaaatgaggctttcaagctgttgctttcggcccagtccactgccgcggtgaccgagagcgctggcggcgagcggcggcgccgccgccgcagccgccgcgcgcatggcggcacggggaggtaggaggcggagcatggagggggaagctagctgcgccccggcgcgacggagatgaggaggcgcaagcacaagcgcacccaccgactaccgccgcggcgagcgctcgaggtatgcacgctcggttcactcgcatctccggttggtttactgttgttaccgccggcgtcccgtcagatgatggagaagatttttcaccgcctgctcgaatgatgctaccatctttcacactagggagtaaaattagcgagggatcaatttgatttttctaccatctgttcatactaagggagtaaaattagctaggggtcaatttaatttccaccatggatgtgctttataggtagttgcatcgtcaacaactttagaagttacttacgtttgctttcacattttctgcaatagtgataagatactaccgtctaatcggttttatgctgtagaaaaggacatcccattatgaaagggaaactgatttcactttcgtgtacgaggaaaacgtgatgccaggcatcggactagatattattccgttcttctccctaaatgattaaacaatgaccagagtttgacaagggtcattgaagaattaaccaaatgacaaagaccagtcacctcatcgcaagagattgttgtagcaaatggtccccatttggccattttcttctccttgagaatataacaaaaccaactgagtgcaggactcgctaaccacttttgacccattaaccctcaaaagtcctgggtatcacaatccattcctatccacaatagttttttcttcttcttttttgagccatcagcggagggccgaagaggcccacttgaacatttcattaattccacaataatctgatcactttcttctgtcccttccaaatatcagtatatattacagaattgtgagctcgccattcaggcaatctggtctcagcctgctgggtagattcttatactgccacagtgccacttcatgtgctctttggcaataccttccatcccaggttcttttctaccaattcaaactcagcaggctgaagtagttctactataatcagagcaattcattacagatcaggaatcactgatctgtccctttattacattgggcatagtgatatgtgatcgagtcctaatggcagagattgttagttctgtggttgttcatgaggcagtcaaccaaatcatacatggcttggtgaactggaatgagcgaaaatcaagcgcagaggagaacatggagaggcttgagatggcacacatcaggttggaggctgcacttgagacatcctgtaagtggcgaatcactgattcttcattactgtgttggcagaagaagctgaagcgtgctgctcaagagtgcgatgacacactgcgcaaatgccggcaacgcatcctggaacaagaagaggcagaacaagaagtaaggaattcctctattcctagacgaatagcccatgccaccaagtcattagtgtcctccttattttacagcaatatcgatggctcatgtagatctgctgttcgaagatttgagtggtttgcagatggagctaatgagtttttgagatttgtggagtttggaggaacaccacatcagtacttgttctttgatcctcttatcaggcaacttcttgcaggcaaaacactagagtataaattagtgtctgaaaataagtaccggttgtttgtcatacggcccttctgtatttcagagaatagaatagaggctaggctgatctttgacagtaaaaatgctagtgcactggaggatgattttttcctgtgtatgctgctacaagtttcagagagtgtggacatacttggcattgtaatcaagtgcttgcagctgtttaatccccatttcatgtctacagctgaatctgttaggaatgaacttactcagctaccttcacaagatttcacctgggtgccatatgctgaatcatgccacaaaaaacactgggataatattcacagcattactacccaatggtttcgccctaacccattatgctgcaagcagcatggtcagaaccacagctgtgaaagtagcaatctaggaatgccatctgtacagggtgtttctctaggaccagttattgaagtgagtttgcagtgccatgtcccagttcctgagttcagagaacagggaacaattgtcaaaggcaagccttctcttaaaaaatgcccgcatatgaaagttgaccttgtctacacaccccatggctcatcacaagacctactcccagaaatcaagagttctgtaatagaggtaattaatggtgataagcaacattgcttgcacacaaacattgccttggaactaatggaagagatcatgctgccaagggcagtagattgttttcatgagaatgcagaagcgaaattgtatcagatgctttggaagtctaaacatggtggtgcatatcttcaggttatgaaggcaaccatgaacactcggagcacacagagaaccattcgaggatctaggaaagcgaagctgttgcaacagcagggtcataaaacacagcatcgtacaaatgcaatctctgacttcctcaacctttggtctgcacatgcgcctgtccagctgcagggctcaatcctcgattggattcagaaagagaaggaagcacaattagcacctcctctactgcgcctgaaattttagatcatgtaacagggactggtcaagaaaacacggataattaaatgaatggaaatgtaatattctagcagagaaaagtaactcatacggagttgatttctaagtcattaggagtgtattgatatgaaatgtgtgctacatatgctgctgctgttggtctaactcaaaacttatgtttgtaaatgatgataacatgatgttcattctctggtaatataatgtacagtttcatcattggaaatttggatatgtcatattttatttgaatttgcatgcatgtatcgttattgaaagtgatgaaaaaatttcatatctcactcaaatttctgtacttcacattcccatgcacttctttttttgtttgggttgtttgcatccagcacgcattttttttacagaaattgtcagtttgacatttgtaccatctctatggtagttcaaactactctatatgtttaggagattttgaattgagagaagacaacacatgcatatatgtaataatatattctgacttcatcatgtgctgaaacagaaaacagaacaatgcagcaaggaggagaccaagtcattttttgtgtctgttggtgggtctgtgtggaggtgggcatgccaagccaacataaggtgccaaatagaacaatttcaatgcatatggaagacaggtatgccattaaaagtgttcagaagaatcccaatacttggtccaattacaaagcatgaccggttggtagtctatgattcagaatagttaattgtgtcactagtatgtacagttcattttataattgatgctgatggaccctttcgcaaaggaagaagacttgcaatcctgtgaaacagagtgtggcaggcaatttcaccggtctgaacatatattactcaaaagttggttcagttacagaatatctggagaaataccagaggtaataatgccttttcaccctccaattgacattttaactagtttggacgcacagttccagctgaattgaactgaacagtgaatgcaactgaactgaactctcctcttaccatttccagctggacgcacatttatggtcttcaggcttgcagtgcaatctgtttacatcattattttcaactagtttggtgaggtgagtatattttctgctgaaatcttgatattgtactattatacacctctctatctcaagttattttcttccattttactataggactagaggaggtcagggttattaacataataatagtagtaaaaagggaaaatccatatggcatatggagagttaatatgtgctttacttgggcctcgataggccagccaagctttgactgacaaagggcccaataaacccctttgaccaccaccacgtaagcaggtgacaagcaagccagtgccatggccattcactgacaagagacaactgacaaaaggatttaactttagctagcccaggatcggacagtcaaaatcaagagacggcagtttcaactagagactagactaggtcactagaatgatgtattctcctggatgacatagtcatcccacaagactcgcttacaccaactttgaattactcactttttcctcaccagaatcatgcattaatgcatttcactgccccctgcataaatatctgttatcttacactattgtcagtctttccgtctttcgcactaagctctcctgcaaattgcaatccagttattgtctgctgggtactcttcggtgaacctgtgtgaccacaaattgcttcctattgattcaactcagaaggttggcctttttacatactacaacattgctctttttaagtacttattaggtatccatttgtctgtattttgattctatcgggcataatgatgtagtgattgatatatatattgctctgtcctgatcagggagggaacatgggagaggtagtcagttctgccgttgttcatgagacagtgaacaaaatcatatctggcttgattgacaagtatgagcaaaattcaagtgcggaggagcagatggagaggttggagatggcgcacatcaagttggagactgcacttgagacatccagtaagtggcagatcactggtgggcccttgcaacgttggcagaagaagctgaagcgtgctgctgaagagtgtgatgatacactgcgcaaatgtaggcagcgcgtccaagaagaagaacaggctgaacaacaagtaaggaattcctccttacctacgcgagttgcccatgccaccaagtcactgatatcatccatctttcacggcaatatcgacgagccgattagatctgctgttcgaagatttgaatggtttgctgatggagctaatgactttctgagatccgtggagtttggagggacaccacgtcgttacttgttctttgaccctcttatcgggcgccttcttgcaggcgaaacacttgagtacaaattagtgcaaggaaacaatcagcatttgttttggatacggccaaataacaccgcagagcgaggagtagaagctaagttgatctttgtttacaatgatgaaagtgtgcctgtgaataacttttttctaggtatgatgctacaactttcagagtgcacaaacatagttggtactgcaattaagtgcttgcagttgtttgcccctcatttcaagtctacaactgaaactgttaggaaggaacttagtcaactacctacacaggacttctcatgggtgccacgttctcattcataccattgggacagtattcacagtacagttactgaatggttccgcccaaacccaatgtgttgcaagcatcgtagtcagaaggtatgtagtagtggcaacatggagaagacatatttaccagacatttctctagaatcagttattgacgtgagtttgcagtgccaagtttcactgcctgggttaaaagatcaggtcacagttgttgagagcaaaccttctctcaaagaatttccgcatctgaaagttcaccttgtctatacgccccatggctcttcagaagacctattcccagcagtcgagagttctgtgatagagatggttaatggtgttgaccaacattgcttgcacacaaacattgccttggaacaaatggaagggatcatgctgccaagggctgtagattgttttcgtcagaatgcaggaacaacagtgtatcagatggtttggaagtccaaacatggtggtgcatatcttcaggctgtgaaggtatccaagaacatgctgaggcagagaaccattcgaggagccaagaaagcgaagctattgcgacgacatgatcattggacacagagtcgcatagatgtgatctctgatttcttaaatctttgggctgcgcatgcgcctgtccagctgcagggctcaatcctcgattggactcagaaagaaaaggaagcacagttagcacctcatctactacatctgaaattttagatcatgtaatagggacttgtcagggaaatagggatacttcaaagaatgaaaatgtactaccccgtcacaaaatataagcacttttagctaagaatatggataaaaatgcttatattttgggacaaagggagtaatattctagcaggggaagtgacttagggagttatctccaagttattaggagtgtattgatctgaaatgtgtgctccatatatttgctgctgctgtttgcgcagcgcagaacttagtaaatggtgataacttgatgttcattccctggaaatctaatgtacagtttcaccactggatatttggatgtcatattctatttgaatttacatgcgtgtaatatgtttgaagccttgaaggtgatgagaaaattagcatatatcagtatctcgctcagatttctgctattggatattcccatgcacttctattttcctttcttttggggttatttgtatccacacattttttaacgggaaattctgagtttgatagtggtaccatttatgtgtaatttattgttttgcacaaatataccgttgcgcgaaaatgacaatggtgtgatgacgccagttggtgatgataatattgtgctcgatgatcatacacaatattctgcatgactttatttgtaaacaaagttgtattgtggcagcgaagcaagaagggtaacaaccaggtgagttagtgtgggctttagttgggccctcgatgggctggccaagcttccactgacacttgggccgcatgaaggccgaccaccacaagcacgccgccgcggctggccatggcctccgcggccgcggccgccgccgccgccgtcgccggaggacggggtttctggtcgatcgatagtccgcgccgacgagggcgctcgcagggaggtccgggcatggcgttgcattcgtcgatccgctgcaactccaccactaggtggcgccgtatgtggtggcgcgtgcggcgacgcggagagggaagaagaagagagcggctgtttgctcgcgcctcgcggcggccgcttcatgcgcctgcgcactagcccgtggtacggctcagtttccccgcatctcgcaaccagttttttctttggttccatgcttaattactgttctgtaattctgtttaggaggtgaaagagattttttttttttaagataatggattttcattaactttttgccgggtcagcgaaggagccgaccaaatttcgaggattttcattagtccaggctctatattgacgaagtatatgcacaaccaaggaggtgaaagggatggtaaaggactaacggcctgtttggttggtgggagttgataatggggaatgagagtgtatgatatctggaagtttaagtttgtagtttgattgaaagatttgggaattcgaaggggtttgggatggggaattaagaggtccattcccaccaatctcttacctggaggaggcctgttaattcgtgagacttggagagaattcgatgtgaaacaaaagaaaggatagggactaaaaatataactcccatgaccaatcccactatcaactccctccttaaaacttccattcctctttccttctcttcaaacaggccgtaaaggttagtagccggaactgaattgattgcagactttgcagtgtcgactgatgcttagctttagcccaagattgcaaaccatcaaatctccggtctaaaagagtgtggcagatcatcaatcccacctaggacggtcaaaagctcaaaaagagggtagtcctttaagttgattgacgaatcaacaggagattagactagagtgatgtgttctctccaccatacacatcaaacaaagacgcgcttagcacccaactctgacttgctcactttttttttctctctccctggaatcatgcacgtcactgcccccctgcataaatacctccttgtgttacaggactgttcattcttgaaaactgcagtccagttatcttgtgctaggtactctctctctctgggtgcacctgtctgacccccaaggccccaagttacttcttattgattcaacccagaaggttaggccttacattgaactttgaatttctcacttttttctgtatggaatcatgcattatttcatttcactgccccctgcatgaatatctcttatatcacaaaattgattcaattcagaaggctggccttttcatatcctacagcattgcactttgttagtacttattaggaattcactggtctgtcttttgatttagtgattgatatagtatatattgattcttgatcagggagggaatcctacagattactgaagatgggggaggtggtcagttctgctctcgttcatgagacagtgaacaaaatcatatctggcatgattgacaagtatgagcgaaaatcaagtgcgcaggaacacatggacaggttagagatggcacaaatcaagttagatcttgcacttgagacatccaagaagtggcagatcattagtgagccgttgctacgttggcagaagaagctgaaacgtgttgctgaagagtgtgatgacacaatacgcatgtgcaggcagcgtgtccaggaagaacaagaggccaaacaagtagcaagggattccttctttcctaggcgaattgcccatgccaccaagtcactgatatcgtccatcttttatggcaatatcgacgagccgactagatctaccgttcgaagattcgagtggtttgcagatggagctaatgactttctgagatctgtggagtctggagggacaccgcgtcgttacttgttcttcgaccctcttattgggcaccttcttgcaggtgaaatgctagagtacaaattggttcagggaaacaagcaacatttgttttggatacggcccaataacattgcagagaggatagaaggtatggtgttcttcgtttacaatgatggcactgcacctgaggataacttttttcttggtatgatactacagatttcagagagtacaaacatagttggcactataattaagtgcttgcagttgtttgctcctcatttcgagtctgtaactgaaactgtcaggaaagaacttactctgctacctacacaagacttctcctggataccacattctcgtttataccattgggacaaccttcacagtatagctaccgaatggttccgcccaaacccagtgtgttgcaagcatcatgatcagaaggtatgtggtagtggcaacatgaacatgatagaattaccagacttctctctagaatcagttattcaagtgaatttgcagtgccatgttgcactgcctgggttcagagaacggggaacaattgtcgagggcaaatcttctctcaaagaatatctgcgtggaccgcatctgaatgttctacttgcctatacgcctcacggatcttcagaaagcctattcccatcagtcgagggttctgtgatagaggtgattaatgctaatgagcagcattgcttgcatacaaatattgccttgcaacaaatggaagagatcatgttgccgagggccgtagattattttcatcagaatgcgaaagcgacagtgtatcagatgctttggaagcctaaacatggtgttgcatatcttcatgctgtgaaggcgaccgtgaacattctgagcacacggaggaccattcgaggagctaggaaatcaaagctgttgcgacaacaggatcataagatgcatcatcgcacagatggaatctctgacttcctcagcctttgggctgcgcacgcacctgtccagcttcagggctcaatccttgattgggttcagaaagagaaggaagtacaattagcagctcctctactgcgcttgaaattttagatgatatagggctcgtttagtagagctccaactcctaaatttaactccaggagttgagtctggagtggggtgatggagccgtttaaacccagctccacctctttggttcattttatgagagagttccattcagctccactcccattttgggtggagctaaaactgtttggctgagctctagctctaggagaggtggagctagtgctagtcaggaaatcagagaaacgtgaagtacaaatgtaatattttaactgagaaaagtgacttgtagggagataatatctaagtcattcggagttaactgatatgaaatgtgtgctacataaaaatgaaaactgaaaatgtcacctagtggtctgctctttcttgacctctgtaactgcttctccttctaatatatccggcagagctcctgccgtcttttgcttcaaaaaaaaaatgtgtgctacatatacttctgttgttggtccaacccagaacttatgttggtaaatagtgattagatgatgttcattgtctggaagtctaatgtacagccgtgctcatcagatgtgtcatattttatttgaatttacatctgtgtaccatgataggaggcgcatgcttttcccccctggaaattcttagtttgacagtggtatcctctgggtggtttaaaattcaggttatatgtatttatgatgattttgaaatgtaacaaaaaaaaacatgctatatttcttctacttcatcgtgtactgagacacagaaacaaaggaaacacacaaaaagcagcaagtaggagaaaaagctgattggtgggtggacatgccaagccaacagatgactccgaaagggaacaattctaatccgtcaaacagacaggttttccattacagctgttcaaaagaattccaaaatttttgtacttagtccagttgctaagcttgaccttgtcttctgactgattttttttttttgactcaaaaaggtagagagactctaccttatatcagtattctgactgattagtctttctttttattttttttagagaaggatattttttatctggcctctacatccaaccagatatatgcaaccttttaaaattagaaacttagtctatcaaatagggaacttagctctcaaataacctaatctgaaattcgctcctataaagatttaaactcaggaccttgtggtgctactcaggtcattgcaatcactaggttacataccctttcacaactaaccgattaatctgtcatagagagtaatcaatcagtttatcaacggaatgtaatattttttacttttcttttgctcagttgattcagtttatatttgacggatccttccaaagacaaaaacttgccatttttttcttaaactactacagcatttttatttttattttttgagaactggcaagcaatttgttggcctgaaacatagatattactcaaaagttggtttagttacagactatttggagaaatacattgcagtaactgtccaattgacattgtgaagatactgaacctccctctaaccctcttcaccagtcacaattgcagtttgtttagagcactattttcaaccagcttggtgaggtgagtacattttgctttttcgcaggctggcgtatgccagccaaagtttattaagatttttcggcaagagagttacaagctacagagattacattttttttttgaatcaagctacagagattacattctacaccaaactcctccaaaacaggctacagcagctacggggagactgcccgcgtctacagatgagtaaattttgtacttgcattgcccttataatcaaatgtatggataacaaaagacagttacttgtaaatgccacctgccattttatacactgtggtacgcgcactaatgaagtgtatagtatacttagctctacattccagatatatacgatatgttgatcacttgcagctttgttgctgcctctctcatgttcattcgttcactgggattctggcgtgtgcaggaaagtgccactccaagcatgtccaacagcaactggtatgctgccttctcttcgtccaacatcgctggagcaagctccttgagatcttttcggaggtaagtatcaatgatatgatctatcacatctggatagttcctctcgacgaaactgacgatgctaagtccattgcagaacagaggatcagtaggccttttccctgttagcaactccaatagtactacgccaaagctgtatacatctccagaggttgagaggaatcctcctccagcatattctgagttcatgtgaaatgtgcaaggtaaggtaagagttcatgtaaataatcagttgtctgtcacataagtgacaaagttacagctagagaaacatacctggggcaatataccctatagttcctttcaaaccgatcgaacagattgagctcgaatctccaacggcaggtgacttggatttgaggtagaaatgtgctatgccaaaatctcccaaatgagcagtcatatcatcatctaggaggacattacttggctttagatcacagtgtattataggattctcacagtcatggtgtaaatattgcaatgcatctgctatgtcaacagctatttttattctttgggacaggctcagttgatttgaagcatttgtaccacttgcggggtgcagccaagtatccaagttgccattgggcatgaacttatacactagagccttgaaatcattgcctacattatcaattgttgagcatgaagttagaactggaagtagattccggtgccgaatgctcctcaaagctttgcattctgtcatgaaacttctatctgcaccttgcatatcaagatgaaaaactttcacagcgacaaccatgttttcttgggttagcgttcctttgtacactgaaccgtagcttcctctcccaatcagattactttctgcgaagttctctgtagcttgagctagatctttaaaagaaactatagcaaactgatcactagaaggcagcaatggtaactgctttctgaacatcttctttctgaaaattgcaaggtaggccagaaatatgagacataaaatgcctaatgtagggaccaataccttgaccaaaaaatgtcgtcgtccagttttacttttataaacagtggggcatgaaggcatatgtaactccagtactcctccacaaagctgtcggttgccttcaagtgagatggccgtagcatttctgaataccccatctgttggcacttgaccttcaagatgattatctgataaatccaactgggtgagaaactgtagtttgcttagagcaattgggatagatcctgtcaaattgttatgtgaaagattgaacaaagttaggatgctaaggtttcccaaagatgtgggaatgcttcctgagaggaagttttgccccatgttgatggtttctaattgctgacatgtgcccaaagtaggaggaatttccccagtaaggttatttgatgaaagatcaagatagctaagctgttgaaggctacttaaagaagggatcaggccttgcaaattattgtgggataatccacatt

SEQ ID NO: 12968 - DNA, 1134 bp, Oryza sativa
gtttaccaagagaataagggattcggccagtaaaccctagagttatatgataggtagtagccactgcagttcagttgcattgcccaatgaatcagggatatgacctcccaacatgttaccacccaagtaaagttgctgaaggttaggaatgaagttgccaaggtcagatggcaatggaccatgcagcatattaagtggtagtgctatttcttggatgtgtgacagattgaagagcacctccgggatcctgcctgacagccgatttccacctagcaacaagtaggacatgttggacagcttcccaagctcctcaggaatggatccctcgagcatgttgccttgaagaatgacagtattgagcgaagtgatgttccctatttctggtgggatgatcccagtgaggttgttggagtgaagccgcatatttcgcaggttggagaggagggctatgttgggagtgatatcaccaactagatggttccttgaaacgtccaacgtcctcaatctggtgcagtttatgagtgcctccggaataataccctgcaacgagttgccactcaggtcaagaaacaccagcttccgcaggttgccaagctgaggtggcactcggccggagagcaagttgtcggggaggctcagagaagtgaggtacgacatgtttccaagggaatgggagatctgcccggtcaatgtttgcccaacgaggtccagtgccacgacgcgatgcgcccgctggtcgcatgtgacgcccttccaccggcacaagtgtgtgttggtgttccacgagctcatggctccgaaaggatcgttcgtgatcgctcgcttgaaatctaggagcgaggccaagtccgtgccattgacgtccccatcttgcgttgatgcgccgcccttgatgcctccagctccatatgacagtaataacaacaccaaggtgcacggtataaacatacccagttccatgtgctgcttgcttgtacccttatgagggatctttgctagctgaaagaactaagggcctgttcactttgctgccaaaaaaaaccttaccaaattttggcattgccaaaattttggcaactatgccaaaattttggtaacttgccaaaattttggcaggatttcttatatagttac

SEQ ID NO: 12969 - DNA, 108 bp, Oryza sativa
aaaaaaaaaaaaaaaaaaaaaaaagaaaaaaaaaaaaaaaaaaaaaaaaaaaaaaaaaaaaaaaaaaaaaaaaaaaaataaaaaaaaaaaaaaaaaaaaaaaaaaaaa

SEQ ID NO: 12970 - DNA, 493 bp, Oryza sativa
cttctccatccttctccgccggcagggagaacagctcgccgccgccggcgagttcgaggacgaagtcgaccgctactggccgccctccccagacaagagggagagaggaggaggaagggagcagcgatcctgctcctcgtcaccgtcaggctccctgctggcgtcatgcagtgagtcatgaagcggcggcgcaagagtcgaggccgccgcagggggcggtgtggctacatgagggggcaagaggagggccgccccggaagagtcgctgtcggggagcgccaaggcgattatcgcggccgcatcaatgttcgatatgatggacgacgaggtggcgtcgacgacagcgtgggggcgcggcaaaactgacgcggctgaggcggcgtcggagctggagctcaagatcatgtgctcctggttctacagtagcggcttctagcggagcccctcctccggctccagctcccacgccttctccctatgtcggaagatgacg

SEQ ID NO: 12971 - DNA, 636 bp, Oryza sativa
tgcggaagttcctggcgcggccgcagcacgagggcgtcggcgccgtcgttcgccggagcatcgggaggtttgagctgaggtacttcgatccgttcctcgtcctggacgagttctcaggtgagtgaattgcttctggctcggttttgatcatctggtttagagtgatagagatttgcattttttgatcgtcttcttgatcgaatcctgtgcagtgtctgctccggctgggttccctgaccatccacacagaggtttcgagaccgtcacttacatgctcgaggtaggcagagtcttttaccacagttcacattctgttcgtcggtagtagaacatccaactgcatatagagcggccatgaaaattccttgcttaatccccagtgatacgtacagacagcagcgtcttttgacaaccacatcacacggatcagcagaaacgaattaaacgcgtttcatttgtcaacaacgcaaacctgataggctgatacggagtagtagtttttagcaaattcagaacgtttctttccgtcaaattgaagaatctaacccatccaaacgggccctgttgccttgctctgcctttggttggtagccttcctacgtcaaccacctcgcgtcgcatatacttttccgcgct

SEQ ID NO: 12972 - DNA, 299 bp, Oryza sativa
tgtttctgttcccgcgccggctataaaagcgccaagctttttgggacgctgcagctggagaagacgagaacgcaaaaccaatcagtcgtcgtcgaacgcggcgggcggaagaggcgaatcgcgtaacgatttttgttaaatttgtaaccggccatggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgc

SEQ ID NO: 12973 - DNA, 727 bp, Oryza sativa
tcgcacataatttctccgcacaaaatgacttatctttttgttgagaaaaatgaaaagtttattctacttgggtagtagtactatggtggctgatctttttttttctcccttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagta

SEQ ID NO: 12974 - DNA, 589 bp, Oryza sativa
aggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgcggctggggggtaatgggccaaatacaaacggcccaa

SEQ ID NO: 12975 - DNA, 656 bp, Oryza sativa
ttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactca

SEQ ID NO: 12976 - DNA, 560 bp, Oryza sativa
ttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtg

SEQ ID NO: 12977 - DNA, 672 bp, Oryza sativa
gtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgct

SEQ ID NO: 12978 - DNA, 674 bp, Oryza sativa
actatcaagaattccgcctgtgatccttttgcgcataagagcttccttaattctagaatggcctagttgagtatcagcatgcatgttctgtgttctgtatgatgcaacaagtcattaggaataaatagtaatgaaaaagggaaagaaaacaaatgatcaggacgaataaaaatagtaactcacagtgaatgttgctctattttaattctagggctaccatcaagctctgcactcattggttcttcaacagcataaacgacaagaccaagttggcaataccctaatgctgtagcttggaaccaggcaagatcaacacgaacaccattcacacccagagagggattagcatgggtttcaagccagtcgaggacaggaagaaatgttcctctgagacttccacgtcgaaccaaacgcaactgggcattcaatccagctacaagacggtgccatatcgatgagggaacagcctgtaatgtttaaaatagtgttatagaagtataagaaaaagcttcagaacataactaatgcagttagaaagatcttaaaatcatacctgactcataaggctagtgagtacactatcactatggagtgaaaatggagccatgtaacttccatcacctccaaagatcaagcacattggaaacctttggcgaagacgaagtggaagatca

SEQ ID NO: 12979 - DNA, 1092 bp, Oryza sativa
gagttttaaggtcccatacctgatgaatagagttttatggtcaaatactagtactaacataatactccttagtagccaacacagaagcacaagtttgcacaagttttgcagcattaccatactttgatggtcttgtcaagtgagccagagtaaagccttgttactgagacaccgagcgaaatcacttggcgctcatggccactgaggattgccactggtccagagtcacccttcttgtcaggaattttccaagccatgatgcgaccatctccggtaccagcaaacaacatctcatccttgatagtcatggaacaaaccagaccagaaggttcacggagactggacttcatccctgtttgtgtgttccatgcctacaattcattgtagggatcaatatcaacagttcaatgcacaatagtaacatcgcaatatgtaacacaaaatggactactcccacaaaaaaaaatcaacgaaattaaaatattacctccacggacttcgtgattccaacaaatatccatgggccatgggtaatcatgcaaccaatcttgcctcccatcttgatggcatcaacgcactatgacagaaacattaagaaaacaatgcaatgtaataaatattagaatttttttatcagccagacacctatcttttcctccttgttcagtcttctctttccaagaaaatataatcatcaatcatctcacatctttttttttcttttttttttactttctctttctttttttcactactttttttttgacaaaaccatgtatggaccatcagccagagagaactgtaatgtaattccagagagccccttgcttatcagccaaaccagcctcattgccttgctcgcaaactgaccctgatatactgatcaacagtacacaagcaggcgaaaagattcccgtaacaattcggtccggcatgccgataaccccaatcttgcaaagaaaaaactgatttggtaccaatatgtctgaccacaggaagcaatcagatagtactccccaattgatctcatggaagcacttcaaagaccgccacaatcaacggaggaatcgacgcagatgcaacccccaactt

SEQ ID NO: 12980 - DNA, 1214 bp, Oryza sativa
tgtggcctccgcctccgcctccgcgcggcacctcgatccgggcggcgccgcggcccccttccgcgcggggtggccgaggagcctcgccgtggcgggggcgacgcggaggggagggcgggagttaccaccaccaccgggaggaacggagctcctccccgccccgtggccgggatcgggggcccgggcgtaggggctccacctcgtggggccgccggggccgaggcgggaggcgagggactaggagatcgtcatggcgatcggatctcgcggcggcggcggcggcggcggcgagagtgagtcggcgcgacggttttgcgggggaggcggtggcgatcgtcagcgtgaggtgagggaggcggtaacgggtgctctctctctcgcataatatttgtgggcttgtggcggggaaccgacgagacgcggtcggggtcggactaggtgtagtaatttttcctttcttttttcttacagccgcggccagttagttttgagggagttttagactgagttcttattatcttcactttctcaactcacctttctcgtttttcacgcgtatattttttaaactaataaatgatgtattttttacaaaagtttttttataggaatattactctaaaaaatcacattaatttatttttaaaatttgttttagctagagtacttgattaagcatgcgctaaacactgcttgttttgcgtgctagggacacagccagcctagttacctactccctccgttcatattaattaacgttttgaataaggttgaggtcaaacttttataacttagactatcaataacttttaaaaatatttagtttaaaggaactagaacaacatatatagatttgtcttttaaaatactataataaaagtaaacatgcatttatttattatatatattataatagaaaaataaggtcaaaaatgtatcttgtagaccgtgtcattgtccaaaacgtcaattaaaatgaaaccagagggaatactcatcttcctcgttttctgcgcgcacgcttttcaaacagttaaatagtgcgttttttcaaaatgtttccatatgaaagttgcttaaaaaattatattaatctatttttgaaaaaaaaaatagctaatacttaattaatcacgcgttaatagaccgttccgttttctgtgtgcactgttctggttgggaataggctctagcgaacacagccttaggaggga

SEQ ID NO: 12981 - DNA, 981 bp, Oryza sativa
atgcattatggaacattacttcactggtcaatgttgtaagtatgctatgtccatctgcatttcattgttgcatgcttatttgtctatattgtattttgagatcctaagacggctgtagttagtgtctgccattattcactggttttagctttccccgattttgttcttattgttgatttatcttcataatcctcttcccatgatattcaggttgtggcttttgcttgcggccttgtacactacaagtcatcaaccaaaagacatcctagtacgcagccatggaaccttggaacgtaagtgccatttccctttgcagttatatacaatacaactaaatgcaattaggatatggatgcatttttttcccctttgccttgtcttgatcctcctttcatctcatcggcgcattttcaattctatcacagggatgaaagtggctggtggctcttccctactggactcatgttgctgaaatgcatccaagctaggcttgtcgattggcatgtggctaatttagagattcaagaccgcgcagtatatagcaatgacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgta

SEQ ID NO: 12982 - DNA, 963 bp, Oryza sativa
gtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtctttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaa

SEQ ID NO: 12983 - DNA, 154 bp, Oryza sativa
ttcctttctctctccaacctttcttcctcctccctctctctctctcccttgtctctctcttttctttcctcttccgtggtgacggcggcgggcggcgctacccctgcacagacagcgggaaatggctcccactgtccgtggggggggggggggg

SEQ ID NO: 12984 - DNA, 1292 bp, Oryza sativa
agggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaaatttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttattggcccaaacaccctgaccgtcggaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccaga

SEQ ID NO: 12985 - DNA, 674 bp, Oryza sativa
aactgtgaatatgacgtagtactatttgcaatcaaaattattattattatttgtggggaaaaatattatttttgtttttacatgtgcatgacaaatggactacattgatgcaaagcataggaccagtacattgattagtacaatgtggccgcagctgtgactggcagtgccatccaaccagaaaaacgttgtgcctacttcttcctacgatcccaacttaagtcaatatttctgaaccagctgtcataaaaacacagaagaaactcgtgccattcatgtcaagcaaaatatttcctcatcgtcatcatgagcgattcggtctgatctgaaatctcgcgtattaatccagatgataatcgagttcgttatataatagtatgtcagacagtcccagcatgagagatcgtcaacggtacacgattagatcttcgattatcttcgtagatctggagaagttaaaattggccgtgtcaaacaagctagaaggcttcttctgatggttcatcgatcggtgtcactaatgatccttgtacctaatgagatcttgagttttgtgtttaatcctcggatcatatattgatgatcatgaccttcgatatgatatcgatcggtctggctttgcatgcatcagttcattaacatcatatctgcttgattaatctctaacacttaga

SEQ ID NO: 12986 - DNA, 1704 bp, Oryza sativa
caattaaatttagtaggcactgattagcctagcttaattatctcttagtagttcgtcatcatgggagatacagatgaaggcgtatctttggagccagtcaagagacttcgatacctcagcgaatctcccaaatgacgacattggacggctacgtgtaattatacacgtgtcacaacaatggaggtcctcaattaagtatagttgaaaaatcaagcgaagttaagtttaaaacgcctcagtcgttttaatttacaagtcacaggcttgcatgtggatctgaatggtagatgccaaaaatcatttttacatactctgcagagaaaagtaattgcttcaatagtttctccctatcttacatactctgcattaattttttacttgttcagaacatatataaggtttccagcgagaatgattgatcattggttcattgttttcctattcatatattcataaaaaaaaataaaagtacaagtaaatcaaagatttttttttgacaaatctactaacattgttttcaaatctctcaaaaaaattcagtatattagcgactttgcatgcatcctaaaatgatctatccaacaataaatgttatatccatttcttctacctggtttcactctggatctatggtgttattacagggttgcaggatactttatgcagtggtgcaataaatctatgatcaagagtctttcgtcctactttaggtggtgtacgtagctagttcctataaacttctgttatagaaatttatgtgatgtctttttattagttcaactcatttctttgaagggagatggggtttgtcacatggaagtatatgtattatgtgtacacaagcttcttatgcatattgcatagcaactaacaaatatcacaataaattaaaaaaaatatgtatatactttcaatagtattacatctatgtgtaaagttttaaccttaagttcattatattccagcctaaaaaaggaattttgacagttttaagactataaatatgtcagaattctttctctctctgtgtataatgaatttgaagatgtgacactatacgcatatgtagtactattgaaagtatatgtatattttttaagaatattttatgatatttattagttgatgtgcacgatatatacatgagaaagcttatgtgcatataggatgctttcccttgtcacataacctcgtatcttttaaatattttaaattaaagtccgaactaaattgattgcctaacgatagaggctggaaacacaaatcattttctttgacttttttaaaaaagaaaagctaagaacaaagggagcatattttttaagttttgaacaacctttacctccaaggcactttaacttacaaatagagtagctatacaatatccgttagttttttaaagctttcacatgtaactatagaattagaatgcaacttatatgtattttgtataccagctggctagcgaagcaagctctcgtatgcccaaatctcgagacaatcaaatagccataaattaagttttgagtaaaaagaactgatttggtcctactccatcttttttcctggagtgcgcccaagatttcaagacaagtattccagaggattttgaagaaaaaaaactttatttctttttttattgaaagtttggtataaaacatatgcattagatgcagtggcggaggcagcgtgggggctgggggg

SEQ ID NO: 12987 - DNA, 3152 bp, Oryza sativa
ttttatcttactaaaaaattatatagctatttttattatgatttgttttattggtaatttaattttgtcttatattcatatatatttacactaattattttaacaacacaaatcatcaaacgtatattaaaaattaaccatgtcatacattcaaaaggggaataatatgggtcaacattcaacaaaacacgatcgatcagactgcaacgtaaggcataactaaaaataacttgattagatacgacgtgttgcaacttgcagcgtgtggatgttgatctaattaaacccttgtcgtgtactttggcatgcatgtgttctaattagctgatcgatggggacttgcatatacatctgtcgacccaagggagcaatgtctttaaaaagtgtcaaattagtgcaaattaaaccaaattttcacatgcatggttcagaagtttccaatattatgaaaacgtcacgcacgcgtgtgtatcgtgtaacctggtcatgtcacttcacacatcatctagaagatatattttcacactaaacatatttttccttttatctttaacgcttgatcagtacaaaccaacagttatataaacttaatttgtgctagttatatttgtaaaaattacccaagttggacatattaaaactacaccactctagatttgacgattttgtttatgtttatgatattgcgaaattttgtgaggataatataataaattctataaaagatagtgatgtaaagtcataaaaatgctagatatatatagaattacagaagggatctgggacctatatattattttgtccttttcagatcagtaacacttaatagttaagtcatcgagtgctcaccaaaattccaagtaggaaattcttccgaagaaccgatgttctttttacgattacatgttgttatgtagtgttgatcaattaaattgacatccatgtcgtctctgctaaagtaatatgtgttttctttacatctaccgtaggttaagtatttactaggagaaaacagcagaagagtcaaacagctagcaatttaattccacacctagtcatcaacatgttcttttcttaattttactgaaatggacaaaaaagagtgtgtcatgcacacgcagtcatacatcttagtacatttgcaaaaccagaggcaagtatatgaactaaacgttaatagcaatggctatatataattaatgtttactcagatttgcttgttaacaccccagatcattagtctctgaaaaaaaatgtcatccaacaggcggcccaactgactgcaattctggaatattttgagcacattttcttgcctcaggtaattaaatctaataaatgatcacttgttgactaggatatgtcacaatcaggtatggaattgttgttaattttgtgtccttttctgtagcgttgcttatgaatgttaagatgacttaaagtgacatgaaagcttaaaaaaagtcagtgcaattaaattttagtaccatattattctatctccttgctttttcaaagaaaaattatttgtgcagtatatatggcaccttcaattaatacaaggactttgatgtatctggtctacaaataattaattaatgttcagtcatatatacctattaatacaagaccacaaaattaaattaatgtgatcatcgatcatattcagtgcattattgcacatatttactacattaactacacgtacatatactgccaaatccacatctagctaaatattaattgtgtacacctaaaaatatgtacatgtaacgtaaaaatacgtggtatatataccagtattctacggcaatcaacacgtatacatattactttttttttctctggtcaacagtagaaatagaaactgaagatcacctatacgtcaaagaatcccattgtgatttaatgctttaattttggcaacaatctcctggatataaatgtacacgcataattagatagatcatctatctatatatataggtgtgcaagttcaagtgcaagagcacaacacccttattaatccctaattaccaaacactctcatcgatcgatctcgcggattaattaaagtggtattagcgagcttaaacgcgccgctaatggcggcgatttacctgctgatcgccgcgctgatcgcctcctcccatgcactcgccgcgcatggcgccggcggcggcgttccgttggcggcggcggcgcctctcccgttccccggcgacctcgccgcgtccggcaagctccggaccgacccgaacgccaccgtgccggcgtcgatggacttcggcaacatcacggcggcgctgccggcggccgtgctgttcccgggctcccccggcgacgtggcggagctcctgcgcgccgcctacgccgccccggggcggccgttcaccgtctcgttccgcggccgcggccactccaccatgggccaggccctcgccgccggcggcgtcgtcgtccacatgcagtccatgggcggcggcggcgcgccgcggatcaacgtgtcggcggacggcgcgtacgtggacgccggcggcgagcagctgtgggtcgacgtgctccgcgccgcgctggcgcgcggcgtggcgccgcggtcgtggacggactacctccacctcaccgtcggcggcaccctctccaacgccggcgtcagcgggcagacttaccggcacgggccacagatctccaacgtgctcgagctcgacgtcatcaccggtaatcacagcaagcaaccgcctgcctctagctagctaattacgtacacctcactgcaactccttttgctagctaattaatcctcacacatacaaacctcgtgatcaagaactaaccgtgcaatcaacatttataaaatttaaatatactatactacatcagagtgaaatgtgatattcctatagaattattctacgtgttttctattcggtatttaaggtaggatgctgtgatcaaaagggatacatgcatttgtctcataacctcgagttttatgtttatctaatttattacctacacatctattaatagaggtaggagatgtaaattattttcattatttttaaaaaatctgttcaaaaataatgtgtccacatgcataattagaattttttttacatattgttaactaactaattttaatcttgttaccc

SEQ ID NO: 12988 - DNA, 1420 bp, Oryza sativa
gactgggtgaggcattttggcgccaaatgggatcgcttcgtgcagaggaaggacaagtacgaccccaagaagctgctctcccctggacaggacatcttcaactgattgattaattaattaattaattgttgcctaattaattaattaattaattaattagttacagcggttaactttagtcaaaaaatgaaataaacataatgttgtcgagaacttactgttgataagtagttactgtgacttgaaaacaaaagtgtgtagctcctcctcgcatcttgtatgatggaaggatgagatgggggttacaagcaataaaaaagaagatgatgaaactagtaatacaacttaacgcatgttcctttgtttgtaaaaatgtacaactgccacttatagtagacgtatcgctgtaacatgttaatgtactttttcccgcacttcgggtctccttttccctaattcatagtacaaagactaaattgattggtgattaaaaaaatattacattttagaaacaacacacttgatagtggtaaatttgtgggtgcattattgcggtagaatactttttaaaatataatgagaaatccatcctttactttaaagagctaataaattattacaaagtatgtagttttaaagtattcactctgttttttaatgtgtgacgtcgttgattttttaaatacattatatttgactattcgtcttattcaaaaaatgtaattattatttattttattgtgacttaatttattatcaaatatttttatatttgcaaaaaaaataaataagatgaatggtcaattaaaaatcaacggtgttatatattaaaaaatagatatgagaaaataaaaccagacaccaatagatagagacacattgtttcgccacatatcctattgttaaactttaatcatagtcgataaaaatttgcatgaccgttgttttcaaactcatgacatgcatgttgcatcctatctttgtgttcaaacctttgcacggggcttattgtcaaatccaataagtggccacgtatttagtgaggatcacatatttaatgagagcagcgcatatgtttcttataagcaggactgtgcatgttagaaaaaacaattctacatttttatgtttgaaactttcaccttccaaacaaagacctttgtttcacacgggttgaaaaatgcatctctatctatgtgagcatggacgagattcttgtagatgttactgggaatctcattaaactacatggctgttacgtaactaaatcggcaatgatcatttgcaagtcggctgctaaccataatagttgaccccaaggggaagcataagtggtgtggcggcgctggagtcgtggatatatgactccatacaccagggtttaaatcttaatgtccgcaaatattacgcacatgcaagt

SEQ ID NO: 12989 - DNA, 255 bp, Oryza sativa
tcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgc

SEQ ID NO: 12990 - DNA, 835 bp, Oryza sativa
tacagatgattcctgacaaatatatgagcagaacttttatgcgaagtgttaaggcagagaagagaaaaagagtcattgacagtgaacattacctttagaactatcaaattgctagcatcaagtaacgatgttgcaactattgaatctccaccaccatcaattaacattttggagttccacataagaagcatctttacagacattctcaaggcaccaaacacctgaaaacaattcatattggtgcatagaaattggcatgcgtttagcacatatagtaaggtgaataccataaaacaacacaatacatggcaagaacaaatagtaaaataacaccttgattgttgagtcactcataagaagctcctcagccatcaattcaaactccgagtatggataacgggtcaaaccaaaagttagaatagcaccggatagaagactaagttgcccttggacctgaaagtataaataaaaagttgcggactatcgttaaatattgcgcaaagcaatattgacaagcattttcctaattatcaggtaatggcaactcccacatttgcataatgtacgtgaaggaagtgcagtgcaaaataatggaaactgtaagaaatatgtgacttgccaaaatgcagagacagcctcaaactcagaaaaagaacatgtatagaccttactgattgagtgtaaattatcatactgtaccagtggcagacgcagctataaaataaagatgggggcaaaaattctcgataaagataataaaacgcaacatatactgtaccatatttatattgtaattgtattaaaaaaacatattacagtcaataaactaaggcac

SEQ ID NO: 12991 - DNA, 2174 bp, Oryza sativa
agtatagattaacagtcttacaatttgaagtgcatatgcatgtaagtattatagaaaccaatgaatttatgacagcaaaatggcaaatatcatactaaagagtaaagaaaccatgatctgtagagagagaattaatgaacatctgaaagatacagattcatacctgaacacgactccatagcaagggaacagcaactttagcatgattcttgacaaaaaattggtccatagtggttgatttgggaactctaaaagaagagtgtcagtttgtgtactcaagttgttgttgctaacaacaagactcttaggtacagcctcataaagagttccggcagctcctgcattatctggacagcccgaactcttcccccctgaaaaaggtataaacgttaattcaaacataaacaaaacaataaaattgtctacactatagctccatccatattctatatatcattagaaagttactcagaatatgagcttcatctcattaaacaaaagactaataacatactgaggcctaacagtaataaaaaggagtctcagaatattttgcgacaaacaatacagtacgatcatgttgcctgcaaatatatagttgctatttgataatctgcatttcagggatataagaaaggatcagtgtcacagtgtgcataagaccaagcacaataccatgagcaaaaacttgggtgtcatcatgtctcttgaaaacattaatagaatcgagtcctccaccacccccagccaggccattccctcatgaagcctatcttgccagctccatgcctgttgcaaacagaagatcagaaggggaaagtttgcaattctgcatgggcttattgaatatactagagcgcatagtcaacagatttataacaaaccaaaataacagctagttcaagctaatgaaagcattcctcaactcaaatgccactcattactgcattggtggtctagtgtttagctggattggtttgaactaccaaatatgtgcaattgtgaaagttggtaacaataaaatgaaactattcctatattcatttattagtcaatcaattatatgcataatttaaccactgaactaatctggactgtgacattaatttctcttattaacacctagtgcaaaaaaaaatcctcaaatccaattgtctagtaccatagtcaagcttgagctcatgactacatactaaatatgctaaactcatacattcctatcacattagtccttaacttctcaagtgttaagaaaaattacaaccagactgaacatttaataacttcatgttctttttgttcgttgaagaagctgcaattccattgtggcggctaatcgtttattaacaaaaatataaacagcatgacaggaaatcttgttctcatatctattagaccgagcaagcctctgtaaatccctaatatgtttagtactacctccccgcatccatgactcattaataacaaaatgaaaaacaggtataaatacgaaataaatcctactgaaccaatatattcatatgtgacctcagctttggaaactgtttctaatctgcaagtttgttaggcagtttaaatgcccatgcatcatttcaattagcacatgtaggaagcaggaaggaatttgaagcaattctaagaacacttacatagtcttagacttgatatagatgcttcccccagaaccaccaccgcccttctcgctgctatcccctccatcggcgagcactgtgccattcattatcaggtcatcggcatacagccacacgataccgccgccgcttccgccgtagtccttctcaacgctggtagagccccctttgcttccatagctaaacgggtgctcgaggtcggaccacgcgtaggcgtcaccgccccacgagtcctcctgcgtctgcccatccttgacgtagcagctggcgccacggccaccgtggccgccgccgtcgccgtgcgtccccgtgggcaccccgctggtccgctcgggcggatcgccggcgagcgcggtggtgttgacaacgaccgtgtcggcgattgtgacgttggccgcggcgagggagaccctcccggcgatgacgcggacgccgcggccgaggcggacctcgccggagaggttggcggagatgacgcagccgggcctctggcaggtgagggcggcgccggcgaggagcacg

SEQ ID NO: 12992 - DNA, 677 bp, Oryza sativa
attgaaattggaacgatgtgatgaaaaaattggaagtttgtgtgtgtaggaaagttttgatgtgtttgaaaagttagaagtttgaaaaaaaaagttggaaactaaaccagtttaaaaatgcctaaaatttattgattgatggataatttgattttatgatagctgtttgagggtataaaaaataaattaaccactaaagagcagaaaggttgtttttaaaaggtatttcaagaaaaaaattatatataatttatttaaaaacacaccgtttagaggcgaagcgtgcaaatgaaaatgagcatctcaaaatcagaaaagaacgggccttaatgctgcctacaaatcaaatgggtggaatattgcatcataacttgcaattaacgctaattaaatacacttttttctctaacaaacttaagcaccaggtggtggtttgatgcctgaagaggaagacatctagaaagtcatcacgttttttgcagatacattcatgtattattaccttcttttttcaccatttctttgccttattataaactggatataatttgctttttgtttctagtgccaaaaaatgctttatttccctttgtcaataagtgtgttgtctctccaaataattgaaactttttggtaaaggctcttagcaattgacaggtaatagtacacaagtactg

SEQ ID NO: 12993 - DNA, 620 bp, Oryza sativa
atgtcaatacaagttgtatcattgaaccaaattttcgtttctaggtactcaattcttatcctatccctttcagccattgggccatatctaataccttctctccttgaacctctcgttcttttcctagaccgaataatcatggccatcattgataacaataaatttgtagcagcaatacaaactaaaagcttggtcctcttatccatctacaatacaacaacaaaaataacacatgaccatcatctactgtcaagaaatttaccaaaaaaattaacacattgttgaaataattatactacaacattcttaaaaaaaacagacatgcacagatctatataaaagaaatccccattcagtgtttagggtatttttaccttgtacaatggaaactgagctctgcagtttgtggatggggatggagaagatgaggatgagcagcaactggcaatggaggctcgcgcgccgctggcttgcccctactcccacagctgcctcgcccttatcgcgccgccgcgtcacctgctcgtgccgccgcgtcgccctgctcgcgccggcgccgcgccctgctcgcgtgccgccgcgtagaccctgcgcgagctgcccccgtgccccgatcgcgc

SEQ ID NO: 12994 - DNA, 25094 bp, Oryza sativa
gacaacgccattgaccaggggatcatccgccaagcatttgactttaacacttgtaaggtgctcacatgtaaatgatctttcttcaagctcgccaatcattctttgtgatgtttttccccaacgatgctatatataccaagaaaaacaggtaagctatattctcctgatgacatgtgtgcttgctaaaaatctttcaagttggatcagtatacatttagagggaaagatttaccttttcaagttccagatttagcttctccagtattggtgagttccgaagaaaaacaattaatccatagaaatttgcatccagacaccattgaccaagagtcaagctgacaagattgatgaattttggataccgttgcaaattgttttcaattgtcagctgcacaatattgaaatgactatgttgcagaaggccatttataaacatgattacctaaattagaaacttgaaaacaaaattcagagcactaacattatgcaataagtattatatttgcggtgcaggtacaactataacttcaacatagcggatcataaaagaccactagaaaaagaaattgcgtcaacaaagaatcagaataaacaatgctacacttgtttggtctcaatgaatctctttagcacgtgtggattaacagtcaagatgcttcagatgcaagttaattaggtagctacatcagcttaaacacaatgctatgtcaaaaattttaaacacaacgcgaatctatagtgaggtagcagcaggagtaagactttcaattgctgaagcatatttatcttatttttcaattttatatttaataatgtcaattgaagttaagcaatcacttagatttctgaaaagaagaattttcagtggccaacccaatattgcagccacacaagaacatgccagttaccaaatgggaaatggtccactttcattgtgaaatctaacagcgaactaagataattcaggtctgcttgaccaaaagtcttatttatgtataaatgagctgaatacaatgaaatagattgcattggatggttgatggcatcagtcatgatttcatgacataagaattggttatgccacgcttagttgtgccggtacaggtaactaatatagtggaattgtgaagtgtcaagaagaaacagcgtgcttaagttttattatttttcatatcaatacctatattaagatgcatgcatataataagggcaggggggatatatatctaagatcaattgcaatacctttttcccatcataatagaaatggcaggtcaaatttttagcagcagaaaggctcctgagattttggcagaaatcactagaggcttgttcgacatgaagtaccagcaatgaattcactagtaatggcatgttattgaacacaattgtgccgctcaaaggccaccacaaggaaaaaatggtaacactcggggtagaaatagtagtcttgtacttccaggggaaccaagtatcaatgatgctcaaaaccttcagtgtctgagaggagatgtgtcactatccacaatgatgcattcatctaaggagagattttccaacgatgggcagcctttctcgagttgcttgaagaaaccttgcttcatagcaacactaacgaagttgattgctgtgaggaagcggcaagcaaacgcagaatagtggtttagctccagtttaccagacaacacaacaatgtccagaactcgggcatatgcttctgcaaagcgtggctaatccatctgctcatatcttccgagttccgaggccgaggcaccttcgattctggtcaatctgtagaacttgaagcagaaggtgcgtatcgacgcggcggggtcgcgtagcttcagcactttgtcaaggaaactgttgaacgacaactccatcttttgatcatacttgataaagccggtttcgttccgcccaaactcatggatgtggatgttgatgcagggcacggtgcgtcagaggttgcgccaccgcgacagcacgcacgtccgcacggcctggcgcgtggtcaggaaggtcatgatgtggaggacgatgtcgtcggggagcgcgctgaaccagtccttgccatcggcgtgcgccggagccatggccgtgagcccgtgagcacacgcgcacgcccagaggcgtttcgtcgaacaggtggcgtgcgtggaaactgcacagtagaggaaaaacaaaatcaaagaatcaagaagccatgaatccgcggctcaaccgtgagcaaagatttgagaccgcggcgctcgagcagagattgaagattgaatccgtgaagaacatcgatagaagaaagatgcgagaagagatggagttgaaggtgatgggaggtgtacctcgaaatcgcgaatggtgttggcgtctcaagcgctcgattgactgcttgtttttgttgggacgctgggtgtatttgcggttttactttagtccctctgatggaagatggatggttcagattaacagaaaatggaggagatttccctttggaccgacaaccaacactttagttctttctttcttgcttgtctcaggtagttttgggtatactgtcgtggttaaatttttaacagtttctcctcaaaatatcgatgaaatttggccggctaatcctttgtcaacccggcaaaaaaaaaactttcaaaagtctagaacaacattattttgtgactataagaggaatggatactgtactcctataagaaacaatatttatgctaatggtgaaacgtcccatcgttggaccatcacgcctgcaacatatatatggtgtcatcccataggcatttgtagatcactatgggtcaatttggagaagcttatggaaattgcattttccctaaaatctttagctgctagaagctttctcaaacagtttagatttttatccaaattttgagaatttgtagttatggaatctagaaaatgaactaaaagtcaaaatctaggttgggtttcatagcttctctagattctcaccagctgtatatcaaaatcttaatctccacaaacaggtcttatgtctctctcaccacctactaactacaacaatgctacgatcagtcagcggcagaaccaaaatatttgcgggcctagggctgatttaacacgttagaaattatatattttattttttttatataatttctaaaagatttacatagagttttgaagcaagcatggtaactcaagccccttataactagtgtttgagccaacctattagctatatggtcggctggccccacaactatttcacaaacacccttgagagtcttaaaattttcatgtgtaaatccattaagatttgcataaatgatcccattaaaatgtgaagtattaatagtcggccccacatgacaaaaattcatggctccgccgtttgctatgacagcttcgctgaaaatcttatcagcttgctacgacagtttgcgacattttctttcaaagaatacaacgtgtgacgcagcagattccataacaatgtgtgcgagtgtgacagttttcattttcataacaaagatataactgcattaaaaaaaataacagttttgtgatgtttcttgttttccactgatataaaaattgttgcagctcgttgatatataaccatgttcattatttctagaaccacctaaaattaagatctcatgtgaacattagaagcatggaaggggatagagccagcagagtcataggagtgtaacatcatgtcagtaaaacataaaggccaaatagagtacccaagcatgtacatgcagacatgcagtatcttctgtacaacagaacatcacagaaggatgcaagtacaggaaccaatacatgattgcttctactgacatcatagcaccaaacaaaagcagtaaacatgtctatgtgctttctgactcaactggaatcaacgaatgtaactgcaagagagcgatttttgaatggaatgttcagagaatgcttgatcctttttgacgtttcatatctcctcagaccagaaaattgcaggtcacgcatactcgatctagcaccagcgtatgatctgaacctgagcagaggtcagtccactattaacaaagaagttgaccacatctttgaccaggggatcaccctccgagcatacaacttcgacgcgggtaaggtgctcacatgtaaatgatctatcttcaagcttgccaatgattctttccggcgtattctgatgatattatagaaagaaaacaaataagctacatccctgattgacatgtgtgtttgtgaaagatctctcgagaagggtcagtatacatatggatgaaacgatttaccttttcaagttccagagttagcttctccagttttggtgcgttctgaaggaagacaaccaatccatagaagttcgcatccaaacaccattgaccaagagtcaggctgacaagattgttgaattttgggtacaattgcaaattgttttccattgtcagctgcacgatactgaaatgattatgttgcaacagaaaacccttgccatgttatagacaaaatttccaacaaaacatgaaaacacaatccagcgcactaacattatgcgataaaagaccataatagcacatgcgatttaattgtcaggatgcttttgatgcaatttaagtagctacgccagtctaaacacaacacaaaaaactattgcaagactttcaacaattgcggagacatttccatttgtatgttgactttgaggttgtcttgattttcaaatttatgtgcagtaatgacaactgaaattagacaaacactcagatttctcaaaatatgaatatgaatcttcagttgacaacccaatattacagcgaacaagaacatgtcgagttaccaaatgggaaatgctccagtttcattgtgaaattgaatagccaacttagatagttcatgtctgcttgaccccaacagcttgatttatatacaaatgaactgactacacgaaatagctagattgcattgatgattgatgtcatcagtcatccttacaacacatcatgatttcacgcataagaattagttatgcaacgcttagttttgccggtgctattgtgaagtgtcaataagaaacaccatgcttgagtttttcctttttcatatcgacaactacattgagatgcatggatgtaataaggaaagggggatgtgtgagaccaataaccataccttcctcccaaaataatcgaactccaatcttttagcagcagaaaggctcctgagattttggcagaaatcactagagtcttgtacatcataaagtactagaattgaagtcactagtaatggcatgtcgttgaacacatatatgccgttcacaggcctccacaacttcagataagtaacactcggggtcgaaatagtagtcctgaacttataggagaactgagtgctcttgatggtcaaaaccttcagtgtcctggaggagatctcaacatccgcaacgatggattcatctaaaaagagattttccaatactggacaacccatctcgagttgctggaagaaacctggcatcataagaacattgatgaacttgattcttgtgaggtagcggcaggtaaacgcagagtgatcgagcttcaatgcgtcatacagcacgagaatatccagaacccagggctgcttctgcatagcgtgggtaatccatctgttcatatctgcctcgtccgaggtgccttcgaatccgtccaatctgcagcacctgaaccggaacgtgcgtatcggggcggccgggttgcggagctccagcaccctatccatgaacatcttgaatgccgactccctctcttgatcatactcttcccactcagtgtcgctccgctggaactcgccgacgtcggcgttgatgcagggcacggagcgccagaggttgagccaccgccgcgacagcacgcacgtctgcacagcctggcgcgtggtcaggaaagacatgatgttgaggatgacgtcgtccgggacgtcgctgaaccagtccccgtcgtcagtgtgcgctggggccgtgacccccctcctcttgctaggcgacccctccatggcggccgagcacgcgcgcagaggcgtttcgtcgaacaggtcgcgcgcgtagaaactgcacgagagaggaaaaccaagaatcaagaacccaacaacccgcagctcaactcccagcacaagaatcgagatcgtagcacaagaaacgacgctcgagaagaaattgattggtcagggaagaacatccagagaaggaggatcgatgcaagaagagttggaagccgtacctcgaaaccgctcgggcaggcgtttcgtcgaacaggtggagcgcgtgggaactgcacaagaccaaaagaatcaagaagccatgaatccacagcacaactccaagcaagatttgagatcgtaacacagcaaagcacactcgaggagagattgatccgtgaagaacattctaggggaggggatcgatgcatggagagatggaagggaggagggagctgtgtgtacctcgaaatgtcgaattcgcgattcgcctcgcgcgctccggggaaaggttcactgctccctcgatggaaacatgggcggttcaggttggataaatgtgtctgccggaatgaaatactctgtccggttaaataatatggactccgtttcacaacgcaagtcattctagcattttccgcattcaaatttattttaatgaatctagacagataataaatctagatagatatatatatctagattcattaatatcaatataaatatacgaaatgctaaaatgacttacatggtaaaacggaggaagtccttggagtaatgtggttatagaatctagtctactccataagtcccaaaaagatcccttatagaacaacgaatctgagctaccatttatccagatttgttagttttttttggacggagggagtatgtaattcctccatttcatattactaaatcattttgactttggtcaaaatcaaactactctaaatttaattaagtttataaataaatatagtagtatttattacaccaaataagtttcattgaatctataatcgaatatattttcatgatataattgttttcggttgaaaatgttagtatttttttttacaaatttgaccaaacttgaaacatatttactttgatcaaagttaaaaatgacttgtaatctgaagtagagcgagtagtcaataaataaattttgatcataatagttagggttaattggatccatgccactgcaactttaccaaattaaaaacatgccattactattcgttgtataggctacatgccactggaaatttctaaaattgaaaccatgccactcttgtcacgttttccgtctcctctctcatgtcgtttcttttcctccagtttaatcgtttcccctcatgtttcctctcctctcctctcctcttcttctcctctcctctcttccgaccaacctcccaccaccacaccgctcctcctcctcctgctgttgctgcaaccgtgctgccctcgagaaactaagtctttgatcaccgctggtaaacaacaaaccaaataaaaaacccttcttgcggtggtttctgggcagatctgagagagaacaaaaagtgattaggcagatccttttccgatggcttcttccccttccttttcctcctcctcctccccttccgccaccagtgccgcgccggcgtcctcctactactggtgctacagctgtgaccccttcgtgcacgctgcccctcacgaagactccatcgtcgcctgcccggactacggcggcgtcatcctcgaggagatgggtgtgcccccaccacgcaccgcctgccttcgccacccgcgcgcgcaccacaccaacgacctgcgcatgtgacggacacgctacgctgccgcagcagcggcggctagcgaccgctcgccattcaaccccgtcatcgtgcctcaccgctcccccgctgccgtagctgctggcgacgacgacggcgcgggctccggcctccgcccgctcccggagaccatgtcggacttcctcatgggctatgccttcgagcgtctcctcgactagctcacccagatcgaagtcggcggcctcgcccacatgagggagaacctaccggcctgcaaggcttccatccccatgccgcggggccgtccactcacctagctcaattgttggagaggagacagaaaaagtgacgggagtggcatggttccaattttagaaattttaagtggcatgtgactgatatgacgaatagtggtggtatttttttaatttggcaaagttgcagtggcatagatccaattaaccctttaaacaacatcaaatcaaatctaaaatcaagtttgaaaaatttaaaaatgtaacttataagcatacaaacataagtgaaactaatagggttatatatatatatatatatatatatatatatatatatatatatatatatatatatatatgtctccgttaccacctaatactactacagtgctacgacagcttcacccagaatctgataagccgatgccactgcatcgaattcttcaggtgaaactgcaccgccattacacgagtatctgaatcgacgatgttggtaccccatgtttctgaaattttggatcaaagaatacaatgtgtgacacagattccataaccatgtgtgtgacagtggtgtttcataacaaatatataattgtatgaaaaaattaacagttttgtgattttcttattttccactgatacaaaaaattgttgcagcttgttgatatataaccaattaaccatgcaggttacacatccttgatctacatccggcgtatgatatgaacctgagcagaggtcagtccactattaacaaagaaggtgaccacatctttgaccaggggatcatcctccgagcatacgatttcaacacgcgtaaggtgctcacatgtaaatgatctatcttcaatcttgccaatgattctttgtgttttttcctgataataatatagcaacaaaataaaataagctatattctcgattgacatgtgttcttgtgaaaaatctttcaagaaggatcagtagacatttgtaggaaaagatttaccttttcaatctttagagttagcttctccagttttggtgaagtctgaaggaagaccatcaatccatagaagtttgcatccagacaccattgaccaagagtcagtctgacaagattgttgaattttgggtacaattgcaaattgttttccattgtcagctgcacagtattgaaatgatcatgtggcaacagagaaaaccttgccatgttatagacaaaattcccactaaacatgacaacacaatccagagcactaacactatgacaatagaaagaaatgatgtcaacaaaaaaccagaggattgcaaaactcaaagggaccctaaacatgacaatgcaatccaaaggactaacattgtgccacaacagaaagaaattatttcaacaaaaaaccagaatatacgatactatactagtttgccttcaccaagtctctcgatgcaagttaggtagctacactagtcttaacaaaatgcaaaaaactattatgtggtagcaggagtaagactttcaacatttgctgaggcatttccatttgtatgttaactttgagtatgtcttaattttcaaatttatgtgcagcaatgtcaattgaagttagacaatcactcagatttctgaaaagatgaattttcagttgccaacccaatattgcagcaaacaagagcatgtcgagttaccaaatgggaaatgctccagtttcattgtgaaatcgaatagccagctaagatagttcaggtctgcttgaccaacaggttgatttatacacaaatgaactgacaacatgaaataaattacatcgaatggttgatggcatcagtcattcttacaacacatcatgatttcccacataagaattcgtcttaatttgccagtgcaattctgaagtgtcaataagaaacaacatgcttgagtttgttttcttttttcgtatcaatacgtacattaagatgcatggatataataaggaaagtgggatgcgtaagaccaataagcatacctctttcccaatataattgaactccaaacttttagcagcagaaaggctcctgagattttggaagaaatcaccagagtcttgcacatgataaagtaccagtaatgaagtcactagtaatggcatgtcattaaacacacagctatccacaggcctccacaacttcagataagtaacactcggggtcgaaatagtagtcttgtcactggagaacagagtgttcttgatggtcaaaaccttcagtgtttgggaggagatctcaacatcattaacggcgcattcatctaagaagagactttcccatgctggacagcccatctcgagttgcttgaagaatccttccatcaaaacaacactggtgaactcaattcttgtgagatagcgggaagcaaactcggagtggtcgagatacaatttgtcacacagcacaacaatatccagaacccgtgcctgcttctgcacagcgtggctaatccatgcgttgatatcttcagggtccgagatatcatcgaatccttcatccaattcaaatttgcacctgaactgaaacgtgcttatcaaggcagcagggtcacggagctccatcaccctctccatgaacataatgaacgccaattccgtcttttcatcatagtatccttccgagtcggagtcccgcgtgaactcgtctatgtcggagttgatgcagggcacggagcgccagaggttgcgccaccgccgcgacagcacacacgtctgcacagcctggcgcgtggtcaggaaggacatgatattgagaatgatgtcgtccgggacgtcgctgaaccagtccccgtcgtcagtgtgcgctgggcccgtgacccccctgctcttgctaggtgaaccctccatggcggccgagcacgcgcgcagaggcgtttcgtcgaacaggtggcgcgcgtggaacctgcacgagagaggaagaccaagaatcaggaaccgaacaacccgcagctcaactccaagcacaagaaacgacgctcgagaagacattgattggtcagggaagaacatatagagaagaaggatcgatgcaagaagagttggaagccgtacctcgaaaccgcgcaggcaggcgtttcgtcgaacaggtggcgcgcgtggaaactgcacaagaccaaagaatcaataagccatgaatccacagcacaactccaagcaagatttgagatcgtaacacagcaaagcacgctcgaggagagattgatccgtgaagaacattctaggggaggggatcgatgcatggagagatggaagggaggagggagctgtatgtacctcgaaatgtcgaattcgcgattcgcctcgagcgctccggggaatggtttttttactgctccctcgatggaaacatggacggttcaggttggataaatgtgtctgctgcaatgaaatactctgtccggtaaaataatactaatgtggttgtagaatctagtcgtacttcgtccatttcatattataagtcattttgtgttgcatgttataagtcagttttactttggttaaaatcaaactactccaaatttaatcaagtttataaataaatatagtaatatttgtaacaccaaataagttacactgaatctataatcgaatatattcataatatatttatcttgggttaaaaatgttagtatttttttatacaaacttgaccaaacttgaaacagatggactttgatcaaagtcaaaaatgacttgtaatctgaaacagagcgagtagtaattaagttaattttgatcataataattagggttaattggatcatgccactgcaactttgctaaatttaaaaaaaaacgccactactatttgtcatatcagctacaatgccactcgaaatttctaaaattagaaccatgccactcccgtcacattttctgtctcctctctcacgccgtctttgtcccccctcccccagtttattcgtttcccctcatgtttcctctcctatcctctcctctcctccgaccaacctcccaccacaacaccgctcctcctcctcctcctgctgctgcaaccgcgccgccctcaggaacctaagtccttgaccaccgccggtaaacaacaaaccaaacaaaaatcccttcttgcagtggtttccaagcagatctgagagagaacaaaaagtggtttccgatggcttcttccccttcctcttccttctcctcctccccttccgctgccggtgctgcgccggcgtcctcctcctactggtgctacaattgcgaccccttcgtgcgtgccgcccctcacaaagactccgctgtcgcctacccgaactacggcggcggcatcctcgaggagatgggtgcacccccaccgtgcaccgcctacctccgccacccgtgcgcgcaccacgccaaagacctgcgcctgcgacggacatgctgcgctgacgcagtggcggcagccgatgaccgctcgccgttcaaccccgtcatcgtgctttgccgctcccccgctgccgtagctgccggcgacgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtagctgatatgatgaatattagtgataattttttaatttggcaaagttgcagtggcatggatcgaattaaccctttaaacaacatcaaatcaaatctaaaattaagtttgaaaatttaaaatgtagcttataagcatacaaacataagtgaaacaaatagggttatatatatgtctccctttaccacctactcctacaacagtggtacgacagcttcacccaaaatctgataagccgatgccactgcatcgaattcttcaggtgcaactgcaccgccattacacgagtctctgaatcgacgatgttggtgccccatgtttgtgaaattttcgatcaaagaatacaatgtgtgacacagattccataaccatgtgtgtgacagtggtgtttcataacaaatatatagttgtatgaaaaaattaacagctttttgattttgttgttttccactgatacagaaaattgttgcagcttgttgatatataaccatgctcattatttccagtaaaatccactccttccgtttcatattcatataataagttgttttgactttttttaaaaaacatttttaaacttgaccaagtttgttggaaaaataaaaatatttccaacgcaaaatataaatatgttcaatgttacatttaataaaactaatttctagatgttattcaatttttctataaactttgttaaacctaaaaaaatgactagtaaaaaaaaagtcaaaaacaacttataatatgaaacagcggaagtaattttttatttcatgtgtacattacacaaaaaggaaaaaaaatctaatgagtcgtactgaaggggatagagccagagtcatggattgggatcccatgcagtttgaatagggactgcaagtttagcagtcttatatcttcagtttagcagtcttatatcttcactaccatcagatcaaaggtttcaacggcctggatttaggagcaatactgtttgtcagcattggtgcgatctgagtccttgttatttgatccaaagatggttatatgactgctaaagttacagtcatacaagcaaaggtgatctcaattccagtcatggtgtataacatcacgtcgggaaaatataaaggcaaaataatagagtactcaagcatcaacttgcagtacgtcttggttataggacaatagaacatcaacagaacaaggtgacagacctttcacttacatagtactactaagacatgattgtttctactcatatcatagcaccaaacaagagcagtatacatgtttatatgtgctttcggactcaactggagcaacaaatgttatgatatgaacctgagcagaggtcagtccactattaacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtcttcgaccaggggatcatcctccgagcatacgacttcaacacgcgtaaggtgctcacatgtaaatgatctatcttcaagtttgccaatgattctttgtggtttttcctggtgataatatagcaacaaaataagatgagctaattctcgattgacatgtgaaaaatgattcaagaaggataaatatgcatttggaggaaaagatttaccttttcaagctttagagttagcttatttttggtgaggtctgaaggaagaccgtcaatccatagaagtttgcatccagacaccattgaccgagagtcaggctgacaagattgttgaattttgggtacaattgcaaattgttttcaattgtcagctgcacaatattgaaatgattatgtggcaacagaaaaaatcatgccatgttatagacaaaatttcacactaaacatgacaacacaatccaaagcactaacattatgccaaccaaaaaccagaataaatgatactatactagtttgctttcaccaagactttcgttgaaagttaggtagttacactagtctaatcacaatgcaaaaaactattgtgcggtgcagcaggagtaagactttcaacatttgctgaggcatttccatttgtatgttgactttgagtatgtcttaattttcaaattcatgtgcattaatgtcaattgaagttagacaatcacccggatttcttaaaagataaattttcagttgcgaacccaatattgcagcaaacaagagcatgttgagttaccaaatgggaaatgctccagtttcattgtgaaatcaaatagccaacttcttgcttgaccaacaggttgattggtatacaaataaactgacaacatgaaatagattgcatcgaatggttgatggcatcagtgatccttaaaatcatcatgatttcacacataagaattagttatgcaacgcttagttttgaaggtgtaattgtgaattgtgaagtgtcaataagaaacaccgagcttgagttttttcctttttcatatcaatatctacattaagattcctggatataataaggaaagtgagatgtgtaagaccaataagcttacctgttttcttctcccaacataatcgaactccaaacttttagcagcagaaaggctcctgagattttggaaaaaatcaccagagtcttgcacatgataaagtaccagtaatgaagtcactagtaatggcatgtcattaagcacatatgtgccattcaaagggctccacaacttcagataagtaacactgggggtcgaaatagtagtcttgttgccataggagacatgagtattcttgatggtcaaaaccttcagtgtctgggaggagatctcaacatcctcaacgctgcattcatctaagaagagacctctcattgctggacagcccatctcgagttgcttgaagaatccttgcatcaaaataacattggtgaagtcaattcttctgaggtagcggcaattgaatgcagagtgattgagctccaatttgtcacacagcaggacaatatccagaaagtggctgcttctgcacagcgtggctaatccatccgttgataacttccgagtccaagatatggttgatttcctcattcaaatccaatatgcacctgaaccgaaacgtgtgtatcaagggggcggggtcgcggagctcattcagcctttccatgaacatcttgaacgccaattccgtctcttgatcatagtgctcggtatctctccgcttgaactcgctgatgtcagcgttgatgcagggcacggtgcgccagaggttgcgccaccgccgcgacagcacgcacatccgcacagcctggcgcatggtcaggaaggacatgatgcggaagacgatgtcgtcggggagggtgctgagcctgatcttgccaggcgacccctccatggtggccgagcacgcgcgcagagtcgtttcgtcgaacagatggcgcgcgtggaaactgcacacagaagaggaagaccaagaatcaggaacccatcaacctgcagcttaacttcgaagaaatatctgacaccgtaacacaagaaacaacggttacaacgctcgagcagtttttccgtgaagaacatccagagaagaaggatcgatgcaagaagagttgggaggaaggaaggaaggaaaggagccatacctcgaaatcgctcgctcaggcaggcgtttcgtcgaacaggtggcgcgcgtggaaactgcacaagacccaagaatcaataagccatgaatccacagcagcacaactccgagcaagattcgagatctcagcgcaagaaacaacgctcgagcagtgattgatccgtgaagaacatctagaggagggaggggatcgatgcaagaagagatggaagggaggagggagctgtacgtacctcgaaatcgcgattcgctgccctcgagcgctccggggaatgggagatacgcttccttcgccactgctactgactggtggggacactgctgtatatcatagtaaaaaaaagggaccggtccggctgttgaaccggaaaaactggaactggtgaccatgacggctcggttcagcacaaagaccgtccccgcagtcggaccggtaaaaatcggataaaccgggtagtttttatggaccgctgaaccggtgcggttctgtagaactgggtggttttgtgtttggacacacaatacccttccttttgcttgccttggtcgttggtactatgaactcaggggtaatattgaaaaatggataagccaccctagggtttttgacatactgtagaaatttggaccgtcatccagatccactcaacctctcacattctcaatttctctaagctcaaactcaattgctgaagaaacctttttaatctcggtttgtaacctccagtagtcccgattatgcaaccgggactaaagattttcatctttaatcctggttgaaataacccggactaaagatggatttttagtcccggttggtaacataaggcttttttttccctattttacatatatcgcgctcgatatctcctaatcattaaaaaaatatcatctcccaacatcccaaattatccacaacaacattctcaaatcaaatcatccacaacaacataatcattctcaaatcacaacaacatactcattctcaaatcacagatcgactgaacaaattattctcaacaaacaatcattcacaaataacaacgaaaaaagaaaagaaaaaaaaaatccaccgcctgccgccgctgggcgtggccctcgcaccggcctccaccggacacggcggcctggccgggcgcggccccgcagggcgccgcgtctgtgacttagagggagagggaggaggaggaggagggagagggatagaggagtgggggaggaggagaaggactgaaggagtgggcgttgtgcgtgaggagataagggagagagagagagagtgcgtaaatcgtgggggagagattatttagcccggttggtgttaccaaccgagactgacttaagttcgttgggggccttccaactattgaaccgggactaaagataaaaaaaatagcgctaggcttttaaccaggactaaaaatattttttagtcttggtttttttagcaaccgagattattgtggaatttggccgaccgaccaaagatgatttctacagtagtgtaagacctacccctactcactgctgctcaagttttccccggtgcgtcgcgccttgtcgccgccacctcgcgatttctctctcgacgcagtgtccggcgacctcacatcaacatgccacaacagtagcgcggcaagccggtagcacgaagttgccgaggtgccgacggccgtcgcggcgtcacgccggtagcagagcaagccggtggcaaggttgaagggcacatcattgcgagttgcttcgtgttctagcctcaagaaatatatgtgcatgtgtggttgattagcttattgcaccagatctgttgctagctagttagcctagctgcggaagtgcaggtgtttgatttgctctgttgatcacccaatctagtctaaaattggtattacatatacgatgaactttattggctaccgatttgttttctaatccattagatttgggagttgtgacctgatgtttatccatttgcagcagtgaattctttatccactccagaatcactaccaccagttgtgccggttagattaaccacaatctcaagaggattgctctgctgctgaaactaaacaagaaatccgttccagtaaaaggtcagagggaagactgatcctgcttgggaccattgtgttgaacttgtccccaaggataaaactaaagcaggaaagccaaaacttttatttttacatacatattcatcaatatctggtgtttctgtatataaaataatacaaaacaaatataatattaataaataaaaaggcagcggttcgaccagtgacctgatggttggaccggtgaactggtgaaccagcaacttgaggggttcgatctccggtttggtatttttactatacttgagatagagatggacagttcaggttgaatgaacttgtctgctgcaatgaaatactccctccggttatctctactacttaaaaaaagcctagtggtggtcttgaatagggtttcacttatcgtgtggtaaccgcgcgattaccgcggttatcgcacttaccgtagggatacggtacaggaaaccggtgatatggtttggatgaattttgaccaaattcaaaattctggaaaaaataaaaaaatgaaaaaaatcatggatgtaatgccaatgatgatgaatttttttgaaatagggtaagctaaattcaaatttgagggcgaaaccgaaaatagtttacaaattagaaaaaaaggaagacaatatcggtaagaatcctacgtattcttccaattatcctcaatttctagttttctacacatattcaaccgtattttcgatttttttgcctatttatttttcatttacgtgatttcagctgcacagcccgtgataactgtgcgaatatcgcggttaaccatgcggtaaccacagcgaagccgcgaaaccaccgagttttgaattcgaatttttggatgcgattttcggcggttaccgcgctactgggtgtgtgtgtgtgtgggggggggggaaggggtaaccctggcccaaacgataaggtaaatcttggtcttggatcctcaccctaatagacccatcgcccaatcaacggctcagatcgtgtttcagtcgataaaaacagtactacctccgtttcataatgtaagtcattctagcattgcccacattcatatagatactaatgaatctaaacatatatgtgtgtctagatttattaacatctatatgaatgtggataatactagaaagtcttacattatgaaacggtgggagtatagaagaaaataatagactgatattttgtttagcacagctctcctaatcggccggcactggcatatagtatatcggcaaaagtaaacaatagtttgacataatcatatctggtcccacacaaaataagcaaatcttaactgaaaagaaaactataactaataagatcgggcattgcacgcgctaaataatcagctgcaaaccgacaccaaatcgccatgcttcacgcggtcttcacgcgcatgcacagaccggttgcatccaaattctcctctctcagcaacgtgaaatccttctgtgcatctcctgcttcttctttttaaatcaccagcaaacctttgactgcatcgatcaatgcatcctcacagtccaagattccaagtacatagctactccctccttccctaaatatttaacaccgttgacttttttaaacatatttgaccgttcgttttattcaaaaacttttgtgatatgtataaaactatatgtatacataaaagtatatttaacaataaatcaaatgatagaaaaagaattaacaattaattaaattttttgaataagacgaacggtcaaacatttttaaaaaaatcaacggcgtcaaacattttgggatggagatagtactaacttctcacataacaccaaatgataaaatgaccctctaacttactatacaaacaaccatccagtacatcacaaattcctatacaaataaattgaggccctctttgtttaggcttataagccaacttataagtcgaaaagtctaagcctaaacaaacaagtagcttttctgtttggcttttttgaagccataagccactctaacactattaagccaaaaactaggttggagaagtgtttttggcttatgtgaggtagatgtgtgattcaactactaaacttaggacattaaatccaccggcttataaatcatataagccaataagctgacttaaaagtctaggccaataagtttaagcctaaacaaaagggcctgagtagattttccaagtaaatcagttgcatcatgcatgtattctaaaataatctcgcctgcacatatacactactcctagctgccaaggctatatatatacatgcacccatggtcatcatattgatcccacgaacagccagcccaggcaacaaccctgtagatatgacactcgacacaatgacgataggcttgccagtaagagaaggtgtgagcagcgcgaagctcaccctcatcgtagcgtgttttctgctaccgtttcttgtcgaggctgaatcgcgggcaccggcgccactctccttcagcttcgacttctccaattcagccagctaccgcctggaggacctcctgttcgagggcaacgcaagcgagcccagcaacaagctggtggacctcacctgcaacgagttcgcggagacgatccacaagtgcaaggggcggatgtcgtacgcccacgccgtgaagttctacgacgccaccacgggcgaggtggccagcttcagcacgcgattcaccttcgctatcgccatcagaagcgacatcagcaacccgacggacacaaagggggacgggctggccttcttcctcgctgcttacccatcaacgattccatcgaattcagatggaggcaaccttggcctccttgccaccaatcattcgaaggcctacggcacagaccggttcatcgccgtcgagttcgacacatacaacaacatctgggaccccaataagacctacgaccacatgggcgtcgacatcagcgccatcgagtcggctaacacgacaagtttgccgagctacagcctgaatggcacgatgacagcctccatcagttttaacagcagcacccggatgctgcttgccaacctgcattttgatgatcatccatcgtttcaaccggccgaggtcagtgcgattttgccggatccggtcacattgcttccacaagaggtatccgttgggttttccgcagccaccggcggctctggcagtgagctccatcagatactttcatggtccttcaactccactcttggtttggccctctactgctaatccacgcagaggtatattctccatcacaatatacattttttgtctctatttaaataactaattaagcactcaatctagttagaaggaaggagtaaactactggctttcatgtcttacatcctcgttaaatatttatacaaacttgtatacttcaggctgaatccaatggaatataatggaatacttaatagctgaatgattcgagacacaaacaaatgaattaactattacaaaattaaaaagcggattaaaaatagtattttacaatattcatatgtacgagtagatagtatttttcatataaaaaaaatcacactatttaagagcttgggaagcttgcatattcttgtttcattccgttatggagaaaagcacactcgagaacaactgtcttcagaaggtcggaagctcaaaggtgaaatacatgaaacgactagcagagtgcatgcatgtgttagcaaatttatggaataaatgatgaaagaaacgaagttttagcgaccttacaactaaaccaaaataagtataatgccacactataaaacacttcttacctagcttgcttagattgataaatgtgtcctttgttgagccttccattgctgcacctaatatttacgcggaatgtgtatactatgacgagagaacaaatataacgtactgtagcagcaacaatatatataatagcatatatatgatcatagaatgattaaattgttctaacatccagattaatgttcttacttctcacttggcttgcttctgtaacacgttctatggatgggaacccaacaaaagaacttcaaacaatatatcacaataatcaaccctacatattaattctaaacctggtatttatctcatgtcctttgttctagacattttttttctgtttttttttaaaacaaacctgaggctaaaggcctcaaaatatattactaatagaaatttgcaagctgagaggacagctagataagcaaagaagcccctaggaactgtgcaaattacacattgagcaacaaaacagcaaagaagggcattagagaagaaactgaaaaagcaatcaggttcctaactctgtttcctccacggcaccagccgaatcgacgacgatggcgatggcgagaccagtaaatccatggcaaactgcaaaaaaaaaaagctaaaacacgaaaacggaggaggaaaaaaagggacggagtacggactaaggagtgcggttggaaaagaaaagttgggtggggtgggggtgggggtaggttgtgaggggagcgtatatagttatggatatggagatacgatcgactatatagtgtattataatgatttgcggggatgatttcatactatatatagtactaatgtgttagtcaagaatatattaagaagcgttcgcgaaggctacaacgtacggatgcttaatgaagtgccattgtcgacctagtggcctactgggggattgcaaatggatgattgaaaacgctcaaggccttcatctccagggaggttggtagggcacacccgctctagctttgtgacatgcatgcatatgtatagatgcatactgtatattgtatatgttaccaccagtaattagtagctagggatatactccatccgtcctataaaaaaactaacctagtaccgaatatgacatattctagtactacgaatctaaacatatataatattacatctgattctagatacgtttttttagggacgaaaggagtacttaaaaacagtggtagaggaaggaacttataaagactagggcataattattaatgcaatttgttgaaccttcaaacttcctacaaaatttaaaagtattttcaagagaggagacaagcacaatagcactgttttttttgaacgcagagcacaatagcacttttaactctttaaactactactgcatatatttttactcctttcatctgaaataacttatttttttatataaaccagaatatcaagctaagttacttttaggacagatggagattttacgctaagcgatggaaaacgatttgattttacgcgctgaacctaacggtattttcttctcgctgtacaagtcctggtaggacgtcactcatcggctccatgggtcatatatcggcccatcaaacggctaccggctacgcactctgcttactgacatgaatgccagtcacaggtcacagccacgtcagccttttccccttcgtgggagacaagatgagaaaagttgttcagcaattaatttcaacaaaagtcaagacctcaaccttagggtagtccctcccttcgtaaaaaaaatcaacctagtagagaatgtgatctagaagagaaaaatgtatgtatgttcaaatttattatactggaagagatgaagtaggtcgatcctaactcataaattattgtataaatatggagtttgtataaaactcagtggatggtttattcaaaataattttttatctaatcacctctcttaattatctcttctttcattcacctatccctttgtctttgttcttgcttcatgcctaaagttattttcttgatgagagatgatttcatcttccttctctctccttgttaactcttttgccactttgtttttttatgtgacaaacatacaatactaggagaagggtttttccgtgcggttgaaactgattttcgcatgcagatgggcggcccgtatgcacccaagggtctacgaaaatcgcgattttcgcgtgcgggtgcctatgtcgcccgcatgggaaaataaaaatccagaaaaaaattcaaaaaaaaaaatccaccggcagcgccaccgcctccttgtcgtcgtcgtcgtccgaagacgctgcccgcgccctcgtcgttgtcgccaccggcttccgcgccgcacgccgcctcctcgtcatcgtcggccggggatgccgcccgcgccctcgtcgtcgtcgccggcggcctccgcgccacctgtcgccggcatccgcggtcccctccagccgcaccgccgccgaggcccctcccctccgccggatctggcgagggaaggaaggggaggggaggggagccggatcccgaggggggggggaggggagggg

SEQ ID NO: 12995 - DNA, 5395 bp, Oryza sativa
gcagggcaggcggccggccgctggatccgtgctcccgtcggcctccaggctcccctccggccacaccgccgccgacgccgctcccctccgccagatctggggaggaaggaaggggaggggagtggagcgggatcccacgaggagagggcggccggtagccggatccgtgtggggacggccgccaagcaccgtcaggactcggggagaggagaggacgacatggaaaatgaggagaggagtaaaagaggagaggagaaaaagaggagaggagggaagaggagagaaagaggggaaaatttaaagtgggtaggagggaaagaaagggtgggtatttttgcatgcggctttcttaataggtccgcacgtgaaaatgggccctattttcccagacgcgaccagttatggtccgtctgcaatctaaatgactctatatctaggaaaatcttttgtgtagtagtgatatatataatgttatactaaacactacgtgacatggagagttgggactacccttaggcttagaggatgtgccctactacctccctatcaaaataagtgtattaaggggttatttgattgatgactaagtttgtcacatctcacgttaccacaagtgtgtatcacctcctatcatatttcttttcatttacctctaattaacctctctctcacttcaaatcacacccttatttaatgtactttctctattccaaaatataagtatttctaggttgttaagcagatgttaaggttaagaagaaacaactttggtgttcctcaataaagctagaaatgcatttactatgacatagagatatagtaggttataaataaataaaaatattcataagaataatgatatattgtaaagtaaaaaaatatctttagaaaatgttgtccaagcaatacttatgtaaaaaggtttttgagaaatcatacttttgaaagtggtagtaataatctatattatctacataattaagttgtttagaatagggcacaaggtagcaccatttgatacacttagatacataatatatgccatgtgttcttaatttataattaacctaagacattgagttgccaaagtttgaaccctagtttgtcatcatcatgcatgtgagtacagtacaggccttgcttgtgtcatgcaagagaggtaacttgcacaaaagaaaaaaaatggctgatcagaatgaataagaaaaacagaattcgttgtacaaaatgtacaattttagctgattgaaaaattatgaaaattaattagatccctgaaatctttttttccctgaagctacaaattaatcaacacgaaaactataaaacctctgtgaaagacctctgcatgtggatcaagatcctgtgcagttgttattataagtgtaacttaagcagttatatgtgtatcaaatgatctagaatggaaggtcaggatatgaagcggtactgtagcaaaaatactgtagcagggatgtactatattatgcctttactgtagcagtcatctagagccgctagatctgaaaacgaatggccacgattgtgtgcagttgctattgtgcagttacaatagcaactgcatttgatctcaatcctctgcatgtactacatcatccccaaaagacctcatttctcactgtagacctcatttttcactatatgaatatcggaaagaaaatgttcgtctagattcatagtcaaagttgaagtgtcttttgaggacaaatgaatggcctgtttggcacagctctagagctagagtccagctaaacaatttcagctccatctaaaatgggaacggggatgggtggagcgctctcacagaataaactagaggtggagctgggtttttttaggctgttccacaactccgatccactacagatccaactcctggagctaaatctaggagtttgagctctatcaaacagacctgaaagtatataatacaacacttgtcattctaggttgtttaggataaattaaggtttcataagaaaagactaaagtaacccttattgattagaagcggaaggttggttgaggatacaatagaaagaaatttgaataagatgtgattgaggggacgattagtactttacagtgacaactattctggcaaagaatttgcaatataactattttagaacttagggattcatacgatccaacatgcatgctgtgtatgaatcctttcttcatgaatcttggattcttggaggtgatcaggtcagacatatgttggcattcacccttgaataactattacgttccaaaacctgcagtactgccacatgaatgcagacatatacccctactatatggcatagtactatatggtattgtcacttcgattaatttgtaccattccttgttttttcgttttttctccttttcccctccgttccccttcttttcctttttttcctcatgcactctgttattttccttttttccttctctttggagccacgagtaaatattttactaacaaattactctcacctaatcttcttttagtaaataattttttttctttttttcttcttttttttctcatgcactcgttattttccttctctttggagccatgagtaaaaatttgactaataaattactctctcaccctaatcttctttcagtaaataaattatgggctttcagtcacactaagtatctaccagcaaatcaattactcacgagtatattgttatagaaaaaaaatattccagtgttatctcaataaagaaattacttccgatagaaaaatctactctggtcttcacttattaaataatttacttcacacaaaatctactgcatcccttatctcagtaaattaattactcataaaatttactcctctcagtaaatggattacttttactataaccattaatttttctggctttttctcactcttataaaataatgcctcctgccttttcccaataaataaacaagaagattgactccggtattctcttagaaaataaatttctcccagactgcttagccacaaaatttactccaatcttctctcattgaaataagttacttcccgactgctggagtaaaatatttaccaacaaatcgatatagccaaaataaattacaaccatatttttgtcgactataaaactacagacatgtttacaaagactcaggggcacaaacacatatgattctacaattaaaaaaagtagactcgctgctccagttgcatctgcaaaggacaaatagtagccgatgatgacaccggcaccgacaaccttagaagttctgtgcggagttatgggcaggacttgtgtttggaggtgggtgttgggaacccatctcccatacacggaaaacagagcggtctgttagcacgtgagtaattaagtattagctattttttttaaataacttttgtatagaaacttttttgtaaaaaatacaccatttagtagtttgaaaagcgtgcgcacgaaaaaagagagggaagtgttgagaacttgatcttgcagacacacccgttggcaaccacaacagattagctacaggtagaaatcgatggaggaggccaatgacagctggctgtagctagctcatgcacgagcaatccccatcaagagagggatccgcaaaataacaatgaatcacaggggcttagaatgctcacaacaatgaaaccatgatcacagaaactaaattcaaacatgatcgatagaaatggtgaagtagtgagactttgatcttatcgacaagaacaatggttcgatccagtagataatgttaggattttagaaagaagaaaaaatgggatttttttaccatgctattcttctactgcaagtcatccgttatcctccttcagctgtgcaaccaagtttgtactcctagcctgcaatcaatgacattgtgcaataattgtatatagaatctcctcttgttccagttccaaattcctcaacactgcacagaccaattgacaactaaaaaaataaaatttaaacaggaaaagtaaggaggtgttgaatgcatcctgcaggaatttcattgtggtcaggcttgttgttagactgctggtaggaagtcagagagtcagatacaaaactgtagtgcataaaatataatctaaatgacccagtgcataccttgaaactgaatttgttatccagacaagcatggaagtcagattccttttccttcaaacgaacatgatcatgaggcctgaattcactatggttcttggtttggcatatattatgaagtgcaactagttggttgctgaaacaaatagtgtgcactacacatctaaccaaaaagaactttaatagtgacaggttaccaatctcaagaagctcatggttttgttttagagtcaattaagcaaactgctagtaaatcggttaatatgagacattatatttgtgtgtaggcaccaaacatatatattgaaggacaaatccaagcctgtaacctgacaatgcaggcaccaaatccattaatatcttttggagctcaaattcgaaattctggccattgttcatttgtttttatacctgccaaaagtagaatgatgctatttgataacatctgaatatgtactcccatctgttccaatttaatgcactcaaatttgacccaaattaatactgataaaactaggatttcttaataaatagatgaactctagtttttgacatggaaacaagcagcgctttaacacccatgaatttgatcaaacaaagaaaatagcacaaaatgtgcataatggagcacgtgcacattaaaaaaacacaatactaaaattttgagattaaatcactttgaatggtttgtaatgagatccaggcaattttagcaagaattatatagtgtggatagacatatacagatgtctaagaaaatcagccacacgattgcagtggaaaacatttgagtagtttagaatcaaactgcaaatatgaaactattacaaacatgaagcaagtaaaagcgggatgttggcactctgaaactgcaaaaaacctgaaacgcttctattatgtgcttgttgactgcaaacctgaaacggtggagatcgaccgagaggcgacgttgccgatggagacgagcggatccagacacggcatcgattgttggttgctgtcgtgcatgtatttcacctaggatggcaacaaaatcatgacacaataattccagctgaacaaaataactacagcaaaaatgatttggaatggacgctctcagccggcgcccggcggatgtgcaggcgcgacgccgaaggtctgacgctctgaggcagagctcatggagactggatcttggggcgtcgttgagcctgaagccgaccggcagaggaggggcgtcgaggcggggccgcggggggggggggggggggggg

SEQ ID NO: 12996 - DNA, 5302 bp, Oryza sativa
gggggggggtgacgaaccgaggggcgcggtcgtagtggcgcggagctagcagcgagactggactggaggcggacggccacgaccccgacgaccccgggcggcgcaccacaaacagcggtggagagagggcagggctagtgtgattttatatctcaggctagactcgcttgagctgtcttacattagtgtctttactttcgtttcgctaaccgcccaaaagcaggtgcgcacacacaaatgctaggcgagatgaggtcgggcggcagtgatggagctccatggggatcttgagccaccgagccacagcgcgcctgccttcacccgagcaagacgccaagacccgcgtgggagggaggggacgtcggatcggacgcacattcagtgacattccccgtgacattctcggtgacattgactcaccgacacgtgggacccacatgtgtctggatccacgtgggtcccacacgtcagtgactcaatgtcacggggaatgtcaccggagcgatgtggccgaatctcaatcccatcggatccgccatcgcgccgcctttagctgcgccggatccgcctcgctgcgaccagatccaccgccgcctcgccgagcctccagtcacccaccaccaccgcgcccgctaatgccgcgcccatcgccgttcggcggtggcggaggtggagccgccgcgcctcccgcccgccgacgccgcgcccgtagtcacttgttgccccgaaccgctactgccgccgctccttctcaccgcatgacaaactgcatgcctccgccggatccgtaaaaagtggagagggaggggaaagtgagtggacggttagattcaataataagctatttactccgtaaatgtaggagagggaggggcgcagcccgcaggtgggcttttgggggaggggtggggggtaggcggggagggggtgggatgtgagaggaagcgttttagttattacgcaccccaggtacggtatagtatgtgtgtgtctatatatatatatatcactattataaaaattgaatatgtttttgtcgggattttggtacgtcatccgtgttagaaacggttttaattttatgtttcagttttaatctatatctatatctctataaaaacaatttccgtcttctgtaaaaaaagaaagataaaagtccgactaaaaaagaggtaaaaaaagaaagaaaaaaatgtccgactcaatgagcgattaaaaaaaaaaaagcttccgtcgtcctcagtaaaaaaaagagaaaaaaaccatctcttgtccgactcccatacaaaaaggaaaaaaaatctcccagtaaaaaacgaaaaagtctgtttgttttttttcaccggtatttttttttccttttttctttttctttgcacgcaaaagagttttctacgttttctctttgcacacaaaagagtttttttatgcgcacacgctaaggcttttggttttttttaatccgatcggttcaccgtgcacctcccgtgcgcttttagttttttcgtcaatctttgttgtcatcggtttttctcccgtgcgcttttttttttcttatctggttttataatcccatatgttcaccgccgttatatcgatcgtgcgttttctcccccaatttgatttcaaaaatcaattccccactcctctctcatcattttctctatgattttcccttcgattcggctttaattgccggatttaatctctgttttatagttaccgatgatgacggtgatcttccccggtcatttttatcccgagttttatgctctgattcagggaaaacggaaggagtagctcaagtggataaaaaccctcgactaattttggctgaccaagaaagatttagccaaatttgatggggatattttctctggcaaacgtacgggcgcggacacgggattatcttcgggagattgaagatggtagtcatagtcgggaagttgaaggtagttgggtcgaagagaagaacaccaaatgaaggaaggtagcggactagcgtagggctgacaaggaagaaaggctttcggctgaaaacccaggaaatattttcattaccttttcttaattataatttatagcgatcccaatattaagatttttattaaccttttcaattatagtgtatactgaatatccaaatatttcagctgtgtttagatttcaacttttccgtcacatcaaatgtttggacacatgtatggagcatcaaatgtggaaaaaaaaagaaaaactaattgtacaatccgactgtaaatcgcgagacgaatcttttgagcctaattacattatgattagccataagtgctacagtaacccacatgacggattaattgggctcaaaaaattcgtctcgcagtttacagtcggaatctgtaatttgttttgttattagtctacgtttaatactttaaatgtgtgtcaaaaaaaaattggccaaatttttacagcatctaaccacggccttcaatttgttactcgactcttagtatatcattgaaaaaagtctttacccgttgcaacgcacgggcaacttttatttgataatgtgtttgtttgagcgtccgtttctatactatgggcctgtttggtagagctccaactccaaaatttaattacatgagttaggtctggagtcaagttgtggagctgcccaaaccctactccacctctctagttaattttgtgagagctccatccagttccactcccattttaggtggagctgaaactgtttggctgacatctaactctaggagaggtggaggttgagctggagctgtgccaaataggccctatatttcattgacaaaattaaatgccttgtggcttgtacaacctaaccatcacacatataatcgtggcttgtgcaaccaaaccatcacacatataatcatcctcaccatcctacccatcagagattatttatagctttttgccaccacatgtagccaccactaagacaaataataatatctggccaccaccataatatatatatttccgggtgaacagatattgtcacacctgaaaatacggcatcgtcttcacatgctctgaacttaggcatatgcctagcactagtacacgattgattttcctggacgctgcccccttttatttccatgcgattggtaagtaaaaccgcacgagaaaatcgaaaaccggtgccaagctaacgcctgcacgagaaaatcgattttcccgtgcggtcccgcacaagaggaccgcacgggaaaataaacagattttcccatgcggtaatatcctcttttcccacttatccacatcgaaatttcctcggtaccctccctctcctttattctctcacgtgtcacgtgttaaagcagacagcgatgtgtcaggcctcatatcctctcctcactcctccctcctctcctccctcagcgacagcgacgagacagcgtgcggtgggcataggcgactgcggtggtgcgcggcgacagcgtcgcagcgcgcatctgccgtggaagcacgggatatggtgggcagcggcgacgacgaggtggcacgcgacggctgcgtccgatccagcggtggccaccccacgcgcggatccggaggcggcggccacccccacgaggattcggctgcatgacggcggcggcggccatggcaacggccgccccccgcgtggatccagcggcggcaaccgccccacgcgcggatccggcggcggcggccctgtgccccccacggatccggtgacggcgtccgcccctcgcacggatccggcggcggctgccgcccctcgcgtggatccagctgcgctacggcggcggcagccgccccccgcgtggatccggcggcggcgtccacccccgcgcggatccggcggcgcgacggcggaggcggtcgccccacgcacggatccggcagcggcggccaccccacgcgtggatccggaggcgcgacggtggcggcgccgccccccgcgcggatccggcggcggcgacgggagcgcgacgacggcggcatggccacggcaacggcgacgacgacgggaaggcggcgatggtggcgacgggtagggttagggtttcgttttttcaattttgtttttttttcgattttttgtttttgcgtgcgccacccgcacgcaaaaatattgattttcgtagacgaattgctccagacgggctgaagctgcacacgtgaaaatccaaatcaacagcacgggaaacgatctgtgtagtagtgtagtctccttgaggaagatatatttagtacaatcctatactactagcaacaagattcatgacgattgagcaagatttagtacaaccctacaagcaagccagacatgtacaactagaatatgcaaataatgcacatggcaagttaaaacaaaaaatgcacaagacacaagtaaagtaaggcacatgcatgggtgattttgcgtaagggatcgaatagttttcaacaattcaagacttctacaatgcagatcagtttcaaacacatagtctaacctagctaataagtcataattcaataacattatcttggtagtgtttggtttggggacagggtgggatgggttaggtccatccctgttttttggaatgggatgatcttgttttttgtttggttacagggatggaacgagcactgttttttgtttggtttgaggtatataatgggatggaatgatcctatacattgtttggatggagggatgaaggtgggatgcttgatagggttacctattgatattagttggtgaggttaccctcaactagtcatgaataccacacagtgcaaaataatacttactcatgaacaccacactatttgaaaatgaccattgtgaatctgttcgcaaacaatatagctccataggttattaaaaagatttaataaaacttcatgtatgccgatactaattgctgcaacagtaggcttcacagggcacatataatacaagccacccataataatagcaaattttagtcttacacatattagcaaccgaaggtcttacacataatagcacattttaattcttgcacatgatagcaattttaagtctagtaagttctctgcctcaaacatattggcagtttaaagtcttacatataataggtaaataagccaaccaacaacacataacaccaaaagaactatccaactcatccaagaagcctatgttgatccagggaacttttcactaatgaacatagcaaaccaatgcatcttgttttcaaatggaagtccatcgaatgctctagcaatatgagggttggcaaccaaatgagcatagtaaaatgatctatgg

SEQ ID NO: 12997 - DNA, 1448 bp, Oryza sativa
cccagaaaataagacatatacctcaatataaccattatagtgctcatcatcaagagtaataatgaagtttttctcatcccaaccagcagcactcactttcctaagcctatttatcttcgagaactttctttgccatgtcttcaaatggttcttaatttgctcacccgtgagagtactattgaacctttcattgaccgccctagcacatgcattgagatggactgccttgaaaccagatgaggtccttgtgccaccagcaacaacattagctaggtgagaaagcatgaaagaggacatagctgaggtccatgaagcatgggtgcttcctcccttgccactgttgttatccatttcctacctatcataaaataaaacaaaaatgtccattcagtaatatatatatcaataaattatgcatgcaacaatatatgaactcagaaaataactattcagcaatatatctaataaaaaaatgaccattcagcaacatatcaacccaaaaaattaccattcaccaacatatcaacccagaaaatgaccattcagcaacatatcaacccaaaaaattagcattcacaacatatcaaccgggaatatgagcattcagcaatatatcaacccaaaaaattacctttcaccaacatatcaacccagaatattagcatccagcaacatattaaccaagaaattcaacattcatcaattcatcaaaccagaaattcagcatacaacaatacatttatccatacaactaagatttggcaaatggactacaacaagctgtccacacgaaataaataaataaagaagttcataatacaaatgaaatgtagcaaataaggtagaaatacaagttgcatagctacatattacactccatgatggttattacggtcagcccacatctgatcagctaaaccctgcctgaactgaaccatcaatgcatggtcattcgcttgccaagttggcgattcatcaatgtcctcacttgaccaatcagacggagctacaagctcatcaattccgtcatttatgacccagttatgaataatacaacaagctacaacaatatctacttgagttcgaaatgggaagaatggagtggcatcatctagaactttgaacctcctctttagtgacccaaatgcacgttcaaccgttatacggagggatgagtgtctaaggttgaacaactccttctcattttgcaccggattattcccccactctttcaagtggtaccggacagcacgaaaaggaggcaagaatccttgtttggctccatatccaccatcaactaaatagaattttcctatcatatgatcgataagttggtcacattcctaaatatcaacatttgtcatggagaatttgataaactatagtaatctattaccttgtgggacatgaaggccattttcacgttccaaagcatctcttaaaactac

SEQ ID NO: 12998 - DNA, 13119 bp, Oryza sativa
cgagacaagtgaggcgcgaggcggaagtgggatggcgcggtccgtctctttttcccggatgaatcggtcccgaatattgaaggaatattccctttgagagccatcccatcccttctagcctctcaaccaaacacacctaaaaatgggatgatcccatcccatcccgggatatccctccaaccaaacgctaccttaggttgtgaaacccacgcacaactaggggtgaaagtggttcggatagtttccatccgtccggaccatttttcggattcggatagtttcggtcggaactatccggaaattctcggattcggaaatgaattcggattttttttctcggaaacgaaaacgaatacaataagggtactatccatctccgtcggaatcggaaaacagtcggaaactatccggatttttttcggatatccacagacattgagcaaattttagaaaaaacacgtatatatacataactttttcatgcggaatcaaacggagacaaactttatatcaatattgtagagatcgatgagatctacaacattcttattaactattttattatttgagatcatttaagggtctaaatattcattataatataccatattaatttttacaaaatctcatatctacaattcaaacgacatctgatggagatgtgttccatatcaaagttgtagagctcaacgggatctaccactttgtagtttataacatttgtatttgaaagcatttaaagtataaaacaaacattacaagtttcgaagatgtgaagtaaaataaataacatcttcaatttatacaatggtaagtaagttatacatctagtaaaaggtcttgggaatagaaaatgataatcatatttgcatatggatctctaagaggaatagccatgaaaatcgattttcacatacggttgtgggaccgtctacaaaattgacgatataaatgttggagatgttgaactaaaataataagcgatatctcttactggatccagaaactcaatttgagggttttttatataccagtaaatattcgctaccgtattcgttccatctcgtattcgctccgtatctgtatttgataatattcgatttcatttccgtatccgagttttcgattatgattccgattccaaaaaaaaaaatgaaaacgaatatgataaagctagtttccgtccgtttccgatccgttttcatccctacgcacaacctgcccctcctgcctccaacttgcccttaacccatagacaatagtctacgtggtcggtggttccaccaacgggtggtaaaaaattaaccagaaatagtaaaacggaccgaagaagtgttggttttttcggtgtttggttttgccttttgttttgtttatagtgaagctcagtctctagtttgcaaaaactaaaagccccgtataaaccgagcatgctagcacagtagcacctctctagtatgggcctgtttgggggagctttagattttgagaagcagttgtttggtagctagcttctgagaatccggaaaagctctgaaacccagcttctacaccttctggcttcttagttcatttttcagaatctgtaactacagattcccagaagctgtggactgcttggggcagcttctagcagaagcagcttttgggaaaagctgcagctgggagaagctccccaaacatggccctagccttttatgtgcgcagcccaccaccttgttgaaggctttcagcttgcccacttactaactagcaattaaaccagcacatccaccgttgccttatgaaccctagccgccactcgtcgtacactcacaaagtttacgcaggtggccaagcagccttgacggtgactgcgaccgggggaacagaggtgggaggcagacgaagatctacgtaggtggttttcggtggaactgaacccggaaaagccaaaccaacaatactaagagaatcaatttttctggacgagactccctttaggttgcaggcctgtcataattgctcccgcttgaaaaaatcgctcccctgtagatagtgaccccttaagaggccctcatgagaaaatagattttcgtatgctggcaaaggggagtgcaagtgtccccccacacattttttcccgcacaattttttctccttctcctccttctcaacaccgcacctttttctcttctccatcgcacctttttcccactccctctcttcatctctttgttaacactaaaatttgataagattctttagtggattcggttaaggaaagagcacaatcagtcgatggaaagcttatccagaagagtccaagttcaagaacgaatcataagacttgtatctattaataaggcggagtcagttagtttccttttttgttagtgtctgattaggatttgtatcttttcttttatcttcaggaaagtttgagtcgtgtccagttaggactcttatcggccaataggtataactatgtacacccaggatccctgtaatctatctctcgatcaatacaactactctcggagcatcaccaccctctttttcgagggttttatcaccgtcagaacttggcacctgacacgggctgcatcgcttcgatctccgacataggggtaagtcataagttccgccggccatgtcaattgtatcggttatgttggtgttgtccaaggctgcatcgctttgatctcttggattgctctagttcggttggtatatttttcctacccgatatttcaattctatatttaattacattgtgtttagatatgcatcgtttagttgggactgtctcggttaggtctgatcttctgtcttagccaatatatctctacaatcacaatgtcactttagatagatttgttatatccatcacattatataaatttatcgactcattgagtattagattatcatatacaatttaatgtttcatcagttaggtccaacctgctaaattgttattgacaatctaaatcttgttaggccgataggttcatgctaatgtttcattgtagggttagctgatcttatctgatgtgttaaatttatctttgatggttttactattttggttaaatttaatgcatcattaccatgatcggtgtcatattagcttattcaaatctatcaggcaattatcaaccttatgctgcatcggttaggtttgacctatcgggttgtggttgtaagttagatttttttaagtctttaagcatcaatcattgtttcatcggggtttcagctggtgagttatcttgtcggtgatatgggcccggaggtatcaggtttagagggaggaggctcccccgagggggggagtcaggcccgaggtagggtggcggccactccttcctaaagactggatggaggaggctgccccccgatgccacgtggccctcccccgaggggagtcaggcccgaggtggggcggcggccactccctggccgagactagagggagaaggctgccccaggcgccacatggccctcccccgaggggggatcgggcccgaggtcgggcggcggccgccccctcctgtgactaggggttgggctcccccgaccccctctctaggtcaccatgtacggtgggttaagtgtccacctccaggtgcccacctacccgcatttatggcagcccgagtagtcgcgccgtgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgagaggttctcatcctcctatcccagccggagtcggtcccccgctctggtcaaagcaaggctcctgtttcccagtgtaataggagcccagaagtcctcacccattaaatggtgactgacaggggcaccccccgtgtcaggcggcaagatttgacaggcctcatcatcaagatgacgtgcgcttgcttcccaagtcaagagacaggacatgcatttaatgcaaagattgtaatccttctccactaagttatgtttttgggcccatgtggtaaccccttgagatataaaaggaggtccaggcctagtaggagggggggctagagcccctgatgatcaacaccttctaccccaacaaggagatcttataatttctcacaagatcagctaagcataggagtagggtattacgcttctcagcggcccaaacctgtataaactccttttgtctcatcaccttggagggggataactccctcaagatgacacagcttcgctcaacaaaccctcgaatctcacccgctgccctcggcagaactcacaaaggggggcctcacggttccccggtggaggagttcattctccgacatctggcgcgccaggtagggggcgcgttcgtgatttttgaggttctttcgagtgccggtgtgacgagcgtcgcggcgccaaagcgggggaaggcgcagcctcctcaggagtgtcgcgccaccccaggcagaaggctaggcccccccacatcctcatcgaaaaaggccagcggccaggcttttgtggcgagtcttcgaaatgtccgatggcccccaaagttccggcccagcctcactgagaagtacgacggcggcgtcaacccctccgagtccctccagatctacacgatgatcatagaggcggcggggggtgatgatcaggtcatgacgagcttcttccccatggccctcaggggccaagcgcggggttggctcatgaacctgctgcctgcctcggtctactcctgggaggactcttgcagttgagctccaggtgccgtcgaagcccgggaccccctgtgctggctcttccgcagcggctagctttggtctcgccggctggctacggtgcctgacccggctcaactaatcgtcctttcaagtttcaatggtcgcaggcttcccaaatggttaggaacccatggtgggaggccctcttcgagctaacggtttgaaaggtcgcgacatgcaagcaaggtttgtgtttgcttcattcatacaagcgattatttgctataagtgtggggggctacgattcctagctccatcctagccctacgacgagctctgggcgccgtccacgtctggggccccctgtgctggctcttccgtagcggctagctttggccctgacggctggctacagcgcccagcttggcttgatcgtgggtgaagattgttggctatggaaaatttagtcctcgcactcgtgcgaagataatcgtttgcatagaattattatggcttatatttatctctcatctcatcctcgcggtcccgcggtacccatgtgtcgcgcgctcgtttgccccccttggtaacgaaaagtttgtattcgctttatccatccaaacgattttttgctaaaagtgtggtggctacgattcctagctctatcctagccctgcatcgagctttgggtaccgtcgacgcccggggccccctgtgctagctcttccgtagcagctggctttggccccgtcgcctcgctacggcgccgagcttagcttgatcgcgggtgaagattgctggctatggaaagttcagtcgtcacactcacgcgaaaacaatgggttgaatagatgaagtagaacaggaacagaggttaacaaaaggcaggggcaagcgaggtacgggacgtgaggtctgcgggcccgagagaatctaacaacgtttgctgaatgtatacagaaaataagtttacagcctaaggtacgggctggcgagtcgccctcaggctggggcgaaaaaggcgcatgggtcctagtgctagcaaagaaagaagaagataccgggcccacatatcatcagactaggagagtggcatcaaccttgaccacctggggaaagttttggttagggctaacgccgggggctactgtcggtgatatgggcccgggggtatcaggtttaaagggaggaggctcccccgagggggggagtcaggctcgaggtagggtggcggccactccttcctagagactggatagaggaggctgccccccgatgccacgtggccctcccccgaggggagtcaggcccgaggtggggcgacggccactccctggccgagacaagagggagaaggctgccccaggcgccacgtggcctgaggtcgggcggcggccgccccctcccgtgactaggggtcgggctcccccgaccccctctctaggtcaccatgtacggtgggttaagtgtccgcctccaggtgcccacctacccgcatttatggcggcccgagtagtcgcgccatgccgcatttaatatggtgtgcaatgcactcaactggtctgtgaccggtcgaatgaccgatgggactggggtagtgcgcctgtgcgctgctcgtgtgtcaggcgacgtgcagcctgacatgtcccatcaaatagtgatggtgggaggttctcatcctcttatcctagccgaagtcggccctcccgctctggtcaaagcaaggctcccgtttcccgatgtaataggagcccagaagtcctcacccattaaatggtgactgacaggggcaccccccgtgtcaggcggcaagatttgacaggcctcatcatcaagatgacgtgcgtttgcttcccaagtcaagagacaagacatgcatttaatgtaaagattgtaatccttctccactaagttatgtttttgggcccatgtggtaaccccttgagatataaaaggaggtccaggcctagtaggagggggggctggagcccttgatgatcaacaccttctaccccaacaaggagatcttgtaatttatcacaagatcagctaagcacaggagtagggtattacgcttctcagcggcccgaacttgtataaactccttttgtctcatcaccttggagggggataactccctcaagatgacacagcttcgctcaccaagccctcgaatctcacccgctgcccccggccgaactcacaaaggggggcctcacggttccccggtggaggagttcattctccgacatatctggattctggatgttgtttaagtgttgcattagcttataaggattatatacaagttggttttagccgattgtagcgaaggtttaattgattccttaatcatttggaattgatgatattggttttctagccgatgtatgttttaatcatcgagactacatttaatattatttctatatcaacatcggtcgattggttcattagatattttgcttcgttacatctatactggccgattggtacattggatatttatttattactttattattagctgattgtctttatatcattgtttatacaagtatcagagtccacatcggacatatagtcgattgttaaaaaccctatcgatatcagcttgttggtcgatcggctctttgatcatccatttatatatctagtcagttgcatgatcaaactgattggcacatcaacatctcaactataatttaggacatgcacttgagctaaatagatctcccaggcctttgtgtttttcacgtcaacactcttcccctttcctctcccccttatgttctccggcggctaaggcggagcaggctagagcgagctgagtgagaacgagctggcggcggcaggttcggatgggcaacaatgatggcaagcggtgacggcagagctcaagggcggcttatttggcaatgccaccctcgacagttactacggggacgactatagcagacggcgacgacaatagtgagctcgacgacaatagttcctccactcgatgcactatcaattacattacgcgatagtcccttagttaattgatttgccagatttaatttttagccatctggacatagtacaatgctatcactctagagtttttcagctttctgatatattttagtcaacgttttatatgcctagatgatttcatgttattgcgtgatggtataaagatcttctctttccacaatgacgtatatcagcaaatgaggttaagtcaatgggcctgggtctatattatattatactactgccgttctatcttaagttatttgtttataagatactaattgataaaattgaacaaataataaattatatattattatttgttttcaatagtaagttatatcttatgattgttatatatatcttcctcttattaatttattgatttgcctcttattttgtgccatagataccccaaagttattttgctatgtttcttggtgtattagtttgtgtgcatcagttctgtctcatgcaagacatgtttatcattaattttcttgtcaaatcagattaattcaatcatactccattcagtttttaatagatgacacgtaaacttttggacagcaatttgttttattaaaaaaatcgtacaaatatataagatatgtttaaagtacttttttgaaaaaacaacacataccaaaataaataataattacgtattttttaataagacatatagttaaatgtgtgtttaaaagttaatagcgtcatctattaaaaaatataggtaatatgctgtaagctattaattcgtgtagacactgtcattggttccgccttacactcagtggtccatctaaaaaatagtccatagaatttattgttatgcaaagtaagaaaacgctgataagatcaatcgcaatgggttgggttctatttagacctaatcatcatccaaatagtattaggacaaaatatttgttggtttttttttgtgcactattgaggttgggtcctatcctaatactctcttggctagacactgctccctccgtttcacgatgtaagtcattctagcattttctacattcatattatatatgtagattcattaatatcaatataaatatgagaaatactaaaatgacctacattgtaaaacggaggaagtactactttaaggatcttctctatacatgatattttttacctataatgtgtgtcctttgatgtgcatgcatactccctccgtcccaaaaaacctaatctaggattgggatgggacataatctagtacaatgaatttggacagattttcagttcagatcctaactaggttaggttttttgggacgaagggagtatgcttatagcttatttatagcatgctattatagaatgggtctagccctcgtacacagagtacgataatgcattggatggtacatacttgtcttacaagagatattcttgcaggctatgaagcattatttattgttggagtcctagctctagtggtggttgttgtgtagattattgtctcatgttttatgtggacaagaaggagcaatgacgacttagatcttaaggaaattgggggacctaggcagttcatataccgagatttgaatgttgcgactaacaagtttttgaatgtgattgggcgtggtgcctttggcgtggtctgccgcgggtccttaggaggctatgaggtggcggttaaaaccctaataaatggaaggaaggacttcatcgccgagctcagctcaattggtggggtgaagcacaagaatcttgtcaggctcattggctggtgcaggcaaaataggttcaacattgttgatttcatattctggtggaggcatgacaaaaagaataagcttttccttgtgtatgagctggtgagcaatggcaacctttgctaaacgcctacacgagggagtactcgaatggacaacaaggtaactaactaatatacacacacgcatgctttatatatatatatatatatatatatatttatatatatatatatggtacaacttattaaattcttttatatatatgtatattaggttcataataataaaggatatcgccaatgctcttctatacctccatgaagaatgccacccgtacatcttgcatagagatatcaagccagacaacatactcctggacaacaacttcaatgccaagcttgctgatttcgggctgtcaaggatcgccgaccccgacaacaacatagtgaagacgacagcccatgggactaagggttatattgatccactctgcatgagggacgcgaccattgaattcgatcgtagctctgacatgtacagcttcggcatggtcctgctagtggtggcatgcacacaaggcacctccagggaacaagtctggcagctgtaccaggacaaatctctcctgcaggctgctgatgacaatttgagaggccagtatgacgagacgcagatggaaagagtactcatcctaggactctgttgctcccgccttgatgatgctaccaagcggcctaccatccgtcaagcattggcttttctggagcacggcggcccaatgccaggcctggagtcattgatcaaccctcgatcgaatctctaaaaattgatgagcaagatgcaattaatagcacttaattgggtccatggatacgtactttgttatactccatttgcgtaattttacctatgccgatgcataatgtgcgacatcattgtcctcatttgttatggttactcatgcagcttccccttcaggttattctcacaaactagaaaggtatgtgcgcggggcaccttatttaattaatgttacttgaattttagttatgaatacttatgtgtggatgagtatttcttaaaatatttttttactctattctgaacatgtttttatcaataatttgtttgaggttgttgtgaacgtcgcttttaattttcttctaattacctttcaaacatataaattctaaaccaaaattatttaaaccgtgtggtttttaatttatgagatactattgtttcacaacaatagtgctacttcatatggaactattacgtgtaccatgtgtgtgtatttttttttagaaatcagcatatattactttggagttatagatgtctattttatctgtttaatggcagacttctatttacttcttctccctcctcttttttttttctcatatgatctcttatattatgtggagaaaatgaatttagtttgaaataagagcggaaataattagtatgtttagagaatttataaatatttaagcaccatagactaaagtatagactaaagtatacttttgttaagtaagttcttattatgacgtgtatttttaatgcatgaattcttatattaactttagtattgtttatattccataattaaccaaacttagtatatacaaaatacccacacaccatacgtatttaatagaaatcaaaggggataaaacacaacatgtactccatccgttattttacttattatttagggtgtagtctacaaattatacatgatttggtaaatagaattgacattttagattatccctgtatagtccgaatagattggaatccacatgataagtatatttatatgatcatataatccatattgttaatttttatcatgatttgtcgtaattctcaattgccatgcaaggctgtgacttgctacttgttgatattgtaaatctaattaagtcgagcatatttgtgaactgatatgggctgaatagagtgcacactacatagtaagcatatttatgtgatgatattagccatatcattaaattgttttttcacgatttgttataattctcaaatgccatataaagcgcaaagatatgacatgtttctggttgatattgtaaatctaatttagtggtacatattattatatccgacaaagaatatatagtgatatatactccacactgtcattttttttataattttcatgtccgtttggattacacacaaagaataaaaatatgacctaaaatataattttttatagattaaagtatagttaatatagatcataaattaagttaatggtaaataatataatttagtaaacttttttttcaatcatcttagatctaattttagttatttatgattataatgtgatatatgacactataacctgtgtttttcgtgtttttttgtctgtgagatataacacaaatggtcaaatcatggatcaaaataatatttattatttttttctaaataaaaatatagtaaatatggattgatttaaatgtaaagaatataattgtggtagaataaaaaaaattgtatatataatttaaaagttacaatagtttatttattatatttatgtactacatttatctcaaataatataggaaaaaatgagttaaggagagggaagaggggctccacattatctgcaattagtgagtatggctggttagttaagtatggtggaacttaaccacctaggtttaagatgtagtcttgacatgggtctcatatttatggctaattatttttgtagtaggcgacgttcccatcaatagcgaggtgcttgtggtgacttcactaatttgaagatatatcattggctcagtctctcgaatatgttttctatggataagtgcacacgcgtgtatatgaactcttgtgtttgtactatgtttctcttaaaaaagcggcatgcattacccttccaaaatgattatctaaaaaatcaattagcaaatttctgtcggcaaagcacgcagtatcaagatgtctcgactaagtgctcaaaaatcaactgacatcacccaaatacccgatgttagtgaatatattgtccaagagccaagagctttgatatatcgctttgttgtagaagctagtagcaacagatcagaatacgaacaacatcaccaaggagtagtataaaatgggaaaaagtacgaattacacccccgaactatcgcggtcgtctgaattacccacttgaaccacaaaaccgaacatttttcacccccgactatacaaaccggacgaattaccccctcgacccaatccacgttggttttggtctacgtggcgtgcacgtggcagtccagtcagcgttttttaattaaaaaattgtgggacccgcatgtcatacacttcttactctgtctattctctctctcttttctctctcgcgcagcgcgcacggcgaggacgagcgcggggacgggcggtcggcgacagtggctcgcggcggcggcggccgagcaggtcgaggagtaccaccacgccgagcaggtcgacgagcaggaggaccaccaccacgccgcgcagcacgacatgagtagcgaccccgataagctccagggcg

SEQ ID NO: 12999 - DNA, 12463 bp, Oryza sativa
ggccaccgccgcgctcgcgtcatctccgcgccaccgccgctacgagccgctgttgccgactagggtggaaaaaaatcttgggctcatgagctcagctcgggcttggctcgagctcgcttagctcagcttggcttgaatgccaaacgagccaagcccaagcttcattttcagctcggttctgaaacgagccgagcccgagctggctcgtgagccgcttgatttggctcgtgagccttagccatcatgtatttatatggatgattttattttctagtggagttattatttgtcaatatgtaatttatcatctatattttgatgaatttaatatataaagttattttaattttacatgttgataatttgttatcgcttttcttaatgattataaattatatagcttcaacggaaggctcgcaagccagctcgagctggcttgagccaggaaacgagccgagccaagctcatgtcttagctcgcttccctaaccgagccgagccaagccaagcctagcttgttgcaagccattacaagccgagccgagccaggcttggcttggctcgtttccacccctatcgccgatcgccggtccctacgctcgtcctcaccgtgcgcgctgcgcgagagagaaaagaaagagagagaatagagaaagagagagtaagaagtgtatgacatgcgggtcccacaattttttaattaaaaacgctgactggactgccacgtagaccaaaaccaccgtggattgggtcgaggggggtaattcgtccagtttgcatacttgggggtgtcagggttatggataccacatacctaatagtagttgactaaatctcggcaggacccaccacataccatgtcttatacggaaacaaccttcagatataggaggagttccgcataaggaaggatgaatagagttctacatggaaacgacaaggactacttggattgtatccatatttatttccctagttctacttggacaaggggacacctatgggtataaatataaggcctcctagaaggagaggggacacggaacaatagatcaagatacaagatcaacatacaagccaacatgcgccaagacaagacgccggatatcgacttcagagataagcatgactagtcccctacggtgtctacggatactgtcaggagagatatagcactgtctttgatctcgccggatgtggattcgaggaggaagggtaccctgttgtcgattacgagtcagcacttcggactgccaagtcgataacagttagataggctaccccaaatattgtactggtgtgattatggtgaataagagcaacgactggtttcgaccaactggagtaggattattacctgacaattcagggacccgaacctgtataaaaatcctcgtctccatcttttttactacaatctcgcaaatatcctagtaccaatgatccccatactatgcaaatatcagaatcgcgacatcaaacatcgacagtggcgcgcgcagttgggagattttggtgcttcagggtttcgatgaaatgggtttatgagatggattctccaacaacaagctactcgacaacttcagctatgaggagatctaacccgatcggagtatgtcgtccaacaagatcggaaccattgtcgtcaaatatttaatccggcgagatagaccaagcttgaagacattgccgtcgcggaagacgttagttcactaatgtcgaccgtgggattttggtccatgtcggctacttcggaaactaacatcgaccgccaaaaagttcgacgaattaccgccgggtatcgacgacatcagtgatcggtctgacgattagcgtgttcggagaattgacgaggtgtacgtatcctcatcggtttctgatatactccctccctccctaaatatttgacaccgttaatttttttaaacatatttgactgttcattttatttaaaacttttgtgatatgtgtaaaactatatgtatacataaaagtatatttaacaataaattaaatgatagaaaaagaattaacaattacttaaattttttaaataagacgaacggtcaaacatttttaaaaaagtcaacagcgtcaaacattttagtatggaggtagtattatattggcctacagcagaccagagtcaactacacgtcgttacccgccaatcaagcaactagccgactgcatctacacatgtattaagcatgcatgcggtgggacccatgtacagtaatgcatggtgtgtaccgaaggctattttagccataggtatgcttgtatacataggtaagccgtccacacgtgctaatcacggaggacaattcagattggctaaaaggtatttagtagattaattttttaaattaatatatactattttcgtagatatatctggcatatatctacacaggtacgcgatatttcataaaaaaattatcgtacttacttttctgatctatataatattgtcagatccatgatttattatgtttaactagagcatgttttttatataatatctattgtgcgagtgtttccgacgttaaaccaactatggtctaatgctacgggcttgctctattttcttatgataaatcatgcttgtttacggtttacataatccctgatatttaatctgcccgttatatcctgataatactagaagatccacgcagttttctgagtacatactcgatattatctactatatatcttgccttctagaaaatatttttcaggaatgactaagcactcgagtaggttgtgatcaagcacatgcattattgagaacgttctcgacaaatgcaaagttgtcacacccaacctaccaacgatgaccgacgacctatctcatagcactgaccatggctgggctgttcgagacaaggttgttaacggataatttctcgcgaacgttgtcagcttgatcacccaacatgattgcgaacggatatccggatatgctataagttggatatgtgagtcatgctggccacatgagatgcacatgtaacaaaccaactttagcgcccctatagacgatcgagaggcccctactcctggttctcgaaccagtatgacgaagcgatctctcgcgccttaacttccaacggtcgaggtacgacaacggcaatagcgtagcggtgcttgcaccacgacatcaaatggttgaggtacgactacggcaatagcgtagcggtcctcgcaccacgacttcagatggacgaggtacgactacgactggtctttgaccagcagcgtagcggtcctcgcacctcgacttcaatcggtaaggagataaggttgctcctggttctcgaagtagtaggccgtagctatctctcgtacctcgacctcaatcggtcgggagataaggctgctcctggttctcgaaccaataggccatagctatctctcgtacctcgacttcaatcggtcgagagataaggctactcctggttttcgaaccagtaggctgtagcgatctctcacacctttacttcaagtggtcgagttataactacccctggtttccaaccagaggcatagcgatcctcccactaccgttacttcaggtggtcgagttagggctacaactagttttcggccagaggtgtagcgattctcccactacctctacttcaataaagttgatatcaggtacacaatatcgccaagtgttttacccatagatcccttaccacgacgacacctagagttgaaaccaatcctacggtccctttacaccgccctagcaaggcctccaaggaacctatgggaacttcggctggggacgcccagagcggataaggccttgtcaggaaatgcatagacgaacgaccatgtaagatctggtcatgtaagagttctcaccgtgcgtattaaccaagccgtgtaatcggaaattgggtttccaacttcacggctgggggctagggtaagcgatttttcaaccaaggtaggtcaagggtccaagagccttatcctccgagaacgattctccgacgataaggctgggggctagggagagtgtatgactcaacaaactgactgatcgaagtcggtaaaagagaagacgctcatatacaaaaacattggtctgtaaatttaattcattttcagttttccatacatattataacatgtcaccttttaagcattcactcgggggctatttctatctaatattcttttctaagtattgatttcatgaaaattctattcgacattgttcttctcattctcttctctggaaaagtctatctgacctcccctcaacaactcccctcaacccagctcctcattctgttctctgcaaaaagtctatctgacctccctactcggcccatcttcttctcctctctctggccaagctggtaggcgataaagtccattccttctccctcttgccggcaggctcgccgtcccgtccccgcgccttgcctcgactccgcgcggccgcaatcgcgcaagccgcggcaaggaccctagccaaccggcgccggcttgcctgcgtcgtccgtcattacgaacaaaacgccggtgcgccgtcccattctcgccggccgtttcccgtggcgattaggtgggcacggtcgcccagcggcccgtgcggcggcggcgttgagcggcaacagccacttggagccccgcgacacccaatcctcggccgcaaaaataattctacctccatccctaaatatacgatgttggtgataaaaaaaaatcaaaggatgtgatgatttcttaagcataagcacctagtatttgttttgggagcagaaaggagcagggaagcgggaaccagcctagctagctagtatttctaacaactgaaactatcaggatatggattttcatccctgaggggatatctccccttgttgtttgcatgtcatctaaatagttgtaaaaaaaatttaaaaaaaattgacaacatagattagtatgaaatatatcagttcacaaagatgcaacaccaaatttcacttccgcaagttacaacaaaatgaacaaattaaaatgaaaatagttgtgtacattcgcatatatatttgttatttttgttgaaacttgtagaagttgaattttaacttgcatgtttgtggagtcatatatttcatattaatatatggcatatttgaattttaacttgcatgtttgccaaatttttttaaaaaaatttgatgactatatttaggtggcatgcatgaaacgaaggaatatcccctcgagggatgacatcactttcccaatctatcactctattatacactattgtattaatatagtaagcaagagcagtatacggaaaaacccacctattttcggcttctggcataatatatatagcaccctgggcaggcgttgtcggatttgctacagtacacaaacccatgaatgccttcttttggcatcaatcgctttgtcttccgtttcaaaaatcagtttgtcttctgtataaaataaattatcgtctcagtaggctaagttcctatcaagaacaaattatatatctaaccgaaaattatggaagggaaactgcatatctagcacgaaaaattggaacatctttttattccggccttccgagaggccgcattattatcagcagcatgaacacctacaagcaaaactcgctcgctgcaagaactcaaggaggtgaactcatcctcctggttctcaacaactacagattgctcactgctacctacccctacaacaatgctacccacagcttggccggaaatctgatcggcggctgccgctacatcgaattcttccgccgctacgacatcgggtgatgcaccgagaacatcgatccatccttgatcggagtcccagtccggcaccgatgacggcgagcacgccattgctctcacccacttggctggacactctgaagatacgttatctgctgctggtgctgtttctaatttatttgctatgctaatggagacgctgctgaggacatcgatccagccttggttgccggagtcccagtccggcaccgacgacggcgagcacgccattgatgtcaccctctgctctattgctgctgttttgtttgctacattaatggagacgctgccgaggacttcgatccagctgcagccatggtcgtcggagtcccagtccggcaatgtctggcaggagcatgccattgctctgatccggccggtagggctgttcgacgacatgtcgtcgacttcctcgccgtcggtcgacgacgactcggactcccataatgtcgcgtcgagcgcgctcgtcggcgacacccatgtcgccttgacggtttccttgttgttgagaccgcatgacttggagatgaacgggtgctgtagcagctgcgccgccgtgggacggtcgccggcgcgccgttgcaggcatccgcgcaagaagtccttcgcctccggtgacagccaccgtggcaggtccggcacggcgtccgtgtacccgatcttgtggagcgcggggaggacgttgtccatgtcgctccacggggcgcggccggtggccatctcgatgacggtgcagcccagcgcccagacgtcggcggccagcccttgctcctcgccacgcgccacctcgggcgccatgaacgccggcgtgccgccgagcaccggctgcttcgaaccaccgggcattgccaccctcgcgcacccgaagtcggtgagcttggcgcggccatcggcgccgacgagcacattactccccttgacgtcgccgtgcacgacgagcttcccgtggaggtagtcgagccctctaagcacgtcggccgcgtacgtcctgacggcgccctcgtcgaggcgacccccgtttctcgccaccacgtcggcgagcgatccgccgggcgcgtactccaggaacagctggtgctcgccgccgccgcagccgccggaggcctggacaaagccaaggcacttgagcacgtgcggcgaggacagcccggacatgacgctccactctcgccggagctgctgcctcgcggcgccctcgccggccgacttgatgacgaagagctccccggagacgtcgttcgctgccagcgacaccacggcgccggaagcgccccggccaacgctgcggaggcgcgtccatccgccgccgccgatgatcgccgcggccattggggaatcggaggcgagagctgggttgagttgttggtgtttccggattagggttgcgaatgctgctgctcgagtcgatcgaggagagtatttatttaatgcgtgaggctggcatgtgggacccgtagcgccgcgcattgcagtgtgaactgtgaaatgcactagagaagcgagggggccgacaagattattgctatagctggaaatttaccagtgtgctctgttaaggaaaggtgtgtttattatcctcttttttatttttaatccatgtggattaagaaggaaacgagaggtaaaaacaaaaggatagacgtgtttagtgtatttctttctatttttttccctgtgtaaaccatggggtggaaaacgtggagtgagaaatagtacgcttgtgagcaaattttgcgtttttgcatgatccattgtaaaaaaatgaaatgttaaaataaattattaagaactactctctctctcgtcgttatatatggaaattttgtgggtccaagactagtcaatgtggtcatcgagctaagaaattaagatctatggtgcaaaatgtgcctcatatctttagaagtgattaaatggttgattaatcatcatccagtaaagtccctgaaacatgcaataagggacggttaaaggtatgtttgtgctactttatattccattcactactacagaaccaagataaccggtcaaagtgatccgtctcagataacatgagctctaacatgtaaaaaaaaaataccattcgagatatgacaaaagggaactacctgtatatgatgtcatctatgatgagtcaaaattataaaccgtcaaagatcatatatgatgaccccacatatatggcaggtccaatcatatggcccaccagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggaggacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaacgatgacaaggaccatgatgacgagcacaacaacaacaatgggcttcggagggggcatgcgatatatagtgacaccttcgaatgggcatagggcataaatgaccaacatgtataggcatcgactggcttgtcgagatcgtcaagaagtacaagatcatctccaaaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaacgtactactcaggcctatagaacaatatcacgcccttttgcaagtctattttgctcatcataggcttcagggtcagccgctgtatcacccccaactatagatggtcatgtgggccacccggcacggcacggcccaagcccggccgtgcctgggccgaggcttgtcgggccggcacggcccgaccgatgcaccaggctgtactgtgccagctcacgggcggcatacacggcccaggcacggcccaatactactcgagccgtgccaggccggcccgaaggcacgatgggctatcgtgcttcctcacagaaaatgtctaattttggtccctcaactctgtgtactgtgtttaaatggctggagaataagtctattttgtatactcctcacataaaagtctatgtttggtccctcaactctatgggctgtgtttaaatggctggaaaataaatctattttgtatacctcttgtcttgggccttgccttatacgattatttaagtctatttttcatctctatattttttatttgaccgggccatgctgtgccggcccaacgtgctgaaggtgtggcccaagcatggcccggctgtcgggtcgggccgacatgggcacgacctcagtcgggccgtgccatgctttgggccgggccacgggccacgggccatatggccatctatacccccgaccaggctgagggaccatgcggcgcgctcaagtgcagcaggactcgttctaactcatccttcacctctccacgctggactgcgactctgcgaggcactgttccggcctccgacatcaacaccttccatgccaataaagctcactacccttgctctgtcaaaaaaatataccaagctagtacttgattagacgtcacgtagttctatgatgactatgaacaggggatctgctctgcctagattaatagtcctaggaggcttctaatcgagtaacaagtcaatatttcggagcgaaggggactacattcgaattatcgatctgtatgaagattagggagagaaaaaggttatgagcacatcgactggggatcgagggacgaggatcatgagaacattcttttattccggcctttcgagaggccgcattattatcagcagcatgaacagctacaagcaaaattctctcgctgcaataactcaaggagatgaactcatcctcctggttctcaacaactacagattgttcactacctactcctacaacaatgctacccacagcttcgccgaaaatctgatcggcggctgccactacatcgaattcttcaggcgcattcccttcaccgccattgtcgtcggccggtgacgcgctgaggacatcgatccaaccatggttgtcggagtcccagtccggcaccgacgacggcgagcacgccattgctctcaccctcttggccggagactctgaagcttcgtaatcttctgctgctgctgtttttttttttgctatgttaatggagacggtgccgagtacttcgatccagccatggtcgtcggagtcccagtccggcaatgtctggccgccggaggatgccattgctatgatccggccggtggggctgttcgacatgtcgtcagcttcctcatcgtctgtcgatgacgacgtctcggactcccacaacgccgccgctgcgtcgagcgcgctcgtcggagacacccatgtcgccttcacgacttctttcttgagaccgcatgactttgagacgaacgggtgctgtagcagctgcgccgccgtgggccggtcgccggcgcgccgttgcatgcaccggcgcaagaagtccttcgcctccggtgacagccatggcggcaggtccggcacggcgtccgtgtacccgatcatccggagagcggcgagcacgtcgtccatgtcgctccacggggcgcggccggtggccatctcgatgacggtgcagcccagcgcccacacgtcggcagccgggccttgctcctcgccgcgcgccacctcgggcgccatgaacgccggcgtgccgccgagcaccggctgcttcgaaccaccgggcatcaccaccctcgcgcacccgaagtcggcgagcttggcgcggccatcggcgccgacgagcacattactccccttgacgtcgccgtgcacgacgagcttctcgtggaggtaatcaagccccctgagcacgtccgccgcgtacgccctgaaggcgctctcgtcgaggcgatccccgtttctcgccaccacgtcggcgagcgatccgccgggcgcgtactcgaggagcagctggtgctcgccgccggcgccggcggcggcctggacaaagccaaggcacctgagcacgtgcggcgaggagagcccggacatgacgctccactctcgccggagctgctgcctcgccgtggcggcgaccgcatcaccggccgacttcacgacgaagagctcgccggaggcgtcgtccgccgcgagagacactgtggcgccggacgcgccgtgcccgatgctgcggaggcgcgtccatccgccgccgccgacgccgatgatcgccgcggccattggggaattaattggaggcgaattgggttgagttcttgatgtttccggattagggttgtgaatttgttgcggatgctgctgctcgtgccgaggagggtatttattgcgtgaggctggcatgtggggcccacccttgcatgcagtccgaaacgcacaggggaatcgagagtggcgtgtggtaatctgactgacatgtggggccgatagggtcaattgctagctggaaatttacctgtgtgtggaactctgtaagtaaggaaaggcgtgcttgttaacctctttttatttttataatccgtgtggattaagaaggaaacgaggattaaaagtaaaaatgaccggcgtgtttagtgtatatctttctattttatcctgtgtgaacaactgagaggaaaatgcggagtgaaaaaaatagtacgtttgtgtgaaaattaaacgaggagcacaagttttgtgttttgtgttgatttagcatgatccattgttaaaattttggatatttctagctcagtgcagctacgaaagagctgcaaaatgcacctcacaattttagtagcgatcaaatggctaattaatcatcatctagtaaagttaccgaacaatgagggacagttacagtcttacagatatttgtccatgtacattgtatagcgtcaactataccgacaagttagatgcaaacactagctactgcactactacgaaaactatttttctgtacaaagatccatttagattgcatacggaacataactggtcgtagtggcggagccaggataaaattatagtggggactcctcagccttttgggccttctaacaatctcagacaaagtctattttaacacccttgcgatagatatatggatttaaattttagggggtcttaatgggggctctaatgattcattagagggtagggggg

SEQ ID NO: 13000 - DNA, 13789 bp, Oryza sativa
accccccagccctcacgctgcctccgccactgactggtcgcgtctacgaaaatcatcctccatttttgtgtgcggttccttaagaaaaccgtacgcaaaaatcaattttcacaggcgggcatcttaacagtcctgcacggaaaaatactcaattttcacagacgggcctaataatcgacctgcacaaaaaaatgagatatttaaccatttgtcacatttagatggggcaattaactttttcccactagacccacatgtcatagacacatgtggacccacgtgtcattgagataggggtggcaaatagttatttgccaaatctaaaagtggcaaatagttaaaaatcccccgaaaaaatacccattccctctcaacctattcaaaaaattcgagtttcccttctctctccctcttatcttctctctctaccccttatcttcacctcactttcctctcctcctcttaatgttctcctcacttcagctgagctagaaccgcgtggccgcgtcgagctcgagccccgcgggccacgccgccggcaccggcgccggcctcttcgcctcctcctccggctccgacggcggtgggcgcgggagtggcgggctcagcgacgtgtgcacggcggtgggcaaccgggagcggcgggctcgcggcagtgtgcacgcgatggcgaacgaccaccccctcccccatccaaatccggcggaggcgactgctcccccccgaatctggcagcgatggccgtccctcgcccggatccagtggcggtggtggcgggcaggcgggttcggacggtggggaggcggcggatccggctaccgcgacggcgacggcgatgacggagtccgtgaggagggcggcggcggcggctgcttttgggttagggttttgcttttttggattttatttttttttagttttttatttttgcgtgtgggcgacataaccaccccgcacacgaaaaatcagattttcgtgtgcgggtgcgccatccgtatataaaaatagcgatttttgtaaatactttgttacatacggttggaagatccacacgtgaaaattgctttcgaccgtacggaataatcgttattgcaccagtgacaagagcacatctgtgctggtttgacaaaacctagcaccgataagggttttcccaccatgaacctcgagctcgtctatgcagagaatatacccggcactgatgagaccacctcttgttgaccggattatgtcattaaatggatatacagactattacatacataagttaaatattttgataaatagagtcaacaaatatcttaaaacaagtgatcaagaagtacaatggaagatatattttttaaaagaagaacatattaaaaacatgcagcaagtcatcatgataataacgtgatgaagcgactgaaatgaagactagtttagctggtgtaaacagtgtgctgcatgtggagagaatatatggcgccttttcgagggagcttcttgctgcggtagcttctcccagaatcagaagttttctcaaacagttcagtttttatccagaatctaaaaattatagaatctaaaagatgaactttaagccaaaagatgaaaaacccagtattttcagtttgtcagaagctgactaccaacagctgtttcgtagaatcttaaacttctccaaacagacccaaacaggcccatgatctgtaactgaaaatgaacggttattaggctaaactggtgctcttggctcacttgatctgacttaattaatcgctcttcctttttctatcattgccacgtggatttggaatagacacacgggcccagacctcctgatctctgggctgataaagaaataaagaaaaaagttagaatactgctaattgcaggcccactaatcaggtcttttcgacaaattcctttgacctgatggcgttcatagtatcacatttttaatctgtatgacttattatctctgtcccaaaatattactatttctaactataataatttattctaaaatgaagttatttattcacctgctatcttctctcaactaataaacaattctctttacctatttttcttttgactatcaatcataattctcctccaattatttgtacctactttcttaatttcttaatgtctgtatatctacataaaaaatgtgtatgtttccttgcgtgtaacggtcctctcacgtgagaaacagaaaaaaaaaagagaagttcgttaagaaaaattatgtgctcctttttacatcaacaatcaattcatttctaataatatagatacatcgtaatgtacgggtatatttcttgacgaccaattcacattggctggtttttaattcccatgtctctattactccctccgttttacaatgtaagtcattcaagtattttccacattcatattgatattaatgaatctaaacatatactcccttcattccaaatcgatctacatatttcataggtataccaagaccaagaaaaactaataactctctcatactatatttattctagcaacaaactcaatgcatgcaccatccccactatttcctagccaataacaaatgaagatattgtatgtgggttataaatacatgtgtgcatggatgcatgcatcaatgtttatttactccaatgcacaaataacgaatagacctaataaatgaacacaacaatgtagatcatttagaaataaacttaaaaaaaactatatgtagatcaatttggaatggagggagtatatctatatagattcattaacattattatgaatgtggaaaatgccagaatgacttatagtgtgaaacggaggaagtattttcttaatggaataaaaccatatatctagtgtaggttaaagacaacctggacagtgtcagacttaattaaacacaagttgcagatagattagtggcagtgaccatactgtttcttgtttcatttttttttaaaaagttgcttctactcgaattaaccacgaatttcacacgaaactgcaaccttgcaaaatatataatccttcccagcaaggacgcattcattttgtcgccatggccaagcccaagacctctcctctccaccgtgtcatcggcgccgcccgctgggacgccgagcgccccctcggccgcctcctcatcctcgcccacgccgccttcctcgacgccggcttcgtgcccgccgccgccgccgccgacgacaactccatccggcttccgaggaaggtgggcaggacggcctcctcgctcccgctccggtacgccgcgccgcagctgctgcactggccggacgacgccgccgccgtccagctgaggctgtgcgcgcacgggcgccacctcgtcttgtacgtgtccatggctagatgctccatgttcagggagtggttggacacgtactgggtgtgcctcgacgcgctcgccgccgcggcgctcctcggcggcgcgctggacgacacggcgcgcgcgctgcggcgcgacgcgcgcctggccgcgctctggggcgcgctcgccgacaggctgtgccggcgcgtcctcgtcgacgtgtgcgccaggaacggcgtgacgctggagcccaccttcatgtcgctccccgacgacgtcaaggcggccatcctggcgaggctccccgacggcgacgacctcgcgagggccgagtgcacctgcgccgggctccggcgcctgtcgcggaccgcgaccgcgacgccgcgctctggaagccgaggtacgagaagctgcctttcctgctgcagctcatcggaggcggcgacgacgacgacggcgagccgacgacggaggtgagctggaagaagaagtatgtggcggcgaggctgtggcctttcggagagctctttgcgtccatgagagagacacggaggctaccgatttatgcaccattgttggacttggacttcgattcattcacacgcttttgggtgttcgatgataagccgtcgccgttgccggaggagatcactgtccctcgtcatcgtcgccgccgtcggaggtggagagcgatgccaagggacgccggccatggccttgcggcgcggggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaagggaaaaaattcagcaacaaatctctagactcattaaaaaatccacggaaagcttacccagtactatgtatttatgggcacaatgatttaaagtctatgagtgaaattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaacttgacagggtgcaggcaagcatgtataggcataaataaatacacccaaggcccatttttgcacttctctcctaggatgattaaataattagtaaaagcacagttttgtcagaaaagaaccttgtcacgaaattcagacgtaactccactatggctgtatttagatccaaactttcaactttttccaccacattaacatgtcatacacacacaacttttcagtcacatcgtaccaattacaatccaaactttcaattttggaaggaaataaaaaaagcctatacaactgcatccattccctgcaaacgtcgacactcgacacattgatgatcacttagtcgccatggccgacacctctccactccaccggatcatcggcgccgccatgtgggacgccgagcccctgctcggccgcctcgtaatcctcgcccacgccgccttcctcgacgcgggtttcgtgtccaccggcgccgccaatgacgacggcgcccaaagctccgtccgacttccgaggcaggtgggcgcgacggcctccgcgctctcgctccggtacaccgcgccgcagctgctgcaccggcaccggcaagacgccgccgcggcggcggcggcgacggttgcgctgagggtgtgcgcgcacgggcggcgccacgtcgtgttctacgtgtgcgtcaggttcgccaacccgtggctggacacgtactggatctgcctcgacgcgcccgccgccgcggcgctcctcgccggcgggctggacgacacggcgcgcgcgctggcgaggcgcgagcgcggcgcgcgcctcgccgcgctctggagcgcgctcgccgacaggctgtgccggcgcgtcctcgtcgacctgtgcgccaagaacggcgtgccggtggagcccgagcacgagctcatgtcgctccccgacgacgtcaaggtcgccatcctcgccaggctcgccgccggcgaggacctcgcgagggtggagtgcacgtgcgtcgggcttaacctcctcgtcgcggagcacgactccacgctctggaagcccatgtacacgaagctgcgttcccagctgcggcggcggctgcggtttctcggagtcagctatggcgagccgacggcggtgagctggaaggctaggtacgtggcggtgaggcggcggcgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcatactatcaaaaatatattcaatatattcaatgtttatatttaatgaaactaatttaatttaatgttatacgagttactatatttctccataaacttgcttatataagtttatcttagaaaaaatcaaaacgatttatgaagtatgtattataagtagattaaaaatcaatgtttaaaataatagactatgataaaacggttttaaaattaatattttggctatggccgataaggcagtgagctgtgagcagatgatcatgttggtctttttcttctctttttcgatgacttcaaccagatgtgtctaaccatgcatcgaaaagcttacgacgataaattcaagatgatgcagctcgcaatctgattcgatccattactatttttttcaaaaaaaatatttgacgaaacaacctaagcaatttgttcttacatggcattctccagattgctttgacattatggctgtcatattaaatctccataccggtcgaaacttagtggtcacacgtcaatcgactatatcttcctctgtctagttcgtgatgcctatctaatactacctatgttttttaatacttcaccgtcccaaaatataaatatttttaaccctgacacggtcatcgagatgctattttgaccaacaatatttataaaagtaagatgttttaaataaaaagagttgcatactatgatagtttgtttaataataaatctagtaaacttcaattttacatgattgattttttttattttttctgctattaatggtcaacgtaaacaatgtttgacttgtcattatgctaaaaatgcttatatttaagacggagggagtatatgatggcattgattttttaacaaacatttatcactcgtcttattcaaaatttttatgtaaatataaaaatatttaagtcatatttaaagaacatttgatgataaatcaagtcatgataaaataaataataattaaatatttttttaataaaataaatggttaaacgtatttttaaaaattaacgatgtcatatattaaaaagctgagggaataccttttttgggaaatcgatcgatggcgtgttgttctagagtgccgaggttttttagttattattgttgttggaggtacaccacgaggtcgttcggccggatctgccgaaaccaacaacttaggcgacgggtttggactggaggcaagcggcgaaggttgaaaagggaaccgtatgggcgaaagccgtggcttggaaatacgcgggctttgtcaggcaaggaccttgtcggcgggccgcatggccgaaggcgataaggcgaaggctttggcacagaggcacgggcttcgccaagtactgaactctgccaagatgaggcccagcgggctgttacgctctcagggggtttcgtcaaatacataggccgagcccttttggcccagtagaggcccatgcatgcaaaggacaatgtgtacccctgataatgtctctatcataagggtagccatgtaaattcccctgtaaaacctaaaccccaaaggaggaacttgtaatagagctataaatagccccctaaagctatgtaataggggcaaccaaaaagtttttactaagcaatacaattatctttcttttccaatcactgttgagagaatcacgcctttcgacgtgacacggttgtctattcgacaacaattgttaactatgtgatccaaggtcatatattatactgacaatgacagacttaattaaacatatattacgtgtgggatggattagaggaaccgaccattgcttttatttaattagttaaccatcttcgttggagacaagagattcacatttcaccctcacaatatgctgttgtcttttccttttagtaaaccacgcgattgttatatacttgacttcatctaaaatggaggaattttagagttcgaaatttgttgctggttttcgcctatttataggcgtattaggagcatatgcgcagagatgtgaatgttgtgttccgtgtgttctgtgtagtgatgtgtgtgcgtgtgtacttgtgtctgccatataatggaaaaaatagaggaattttaaaagattgaactacataatataaaaaaaaaatcccgcataatgtttttgagcattaattgatcacaaattaattatctcaggtattagattcattgcaacaactcaggatagccctcagcacctcaccgtctcaccctcgtccccaatgtttgccatcttaaaaaaaataaataaataaaagtggactagaggcaaaccgtgtcatgcataaataaattcatctcgaatttgttttttaagaaaaggccaaagacccgcttttatagaaagccatgaccgcatgagctgggaacaccggcttgctatgtaagttcggtacatatgacatccacacaccgcaggccacattccagacagtacaaccgaaagagttacaagacagaagcgaaaccggaccagcaactctaagaactccaacaaaaggaccttacagactaagaacatgaggccagaccacgtaagatcaaatcacaagaactaaaccaaccagagggggtgaatggttggtataccaaaaaccgaaaacttttagcggaaataaaagttactctcaaattcgacggatcgcggtctgaccgaaggtattgcgccagtttgaccgcctgatgaacgtcggtctgaccgatgtagatcgatcggtcgaaccgccgaagtcgcctgccgccgccggtctgaccgccgcgatgctgccggtctgaccgccggtgtgtcgccggttagaccgtcgaaacccggtgaaacacaaatcgaagaacttttaaagtagatgataattttattgattctctctgtgtttacaaagtgcatcaatagcagtccttacaaaaatttcgactaaactcgaaaccctaactcaaaactcaactcaattgctctcaaaagcaataccggaaagcctcacgctccccctctatttatacccgaggtaggcagcctaaagccacgaaccaaactcatactagaagtcctaaacaccttaggaaaccctttagtacaagaaacaaactttacataaccaatcataccaaatttggactccttccaaattcgactccggcatcccatacgcacacaatacctccatcgtatgccatatggaatcttcacaaaccatgtgcatcaactctagcctaagtatcccgcatgatctctgaccacctcggatgtcgtcttatccctaagccgactcccggtccatcatcgcaaatactctcccgaggcatcgagtcacctacacataaaataaacaaagaaaccatattccgagaccaagctatctccaacttgactcattagtagcaaacaacagtattacatatgtatagtatccatccagaagccataatcatgaaacaatcacggatatccaaacaaacaacccgaaactaaaactgacacaacgtcggccggtcagaccgcgggctgcgccggtctgaccacgcatatacctccggtctgaccggcataccctacccggtttgaccggtcccgacaaacagcagtccctgtcaatcacctgtaaattccaatcatctataaaaccacttcgcaaataaattccaaataacaaaaccaataatctccgatgccaattgttcatcacagaataataatcaaaaacacctttaattttacaatctccctcttgatgaacacattggcaaacccatcaaaatgttttggtgtttggaaaaataaaaacaaaagtggtaaaaagcacacttcgtacaaatgttacacatcgtgctcaaaaattcaaaagaaaacttctctctcttttgaaaaaaaagaaatttcccaatcgacaagctcttctcaaatcatttgtttctccaaaaatttcacattacttctcccccttttgacaatgatttcatcaagcatagaaattatgttcattaatgtataagagcttatcatacatatagcatatcatatcatgtgttgcaataaaaagaagatgaacccatctataatatagcaaacatgcattaaagtataaacatgaaccaaagattttacaattaagcttgaatcaacaatcaaaattcatgatttcatacgatttataatacaacatctttacaagcacataggttgaagaataaacactaaacgcatatacctaatgcatttatcattctttctcaaataacctttggcacaaaacaaccaagagaatttttttttaactttttcttttcttgagcctttttgctcatatttttctcttttattccaggtacgtccctgtcgtcaagactatttccagggattcgacacccattattttgctcacatcgaatacgtcagtgtcgtcaagactgtttccaaggattcggtattctttttttatatttttattctctttttcacaatgagcaattaaagctatttgaggaataacaattcaataaagcatatatgtagagcatttataaaacaaaccatatgctcgcatcaacattgcacatttgctttattcaagtatagaatttaagtgtcatgcatcatctcccttaaaaacaaaatctaaatatcatgaaaagactagaatacatataagctatgctagagacaaataaaccttcaaggtattgctagaatgcacaagaaaatactatatgtatagaacaaagctctcttttctcaatttttctcattgtcatatttttgcttgataaaaccatgaggtacaaactccccctcaaaccatgccaaaaggatgaattattcccaattcaccacgaagaaaagcaaaatgattagaatccaaaggtttgttgaaaatatcagcaagttgcaacattttgtccaaaaactgcaattcgacatctcccttctcaacatgatccctcaaaaagtgaaaacaaatattaatgtgctttgtgcgtgagtgttgaacaggattcttagcaatgttaatagcactagtattatcacaaaagagaggtactttctcaaaagtaagactataatatttcaaagtagataaaagccaaagaatctgtgaacaacagctagcagcagcaacatattcagattcagaagttgattgagcaacactagattgtttcctagaagaccatgcaatcaatgatgtaccaagaaaatgacatattccactagtacttttcctatcaattctacaacccccaaaatcagtatcggaatatccacttaagcatatagaagatgaagtagaataccaaattccaaactcaagtgtatgattcaaatacctcattattcgcttgatcgcttgacgatgtgaagcacgaggagaagctggaaagcgtgtatacaaacacatagcaagttgtatgtctagcctagaagcaattagatacaacaaagatccaatcatacttctatactccttttgatcaacagcttcaccatcttcatcaggatccaacacagctgtaaaaccaattggtgttgaaattggcttgcaattttccatcttgaaccgtctcaaaagatccttcgtatacttcatttgatgcacaaaagtaccttgaggtgtttgcttaatttgcaatcccaaaaagtacgataactcacccatcatgctcatctcaaattccctgcgcatagtctcagcaaactccacaaccaaggcgtgagttgaacaaccaaaaatgatatcatccacataaatctgaacaaaaagttgattatcaccatgcttaagaacaaaaagcgttttgtcaacctttcccattgaaaaacctttcgcaagcaaaaagttcttaaacctatcataccatgccctaggagcttgtttcaaaccatacaaagctttagacaatttaaaaacatggttaggaaactcaggattttcaaaacctggtggttgtttgacataaacttcctcctgtataaaaccattaagaaaatcacttttcacatccatttgatacaatttaaaaccttttgaaatagcaaaagccaacaaaagtctaattgcctcaactctagcaacatgagcaaaagtttcatcaaaatccaaaccctccacttgggtaaaaccttgagcaacaagtctagttttatttctcacaatcaaaccatcctcattttgtttatttttgaaaacccacttggttccaaaaatattatgttcagaaggtggttcaacaaaagtccaaactttgtttctctcaaaattttcaagttcttcatgcatggcattaatccacgattaatca

SEQ ID NO: 13001 - DNA, 825 bp, Oryza sativa
atatcgggtctagtacctggactagcctcatcaaaagaaacttcgcaagtctcaatgattttgttagtctccaaaataagtacacgatagccacgactatgtgcggggtaaccaagaaacaatccatcggtagaacgtgcctcaaacttatccaaatttccagatttcaagacaaagcacttgcaactcaaaacacgcaaatgtgaaactttaggttgacgtccaaatcgaagttcataagaagtttttccaagttttgatctcaagaaaactcgatttgaaatataacacgcagtattaatcgcctcagcccaaaattttttaggagttttatattcatccaacatcattctagccatctcaaccaaaacacgatatttcctttcaacaacaccgttttgttgcggtacacgaggagaagaaaattcatgttcaagaccttttttgttgcaaaattgttcaaaagaagcatttttaaacttaccaccattatcacttcgaattcttttcaaagaaccaggaaattcaagatccaatcgaagaaacaaaccacgaaagtgttgaaaagcttcgtccttagttgccataaagaaaagccaagaatatcaagaaaaatcgtcaacaataaccaacacataccactttcctccaacagattgcactctagctggaccaacagtgtccatatgtaatagctgtcccggtgcatccgtcatcacagaaacaataggagcatgtgaacaagcaaccatcttagcatgacgacacggtgtgcaaaccaaatcaatatttttcttaagtttaggcaaaccacgaacaagatcc

SEQ ID NO: 13002 - DNA, 26058 bp, Oryza sativa
gtagaagcatcaccaaagataatcgattcagtcttggatgcctttttgagggaggagaaccaatttttatcaccggtcatgtgccgcgaataaccggaatccacgatccacacgttctccttccttgccaccaaagcctacacacaagcataagtcgaagcctcagtactggggttagatgataataaaaatttaggaatccagtactgagacacacgaccagaagatccaataggcatatatccacgtgtaaaaatagtttgagaattttcagaaaaattcctctgaggccggtctgaccgaggtgttactgccggtctgaccgggggccggtctgatcgccgctgcaccgccggtctgaccggtgttcggtctgaccgaggcactgcagccggtctgaccggtcgccggtccgaccatgggacccactgcggtctaaccggttccctcgaggaaaaatcagatttttgccactttgattttgcaaaagcaatctctctctcgtttttctgtttatgagttaatctgaaacaaaaaccaacaatatgtccatctttaccataaaaagaacaagtatatttttcacgatgattagacacattggtagaattagaagacttagcaacacaaccaacaacaggagatttgtgcactcaattgttccacaaagttgaatatataaacgtacgaacaaggcagatgaagaggaagatataaggcccatttggtagccagcttctgagaatatggaaaagctaggtttcccagcttctggcttctagtttattttttggattctacaactacagcttctcagaatttggaccaaaagctggactgtttagagaagcttctgattctgaaagaagctgcagcagatagatgctcccccagtcgattgacgtgtgatcaccaattcaccatgttaccactgttagggaatccacaatgtggtgtaaaagtagtccataagcaatagaatattccattcagctacctattactattgtgcaactagtccatatagaaaaaatagcaaaagatacccatatgcatatggactacccatatggaataaattatattatctatctctactcctctcttctcctaatgataccttgtaggacattgccatagggataaactatttatgtgggtcccatctatatggatcactttgccatatacatcggtgatgcccttatacatattgagatttaattaatatggaaactgtaaggtcaaagcaagttggagaacgccagctggtaagagcaaaattgtttatgcgcgccctttcgtctaataattcaggaaaaacagtatggaatcagattgcgtgttgcatcatcttcaatttttcgttataagattttccatgcatgtggttagaaatatctggctgaagttataaaaaaagaaaatctaaagtgtaaaaaaagaaaatctaattagcatagtttaattactagagtctgtcaccatcctactgaattatattataaacgattactcatactctcaacgtctgtccattaacttatcaaccataggcaaaatataaattttaaaatttaactttagagtttattttaaagttgttttatcgtagtccattttcaagcattgacttttaaaccgctaataacacatatataaaagtttgtaggaattgtattcaaggtaaaaaaaaatttggtaggtgtgtgcattttaatgcaagaacttgaaaactgagcaaattggtacacctacttggttagatagtgtgcttttggtcaaagtgaatgccacatggatgttttttccaggttagcaagaaacgttatttttgttacatgtttctgctgcatccttggaacaatagatagactgaaggcccatttcagcaaatatatatcaaatcagaagcactacaagtctagatttagaattgatacaggacaccgtgatttattgatcaatttatgaaccaattcactgtaaaaaggcaaataggtgtcgccactataggtgccggcacagctaaaaacgacacctataatgcctttcctgcccatgcacccacccccacgcgccaaatattcaaaaccggcacctttatgtcgaaataggtgccggtttttaaataaaactgatacctaaaacctgtgtcagagaaagctgacggttttaaacccaccggcaccttttaatcttccccctcccacactagctgttggtgggccccacacgtaggttcggttttaagactagggtgttggttctcgtcataaagccgacacctttattccaatagtgcttttcatgcccgatggtaggccctacaaaaaggtgccctttttttgtatgacaagataaaggtgccggtttttggtctagaaccggcacctttgttccaatagtgcttttcatgcctggtggtgggcccaacaaaaaggtgccggttttttgtacgacaagacaaaggtgtcggtttttgtctagaaccggcacctttgttccaatagtgcttttcatgcccgatggtgggccctacacatatgtgctggtttttttgtatgacaagacaaaggtgccgatttttggtctagaactgacacctatgttccaaagtgcttgtagtagccattggtgagccctacacataggtgccggttgggaagacaaaggtgttggttttgggtctagaaccggcacctttgttctgacaatagtacatatatatatataatccatcccttgccactcgaactgattgagcaagaagagagtggcgcctctcgttcttgccccgagcagctagaggagggcaggaggttttactccattttttttgtggtgtttggttaaaggttgaagcctaaatgtaaaaatcaattatttctcgctccgtttaactcttggttgttgatttgaattgccatgtgctatatgcatgcatgtaaaatacactatgggtgttgtttttagggataattctttttatctttttttgtgtctattgttgcatgaaatgctaaatttgcgttaatgttttcttccatccttcgtcacggccgttagtcaaattaatgctagtcaaactatgttaaggccatggaaatgtccattgatagcttgatttatctcaaatttatgttacgggtgcccatcgatccactagaggagatggaaatggttttgctcgatttttcttgggttttggttgaagattgaagcctacaaagtaaatattcattatttctcacccagattcacacctgctcgttgaattgaattgccgtgtggtaatacatgtaaaatgcactagtcatttgtatggatccatcagtcatttgtagatatgttcttagatgtcatgctaaattttaattaatgttttattccatctacgccatcgtcgttaatgtttcacattagccaaatattttttttgcattgacgaaaaatagaattttttttatcttttcattagccatgaatatctaattaaggtgatgtgggcgtgcgcaaaaatctcaattttatcgtagggtaaaatgggcattactctttgtttttattctaatgtgcttgtacattatgaaatcctcattgtttttttccttcacgattggtaataaacgataattattgcaggtacccattggatataatggatctagaatggataactatagcggatcgtgactctgtggagtatttcaggggagtaacggctcttgttgatgcaccggaatatatttggtgtccatgccatgaatgcaagaaagacagacaacttccggctcacgggtaaattcacatctccttacaatgggttttagggacaacttccttggcgaggaggtgcacgtgaggaaagtgccggcaactgtcacgggcatgatgcggatgttggctgcgaggaggataaccaaacatgtgtcgatcacggtgaacctaatctagatcagatgctacacgacggggagagatttgacactgatgatagggaatatcgcaagttcacaaccatggtgaaggactccaaaactccagtttacaatggatgtaaggtggagcacaataagcttcaagtggtcctattgctgcttcacctaaaggcgagcaacggatggtccgataagagcttcactgagttgctagagctcttgaaagaaattctcctatggacaacatctagccagaatcgacatacaagccaaaaaagttatatgtcccctttggtcttgacatacagaaaattcatgcttgtctaattgattgcattctttaccggtatgcaaggcttctagctataagtggggagacggggatgatgagggtggaaataagaaaagagtgccggtgaaggtcgttcggtattttccaatcatctcctgtttggaacgtatgtatgcaaacaaaaagcatgccaagctgatgcgttggcaccacaaagagtgtaaaaaagatggaatgatacgacatccagctgatgggtctcagtgaagaaagatagacaagaagtaccaaagttttctcacgacatcagaaatgtgaggattgcactaagcactgatggcatgaacccatcttgtaacatgagcagtcgtcatagcacatggccagtggttgttattatctacaacctcccttctgggctctgtttgaagcataagtacatcatgatgctacttctgattcaagggcctaaacaacctggcaacgatatcgatgtgtacttcaagccgctggtagaggatcttcatacactatggacggaaggcgtgcagatgtgggatacgtacaaacaagaacacttcacatgtcgggctattttgttagggacaataacagactacccagcacttggaaacacgtcgggccaaatggtgaagggcatgaaagcatgtgtatggtgcatggcccaaacaggaggcaagtgactgaatcatagtcggaaaaccgtgtacatgcgtcatgggaggttcctcaggcgggatcacccacaccaccaaaataaaaaagcttttgatgggacggtggaaatagatggacgtccaatttttagaaccggaagtgagatcttggcggaggtgaagatccacatcgagcggtgagacccctctattcaaaaagaagtctatcttttgggacttgccgtattggaaagacttggatattcgtcatgcgatcaatgtgatgcacgtggagaagaacgtgtgtgaaggcgtgctcggggtattgttgaacacacctggcaagatgaaggacactttgcaagcacggaaagatcttggaagacatggacatcaggaaagagctgcatcctcaagacagaggaaatggctgctactacctacctccggcatgctacactcttagtgctacagaaaaaacgagtatgtgggaatgcctgcggggtgtaaaagtcccatccggttactgtgcgaacattaagagacttgttagcatgaaagataagaggttggttggaatgttcttaagcttcacatgactgccatgttcttatgtcgcagctgctaccggtcgcaattagaggtatccttctagaaaagatccgagacccaatcatcaagttatgccagtttttcaaagcgataaaccaaaaggttatcgatccggcttcattgggcatgcttcaggaggacacgattctcaatctttgtcagctagatatgttgttccctctctctttcttcgatatcatggtgcatctgattgttcatcttgtggaacaagtaaagatcttaggtacagcatatctggatagcatgtgggctttcgagaggtttatgggtatcataaagaaatatgtcaggaacagatcgatacccgaaggcagcatcatcgagggttatgcaacagaggaggtggtcgaattctgtatagattacatggatctacaacctatcggtgttcccgtgccccgtcacgagggcaggatgcttggaaagggaatattaggtcataggagaattgtcgcccccaatcgacaaaccataagacatgcccattttgcagtgttacgacaatcagctttggtggctccgtacatggacatgcacttggatgttctccgtagagacaatcccaggaaaggcgcagcatggctcgcgaagatgcataaacttcaatttgggaaatggttgatggagtacctaacaactgcagacatcgatggtgcccatttttctttatctcggtggccatccaacacaatccacatgtaccagggctatgatatgaatgggtataccttttataccaagtcccaggacaacaagagtataaatcaaaacagtggtgtgcgcatcgacgcctacgatgatggtggcaacaagcagacttaatacggtttcatagagtcaatatgggagttagattacggagccctcaaagtccctctattccaatgcaagtgggtcaaaattccaagggggttgaagattgacaagcatggaacgatcatcgttgacctcaatgatgttggctacgaagatgaaccattcgtgctcgcaaaatccgttaagcagatattctatgtcaaggacccatcactcatgaagccacatcatgttgtactcgaagacaagcaaagtattgtcggaatggagatatcatcgacgaagatgactacgatcaacccgatgagccaccgacacccacaactgatgtcgagactgaaaacgaggcaagcgctaaagagaatgaccaaggcttgtatgtatgatccgatcatgcgaaagggatagtagttagggtgtgaattaatttctaacttcattgtatggatttgtatggcaacttcattgtacggatttgtatggcaactgtttgatttaaatcaacaaaatttggaaatatattatgtgcactctaatatttaatttctattttggtcctttatactcttttttggaacatattaagtaataggcctattttctagtgaaacataaatttatgaaagaaattataatttataattaatacatataaagttacatttatataacatgcttatctctactattataaaaattagaacctattatagtcaaaggttccggatttagtgttagaaccaacacctatctcctttacttaaataccctcacttatccctttactctctcacccttatccattcactctctccttctcaccctcggcggtggcagtggcgggggctgtggcggcgaacctcaccctcggcggcgcggcgccctccaggtacggcggcgaggaggcagtgggtgtggtgcggcggtgtgtggcggcggcaatacagtggcgaggagggctcgacggagcgcggcggtgcggcggctcgacgcggcgatgaggagggctgaacggcgtgcggcagcgaggaggaggtgagcggcggcggtggcatatccatcccaacggtacctgcatcctcctccttctcttcttcttcttcctcgtcgttgtcttgccgcaaccacgcctccacgccctcctcttgctgctactgctactcctgttgtcgtcgttgtcttgtcgtttcttgcggttgttgggggaggggatgcgagggaagggagggggcggacgctagaggagaggagaaaggcgacgaggaggaagaggagggttcttgcggtggagatgaccggcgagaggaggccagcagcggtgggtgccctggaaaaggatatataagggagagcggacggtgtattggtatgagaaggaaggatatggagagattgcagcgggggaggcggctgacggcgaggagtggctaggaggaggaggtcgcgctggcggtggcggtagatgaagcagagagagaaaaggaggggaacttgaagtacctggaggtgtggcgctgcaagttcagcgataagctcttcatgctgtaaccgccgctagccagcgtctcgctgccagtgacccacgtaggatggcgcggcggcggaggcggcggcggcgccagccatggcatgcatgcatgtcgatcagtagcatagttttgacttttgaaaggggtatagtagtgtaaaagaggggtagaaagtaattaattaaagttaatggttattttgtgatgattataactatttaattaatcaactaggtcgatcttaatcttaagatggtgtactgagttgatgatgctggtaatgtctgtaaatgtggaatttaagatctggattttaccgtgtatgttcttcttttgatttatctgctttccctttttcgactagttcttttgcttaggtaaattttcattttgcattcttcagttgtagcggttgactaatggctgagatgcgactttatttcattttcatcagattttacatggtttcttaataaaaaaattgcttgacgaaactcagctctactccaaagaaatatgcaaaattttcacatgatttatggtcggatcgagtattcaagttcagcttatttgtataatgttcttgcagcggcagcagtgaagaggggcagcggtgtgcggcggcaaggcggaggtggaggcagcaacgatggcccaatgccgaggtacacccctcctccccccatccatcctcttcttcttcttccctcctccacttaggaaaatttgctcatgtgtgtgatggatttgtcccttactgtcatgggtgacggatgtgtgaatgtgtgtgatggatttgtgaaatatgttttgttaatggagtagtatagatttaagcttcacataaatatatttgtaaaatgccattgtatcattgataataatgctctattggtaatcacagtaaagtatccacattgtgcttgtcatcataattcgtcactagcatgctaggatatatagaaaaatggcaagtctagcatggtaaaccaagtggcatctgtggacggctattaagtacaaaattctcgctgtcaatacctgcataaaaccataaaagtaaaacatccaatatagtggtaggatttatttctaaccatttccacgagtgttagtgtatatttgtatgcaggatgcaacccaccaaagttgagatgaaatgtacatgaaggatgagaatataacttccatatccaagccatagagttttgagcccacaaacccaataagatacatttatcttgagccaaacttcagtagaacatatagtgggacccacatgtcagaacaccagagaaggagctaggctggatgggccagccagggttcggctgaaccagcagctagcccaaccagcacaatattttaccaactgatagttatcctcatcctatgacggttaggagcgttaatactggtggaaaccgtcatcaagaggacacatggcaaaaggagaagttaagaagatgctcttaggattctatgttgaatatttcacagtatctccactctctcaactcacctccacactataaatacccctgtcctctccctcattcacacacacttgaagcatgagctgaattacaagaggctctagtgtactttattgtatattagaatagagagagagtaatgtagaagaagttgtcgatgcaaattaattctcttcttaccttttttatcttgttaattactctgcattaattgaatatcattataagtaattaaaatttactctgtgagaattatctcttggttagttcctaattagcgtgcgggatcatcgttcactatagtctattataatatagattactttagtgagttataaacactacagtagctattaattgcttagatgcggtgtctaagtagttgatttatggtgtttgctccgtatcccacagtaggtgtaaggtgggtgtagaggtgggtgtaagtcctccctgtccgggtacgtaatagagcgatatctgggagcagcaagctggccagtgcccgaagtatcgcgttaggattaagttaagctttccgtagacattgtttctcaccggtgaatcctctctatcctttgcctatcattagcttcgtgtccttggacaaacctggtaaagagctgacacacacgttccctgtggaaatcaatacctgagaatactcctggctgaagtgctacatcagtattttccgtgcgcttgcggattttatttgtaaagttaagaaataccaacagcatccaagataaatggtaaatgcaactgttagcactatcctgatcctaatttcttatatactttaatcgaaaataaaatttctgaacacccataacttgctgcactggacctaggcttcaagatcacctctacagggtatttatgttgctcattaagtaactaattatatatttttagtgtctaataacaccgaaccagctgtttggattacccagttgtataaaccatgattacccatacatgtgaacattttacaactatagaatatggaagttgtatgaggatgtaattatgtgtgtgaatgtatgatggatttgtgcatgtgtgtgatggatttgtcccttactgtcatgggtgatggatttagacatgccacaatgtgttggaaaatctgcagtatggcactaagacacattggcacatatatggcacactaagaccaaatatgtgcttgttgcacttgttactccatttccaatgtctaaggacatttcagtcatgttactgtatattttgtgctgctactgctgctgctgctaaaatatattttgtgttgctgctgctgctgatatatttggtactttcctatatcagtttatttccacaatccatcattgggttgaaatgtacttttctactttcctgctgctgttgatatatttatgcattgcccatgtgaatataacttgttgctcgatgatgaaattcatatggtgggagattatgtgtggaagtatttcatttatttgtgtgatttgtgaattgtgctgggttagggtataaaaccggcacctatctcctactacttaattactcggcctgccacctacccactggccacttcaccctctctctcttatccacacactctccctcactctcttttggtcactatttttgaattgccctttattctcgtctctgtttatactgccacacataatcgatgacgacctagtacaccatggcatggaggccattaagttggcaacctgccatctgagagcaaatatgttcctgttttgtgcttgtaacagttctgagagcacaaaatatcttacacctttagaccatgttatttttcaacattagtaatgttattatgcttgatgatgactagacggaacacaaagaatttgccagctccagatctgagggtgaacatcatgccagccctagcacgttcttaaacttaaatcaagagcattccgaaggcggagaggtgatttcgacgtatatttcacgcaatagtgcattagcaaattccgactctaatggaccattcgaactaatcaaatttgcaatttccaaggaggttgacacttccactggcagttcaggccagaattcaactgtctcatctagcctaggggtcctagcttgatgccggatggtcactacgttgtgacagtgctcatgaaactgggtggccacacgtaccatcgacggtgatgaccccctatggtagggcgtgtggatgtatcgtcaaggatttcattcccatcaagtacagacattggaatgaaatgatgtaacacaactcgactggatggtacctgaaggaagaatgctggcgaaagttgaagttgtcattcacctttccagaaggccaagaagagctagcaaagaagggagccctatcaaagatgggcacattatttagagagtggtggactgacttgaacgtggacttcgtccaatgcaaccgaaccccggattttgagaaacccatgtatcaaaagttggcagattattgggatgagtttgtgagctagaaaacatctgaggaggcaagagaagtgagcgccctaaacaaggacaacttcatgttgaacacgtatccacaccgacttggcccgagcggatatgctaagaatatccccaaatgggaagagaaggtggaacaactacatcaagcaggtatagttctcgagacagatgcatgggggacccggacaaagcactacatgtacgccaggaaggctcaactatcggatcaggagagttggttgctctgggacctcatcagcaagagctaaaagaaaagatcactgaggccatttccctggcaagacagggtaaatttgtgccagtaagagagaaagatgagatcacagtggcactggggacgaaagagcaccctggacgcatgagaggcgttggttccgttccatggaaggaagggttcccggatgatacacacatgtatcgggcccgttcaagaagacccacgagagaagaggaggccggacgtatgagattagaggtggcctatcaggtaaaggcacaacatgcagtgttgtttcccgatggggtactaggacgacaggggcaagttggtgaccaactggttagcccgggtgggaaacggagcagttgcgcatccgcggataatccccctccagaacagcacaccacgcattacgttgtttttttaggggaacacatgttacgttgtggacgacataacaacacatactccgtgcgtgctccatgtccctcttcagagcaacattactcaggagattgcacgcaatgtggcacatccaatatgtgcagggcaaacaatacacggtgttccattgcctgcagaccactcaagggttgaagtggaagacgtgccaagccagtatagatgttatgtgctacaatttcctctagaggaaggggttgacactctgagcgctgctcttcacaacctgatcgtatggcccaaacgctacatcgttatcacaaacgatggggcaggggatccaagcgccgatgattccagcctttcaaacggacgaggtcattcttcgcctcgacagaggtcccctagtctacctcctcgtcagaagaccccaaatcaaccacaaccttcgcagaagtctccgagtacaggcccaattaggaaaaagaccccaacaccaagtgcgtcgcaaatgtctggttcatcaagcatggagcgactcccacattccaagtcgaaattagtgccaaatccgacaacttcgctaccgaaaaaggtgagcggtagcatcacttcgcttcttggccccaagaagcctgaggaacgaaagattccaattcctaagaaagtgatcgagcatttcatcaaatgcgcacagccaaggctacctccaaaacctatatcggacttccgtagaacacttgagaaaagtgaaatgcagtctcgatctagggagttgttccttgacaagaaagcgtctgatgaggctgctttctgtaagtcagtcgatttgaaaagcctagacgatattgataaccttgacaaggctgaggtggtactcagttccaacatggatgacccatggtgctcgactcagaaattgaatggttaggaactcaagcgcattggctgcatcaatggtatttggaggaggccgcaaagggtcatgaaatgatcggtgcctactacaccgacattgattttcaccatgaccccaatatatgttatgtataatttaaggagctcttcaacttgtaccataaaaaggaactcgatatcagcctcctccaaatgtggtcattgtgagtcctttgatatcttctccttaatctggcaccttggacgtactctaagtagttttcaactattttctccttttgcaggcgctgctcttatcaatgtagaagtcttgaccgtaagattgcatttctagatccagcggttgtgaacttcaacaatcagttgtccaaagaaaaagaaattgacgactatctcttcaatgccctcgttaagcaaaatggttatgaccatattctcctgccttacctatctcagtaagtcactatcatcgatttctagttccatttgctctccacgcgtatcatattattgatacattgtcctatgtgcagccatcattggatcctcttcgtaatcaatatcgacgacagtaagatttgtgtatatgatagcttgaggaaagggacagacaattaccaaactattatgaatgcactaaatagggcatatgtgaagtaccgtaggtccaaaagaacgtatgggagatgtgcgatcgatgcaacatcattccggatctttgaaaatcaatatatttatagacaaccagcgcttaccaacctctgcgggatgtacgtcatgtggtacatgctatgttttgtagagtctgggcaccttcttccccgtaatgctgaggtatgacatgtttcagggacttacgtaataaattagactattctattgaagtacgaaagtaaatttctatgccttccacccttgtgttgcagaagttgggtcttgaaacaagcgaaatgctgccacacgtcttcacagctctcaccgactagttttgcgggcctgtccatactcatgtcatagatccaaatggcacttacaatgtcaacaagctcccacaacaaagtgcaatcctctgctcctacccctcaggaccaaaaagtgaagaaatcaactactaagaagagaaaaaccaggtaggtagatttgtgtgaaaaattgtagttacttagtgcttatgcatgaattatggatgtgacacgtcctagtacaatgaatctggacagaccgtgtgtccagattcattatactaggatttgttacatccacccaaaatcccttatgttatgggacagagggagtatgtacaaatgttttggatttggacttacaatatatatgtaaatgtttagagcatctgagatgttgtagagctctagcgatttagtcaagtttcctgggatgtgtaacacatctggtcgccaccttcgtgtggtttgatgagcacatctcaggctgaagttgactggcacgctgagtcccaacaatatctcatttgctctttactcgaggatatgaatgtgaattatatgcaaatgtctagaatttacacttataattttctggacttacgaattttagacttgtgaatttctgacctaaggatatatgtgcaaatgttcataatttagacttaggaatttttggacttaaaaattttaaactaggaatattttgagttaggatatatatgcaaatgtttaagatttaaagataggaacttttggacctacggatttttagacttggcaaattttaacttaggcttgtaggtttttatttgttgtgatgaatgtgaaagtgaatgaatgtgctgtatggatctggggctgtagggatggatttgggtttgtatggaattggggttgtatggatgaatttactgcaatatttttattacccaacaaataggtgccggattttaggtttgaaccggcacctattaggaccatataggtgccggttttaacctaaaaaccgacacctattaagaccatataggtgccggttaagacctattagcggcactattacctaatatgtgctggttctaaaaccaacactgatggcaagtattatcagtgctcctttgtgccggttgggaaaaccggcacctattatggttttcaaaccggcaccttttacccttcctgtagtagtgtcctaattatacagtcaattgaacaatgcagctagatggtgtctaagaaaagcagcgtgatgtatgttcacaagctttacagtcgaccaaaagcaatagatcaacctgggagtcacgagttcctgataaattgaaggaagccgacattaaatatacatcatgcgggacagatagaacataaaaggtgtagatagtttgtttcaaatttattagaatgcgagagaagcgatcttgtgcacctgatgtgcaatcaacaacaatgtcctatgctgatgtgacaaaagaataataatgtggtatcactttgcctaaagtgcaccatatagctaagctaatacacttatatatatatgctcaaattttaagttcctgtactagaacgcaaccactcgacactaagtgcaatttattccaaacgaaaacacatccatagagtaataaaactgtaacggcgaaagcaaaagtacgttgttggcggtcaccggtgcttccatcggaaccgggaagacaacgagtgaaccgcgctggcgccattccgtggcttcttgtcgccgccatgtcccacagccgcatagccatggccggcgtcccttggcattgttctccaccttcgacgacggcgacggtgagggccagtagtgatctttatatatgtcttcttcttcctccagtccgagccaagcttcaaaattcttcagaggggaggtcttgccaaattttattgtgaatttattttggtgatcatatacaaattggaggtgtctaaaaggttagcaacttcatcctccaatattttttttgttgtcatattacatttgaagctatgtttggtacacattattgtctctaaaactttgttggaagttgatgagagagaaaatttgtgtagggaagaagaatgtatagaaattttgtttatttacaatttataaaaagtttttataaaatagttgagaatgaaaatatattgaaaattaatctaaaataatagaaaacaaactaaattgaaaattaaaagaagtacaacacattaaatattagtttaaaaacttcaaaaataattacaaaaagaataatttgtgggattattttataattattgtatgtataatgatatgtcattattgtatgactgtttagtgggtttcactttcgttgaatatttttacggtttttttgcatttcatgtagatggatcggcaatggatgtacgcggactagcagtcgaaagagtttattgatgacgtgcattattttttgagagtggccgatgctaacaagcataagggttatatttgtcgtccatgcaataagtgcaagaaccagaaggagtattatgcacttaggattattcatttccacttgtttgagtcggggttcatgcctagctataattgttggacatcgcacggagagctaggggtttaaatggaagaagatgacgtgtaagacgagaacattcccgactgagtttagtacgctggatttgaaggaaatagaacgggcgatgtggatggggatgttgacgataacgacgctgtggatgatcttggttaaatgttgcaggacgccaaggaggactacgaaagtgaaaaggaggcccataaattggagcgtatgttagaggaccactgaacatcgttggaccaggttgtggataggggcacaaaagttggataccactctggaattctagcaatggaagacaaaaaatggtgttagtgacaagtcatttggtgatttattaaaactcgttaagaacattcttccggaggaaaacaaattgtccgagacaacgtacgaggctaaaaaaatagtctgccctctaggcgccgagcactttcaaaggtgaggttgacggtgagggtcggagaagctacgtggcgaggcattccggtgaacatcgtgtccatgatcagcaacactggaacgccatcgattctcgactcgtgggtgaatccatggctacccgcttttttggataatgatctatctaaggatttgtttgtcccatttcgtctgccgttcaacgactcgccggaggagacggtagtccctcgtcggagatggagagccttgggtttgtttcaaactcttttacatgataaagtttgaaatgttttatcaaatctaattttgaacgtgaaatatgctcgtgtcgtgttcgtgtaaggcagttataataacgtcataatagaaggatgtacatgcaaaatcatcatatgaaactgaaaatggaccctggcccacatgtcggtaacacaagcaggggcaaatcctaaagatacatcctatgtggggataaatttgtttttgtctccttttagaggttgccaatttagcgggactgcataaaaaggccatttattattgatagatctaactaattaaactaatgctggatgtatgtttcttcctggtttccagtataaagaagatgtctgccggcctctaaccagtgattctgattacactctggtacagttttgcaaattttgattgacataaaaatgtaaacagtttaggtttctgattctaattataggcgattctaattctagcagaaatggaaatgaaatccatttcaattaaaaactttttatttgaacagggcaccattgctttgtttgagaaatttgataattcgaccctttatattcgttgccaatttgctttaattgacgctggtggaaatgatatgtgggaccatatgagtgaatgagtaaatcaaccacgtttggcacacacacaatgacacaaactcgttcattactgattgatatagtttggcaaaattttacaaattctccatgctttttcaagtgacgcggcatgaagcaggcaggagatctgctgctgtttttcatagatgaagagaagcacacagaaacactacaatatacaaactgaactgcgcctcatcgatatgtcttgcagtatgagaggctaaaattgttgatgatccagagaaaattttgcaagaaaacaatagaattaatatgcgagcttcttcttattgcgctttcccgttttgccttgtttggattctctgcatgaaaatctattagtccactcttgggctggcgatggtgacgtagctagcgtcacatccttcttgaatgcatcgttgaggaaatccgaggtaatttctagttttgctccgctttgacacctaaggagggccatcgggaattcggagctgctgcgtttgaggcattcgacacgcttggcaacaatgacctgtatccttgcttggtttcgggaggggtttgctgttgtcctcttgggaagtcgaagctgctacgtgtttgcgagctcggcaatgatgactcatgtaagacttcgtcttttgcgttacgctctagtgtggggttttaagcttttcgatctgcacggtttgtcagtctggctcgcccttgtctcaatgagtctagtggtcgtgaagtcggagctgcggtgttgacggggcgcgacgtgtagcaacgatgacatgagcctagttgagttgtgctttggcgtggtttagactgttgccctaaccctggtgtttcctggtgaagtcggagtcgcccaatcggtgttggtgtgatgacgataacaccatggctgtgtcaatgtgtgggggccgtatgtttgtctagcttgtgccttgttagcggctttggttgggtgttgagttctgctgtcctgttctcgttgtcgtggtagcttagattagttggtggtgttgtgtgacagttgcggtttcgtctagttttccttaattaaccgtgcattgtaaggtttggtcctgttttctctttaaaatggggcaccttcttctttatataaaacgtcggcaaaggcctgaccgttcgaaaaaaaaaatgcgagcttctcgcttccagcatgagtacatcatctttgatctcggccagtagaaataactcgtagtgccttggattttgctcatcttgatctgttgaccaaacagtaaccatgcttgatttctgctcttcatttttctgaaactgatactattaccagcagcaggcaggaggtagcagattaccaccagaccaactgcatgaattaccatcaaaagaaagactgactatgcctgtgcttcgcaagaagtaggtgtaaatattcagacaagataaatacacaatactatcacatggatacaggagtacttgttcagacaagattgcaagttcgaatattttctgctgaaatctgagatcctcaagctgcttcaattagtcataacatgaaaaatcccaaacaaactagaaaaaaatatatcagagattcctttcaagaggacatattgattatacttggagccacctattgataaagcaatgcataatcagaaaaccaatttttcagattacacaacaggttggatcagtcaagatgaaaacaatcagttccacaaacatgtaccgtctcctgatttctccaaatttaggtcatcaccgaagtgcgctggctcaccgacagccaggaatagcatatttccaagattttggatcccataatgtcgggcgtttatgctctgtacccaaggaaaaatgaataacacctgtacatcatatccatgaatgatgtcaactttcaccaaactatatacgagattatcataaaactacagatagtcaccattttgttacatgagcatgtatgtaataacaattcagaggcattgcaaaggtatacacatacttatcaatgatcagtcaaaaagccagaaagttcatcgattttagtggaatgacacttcgtgtcatcaaataagcctcattgcaaaagggaaaaggttggagtagagttagtgtactagttttcaatgggcttcctactaattgaaagcaaaccagtccttaacaaagaaacagtggagggaaataatgctcatgcatctgaaaacagaagaagaaaacatttaaccatggctcctgtgtttgttgaaacataaggaaattctgttgacaaccttgtaattgtattattgactataaaacagagggggaggtgattgaaatttttaagtgcatactctgcaacatatggatatgcaatactagtatgtagggaaaaaaaaacaaaaaggaaggaataagcaatggaaaggtacctccataaggacattttgcatgggcatgtgacaaatctctttccttaagaatatccaaccgtggcctaaggcgttcatatagcggcttcatattcatggctgggcaatatcgaatagcaatagttgaaagagatgagtagctctctggaccacatgctaaggatgctagacgtttgcagctcacaagacaaagtctttctaatgatggcaggtctcccaaacaattcagtgactccagtttattgcagcacctaatatccaaaaacttcagggcatgcagctgccctgatagagactgaagcttcggacaagaatgaaattctagtgacgtgagggacggtggtaggttctgaagttctaccattttatcattgaaagagatatgtatcatttctaggcatggcagaggatgattcactgctgatgatgattgctctggtacacttctgtactcaaggtcattgcagtgctccgatgatgtaaatgtgtcatggtgttctacatgtacattctccgactctatatcccccttaccccatatgaactcaaaattgcgacatccagaaacatgaatgtgggtgacagatgggggtagaacgaatagctctctcaagttatcacaacagcaaattgataatgacgttagacatggcaggaactgatctgttgcacaacgagttggctcacctttcaccagcgtggtacggcctattagattaacacaaccaaaaatggccaacatcttcaaggacaccaagcataggaactcttcctccggccagtagatgagcacatcactggacttgatttccaaatacacaagttgtcgaaaccatttccaaatcccaattattggttctgatgggattgtggagaagaaaaagttgcagtgccttaactccatatttgagagagatgattcgtgaatttgatcaagctgcaatatagcttctttgtcaagcacgtccaattttaacttggacaattgggacatgtatctggatttaagcaatggcaatgacagctctgccttgttttcatttagctttaaaaccttcagctttggtgcttcgggtagactagacaactttggacagttactgatttcaacctcctcaagcagaggaaatgttggtttgttttcttgttttccttcagtttccacccaactctcaaacctttccaaatcaattaacttgacttcctttaatgctggaaatatttgtacttttccatctcttgcttcctcgcagcataagctttgcaatttatctagttttatcaaatagagaacttgaagaaacttgaaatgtatgaattgaggaaattcttcacacattgtacagccctctagatggagctccgtcaagttctcaagaacactaagatctgtcatccatgttggaaaattagtgcctttataggaaactaccttaagcatatggagaccatgatgaggtttaagagcatcaagaaccttctcagggtaatctggttcttcagcatggtattcgccactccattcaagagataagtgtgtaagtttctctttccttccaagattggctgcttttgcttgttcttgagatacattttctaggccacgtaactctagttcgccagaaaggtttaagctatgcacttccctaagggtactgcaactagcgctagcacccacaataaaatatgttaatgtctgtaaggaagttaactgtccaaggtctggaggcatgcacttcaattttgagcatccatttgtataaaggtgtcgtaggcttgtcatatacttcatatcttttgggagtctaacaagattatagcaatcagaaaggtttaatgtctgtagattgtacattgtgcttatgtctgcaggaagttcatggatattactgttgtctgagagatttagatatcttagatgttgtaggtgtcttggcctgattggtaattcttcccttcttgggagctctaatgctcttagctgtagagaattgtacttaaataaatgtgatgttgagacattaccataataccctcgaaacaataaagttcggagagctggagcttcatttcccataaagtcatctggaagagcaatgctggtgtatggtatgagaacgtgatataaaggatgttctcgcatcagatttttcaaattagacgaaccaattatactgagacattctttccccataacagattgagaaatgtcatgcataagatcatgtatcttgcacgttgttctgtcacggagctgactcctatacacattctcctcccgctgagaaattttattcacatcttgaaaaaatgacctccaaactagttccttgaaaatattctgggctactgtttccagatggtcttcctcctgcagtggtatgaagtcatgtgccaaccataattggatcaatgtctccacatcaatctcataatcttttgggaatatagcacagaaagcaaagcactgcttcatgtgtgatggcagatcatcatagctcagccgaagtataggaaaaattttatcctccccttcattgcaaatgttgcttttagttaatacatcattccattcttgcatagtagtcctggtacttaacatagaaccaaaggcttttgcacctaaaggcgagccatgacatctgtgcacaatcttacaaagaattccaaaatgttcatcattgtttggcagagttaatgctctcctcaggattatttccttcatgtaaatttctcctagattttcaagattatgcacttcaacttcacccgtgaccataattctagcaacttctgcatctcgagttgttgttagtactgcactacccataccacccttcttaaggcaggtctttagctttccccacttatcataatcccgttcccatacgtcatccaacacaatgagatacttctttccacctacttctttctgcaggtcctgcaaagccttttcacgatctctctctgtgctcatacatatgttgtttgcaatagtgacaacatcaaacacatccgacacacaacaccacctgcggagcgggaaatgcttctcaatttcagggtcattgtaaatgagttgcgcaaaggtagtcttgcccagcccacccattccaacaataggaaggacagtgaggtccgtttattagctttatcaagcaatatcctgataatcttcttcttctcctcatctctagatctgataacaatatccttgtcaaaatcaaccatgatggaatcagttttcctccactgcttgggtgtttcctgctggtgtacgagtccgaaggagttcatctccgagacaagttccttgattttctccacgatctttcgcagtttcttgcccatcctatatcggaagacaataggattacgagaagggaagaggcttacagagtccatgccaagcatagtgtggttgcggtgccctttcttcttggcctcacgccagagcgactcgtacttgaactcgtcgaagacgtcaattgcctcgtaggacaccttcttgagtgatttgagccaagcgcaaactagaccggatcgatgatttttcttctcctccgcatcttggatgacatcgaggatggctggaagcaagcgctccagagtctcacgctggtcctccatgccatccatcaccttgtacatgtctacaagaaagctggaagccttctccagcaccttggagagcagtggcccaaccaaatattcagccatcgttgctctctcaactctcaggagcaggagcacacggcaagaacccaaggcaagggcaacggcggctgttgctgatatgtagttctattggagagtgattaatggggtattaattccaggctgaacaaaggcaaagacaattgcaaagaattgcagtgcgctgcgcactgcatttcagtgttgactgacgcgtcttgctttccactaatttccaagagtcagttttgcttttatctctcattttcacgcacgccgatgttgactgacgcgcgccttagcagagtggtgagtggtgactgaccttgtggagacgcgagggacctggtactctggcagccggccggtgagggcagcaagatttcgctcactcttgcttgcttttgccgaagaggtgttgacaaccgttgcttgcttttgccggccgagacggcgtacgtgttgtcctcgcagccattccgtcgaacaccagccgggcactgactgccatagcaagcccctacctctcctgccaccctgcactggacgctgtaggagcggagcggccggcgtccttgcaagcgaacggcggtgggcaggacagaagaagaaggcggccggaactcttcaaaggctcgccggcggcgtggcgcatggcaggcagacggagagcaaatgagcaattgcgcgccattcggttccctcctgtatattcgtcagaaatgacgatcgatttttgttcgcgattggattcgaaggcccaattggattttgagcgcttcatgggccgtcgcaaaacatgcaagcctggcccaacttggtacagtaatagttaatcatagtttacaacttcaatcgctctgcttttgcttaatttcgtcagaccttgtagataaaataaattattcaatgagatgagcatgtaattttcctatcttgaaaaaaagcatttgcagttcaactaatgaaatccctgaaatgtactgtatcaattcattcggcgatcattttattctcttctctcttttttttcttctatatttgaggtatcatcaagcaagcagatctgctgttttgatacagattaaatcctacagctgatgagctgacagcaatccaaaaaatatttttgtgggtaaaagtttttatatatgtgtccttagagatttaaataagctattatgaaaagaaacctccaaaaattcaattttggcagctgcctaggaacagatcaatgtgcgcaccgaaacacttgcaaaaagcgaccagcggcatgtccatgagcaaacatgttgataatcgagcgaaattcgacagagggacaaacaaatttctgttggacaaaaactcactacgcttcttctgacgacggcaaaattaactaagtgaccgctttgcaaatccctaaggaaaggaactgatccagagaataatcgccctggaacaagccttgtgaattggcaaaacagtatgcaggccaaaagttttaggaggattggaaattttcaagagctttaagattaagatggccttggataaaatggaaagatgaccaaagaccgtggacctcgatggatctacattgcaacaaaacagatatacaccttttccaagcttgcatgcctgcag

SEQ ID NO: 13003 - DNA, 478 bp, Oryza sativa
tatgttcttctagcgcattaatatttcttttccagattatgctaactgtatatatactaatagctctaactcatgtataattcgattgctgctacgatggaatcagtaatacataacttaactcattagtaatccatataagagtttcataacttagcatcaaattctgcaatttctagttgtgtgtttctcctggatttctgcagaagtagtatagcagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggccatggcgacgaccgataagcgcgctctgctggccgccgagaacggccatggcggc

SEQ ID NO: 13004 - DNA, 1321 bp, Oryza sativa
aagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtgtagtgatgctagtgaaggttctgtgaagtcagattcctcatggttccttagctgcaaatccgacaggtgtgtaccaaactcaggttccttttgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccatt

SEQ ID NO: 13005 - DNA, 542 bp, Oryza sativa
gatatagagggttggtagcaatactgggcagaaaagcaagaagaatatccagaactaagaattgacaattcacgaccccatttgttcatgctttgatgcagattgtacaaatcattcaattgttgctgagagcctgagacacttccatcaatagcttcctcaattacatcatactcccttattgatactctttcaagggaaccagatgaactgagcagccttctaaagtttcccaagcggatgtttagtccttattactttaagttcactcttcactaccagccaaccaaattattactccctccattccataatgatcagcgcataacgaaagtggagatattccgatttgatcagcatattaacgctggtagcatgtgcatgttggatggattaactagttatcacggagatcgagtaggccatgcgattttcgagctgcatgcagcatggaacattccttgcctgtgcaatcatgcaccggcagtaacgtcgtttcgtttctccaagccgattaatatggagattaattacaaggatta

SEQ ID NO: 13006 - DNA, 411 bp, Oryza sativa
attaatgtaaccaccatatcgacgatgatgtctgcatatatgtacggccaatataattgagctgatcgaagtctagctagcttgcttgcattcctggtctccgattcatcgccatgcatgcttagagcaggtacaatagcaggattttaagaagataaataaggagagagaagagcatcgggctatagatttgtagccagctgtagcacgaactccaagacgcagtgtgtgtataacaggtgggatcagatattaatagtgtagtatgtacctattatacgaatgagctattagactggctatagatgaattggagttagtagatggctatactattaaacttgctcttatcgtcctcatcaatatcttgcaaagatactgcaagatctgtttaagttgggagaagagagg

SEQ ID NO: 13007 - DNA, 465 bp, Oryza sativa
tcctgcagccccccggaccccccttatatatgggaaggagtccgtgttacaaaagataatctatatccctaactgaatatgcggatactgataaaatacacgcgtaaccgactaaatctcaaggcgtttccttgatgtacaagtggagaaacaacacccgacatacaaataagatattttatcttattcgcgttgctagtattcagtccaatatcatcgccgtgtagatatgagatatccataatcttcacactactcgtgaaccacaaaatgatagagaggccacaaaataatagagaggctctaggagataaaaactggatagctgcaatgcaagctgagtatgatgctttgtaaaaaataatacatggcacctagttccgtatgagaaaggacaaaatattattgggtgtaaatgggtatataagattaaaagaaaggcagatggaacacttgacagataca

SEQ ID NO: 13008 - DNA, 928 bp, Oryza sativa
acgcccaacagcggtggcattataggcccgccctgttaggcgaaggcaccattcgggggcaacggaggcaggccggtggttaagtcttaaactcccaacagtggtgggataataggccagccgtgtaggcggaggcaccaatcggcggcgacggaggcaggccggtggtgaagtcgtacacgcccaacagcgggggcataataggccagccgtgtaggcggaggcaccactcggcggcgacggaggcaggccggcggtgaagtcgacgatgcccatcaacggcggcgtaatcaaccaaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgaagatgacgatgcccatcaacggcggtgtgaccaaccgaccgtataggcggggacaccagtcggcggcgacggaggcaggccggcggtgtagatgacgatgcccatcaacggtggtgtgaccaaccgaccgtata

SEQ ID NO: 13009 - DNA, 1042 bp, Oryza sativa
gcacgcgaacctacgtggtagaaggagggcgccagctatgctggcgccgccccaaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttactaaaaccctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctatcgaaacggacaaaatatgtcatctattaaaataggcgtaactttctcatacggacttgaaatcaggaaaataatatatgcacggacatctacagaaaaagttacatccaattctccctagctttgccgggttcggtgatattaaatcccccaaattccgcttgcaagattgtgttttcgaggagagaagtttttcggtggagctttggaaaattccacatgccacatatttcgtccgtttgagtttattttttacatggttggttcctgtgagttcctaagggtgaaaaaaatatcaaaaaataaaataaaaataaaaaagttgcacatctctctcctctgcactagttcggagagaagagaggagaggaaaaattctacatgtcacatattacgtctatttgagttcaatttttctatggggggttcttgtgtgtccctaagcgtgaaaaaatatcaaacaaataaaacaaaaataaaaaatttcggggggggggggg

SEQ ID NO: 13010 - DNA, 833 bp, Oryza sativa
  unsure (1)..(833): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatcc

SEQ ID NO: 13011 - DNA, 9828 bp, Oryza sativa
  unsure (1)..(9828): unsure at all n locations
nnnnnnnnnnnnnnnnnnnnnnnnnnnnnnnnnnnnnnnnnntgattaaaagtgttgctcaagccttgccgacttatacaatgggagtgttcaagatgccagagcggttttgcgaagaatatgaacaactcgtccggaatttctggtgggggcatgaaaaaggggagaagaaggttcattggattgcctgggagaaacttacaagcccaaaacttttgggtggactgggctttcgggatatccgatgttttaatcaggctctccttgctcggcaagcgtggagattaatcgaatcgcctgatagcttatgcgcacgagttctgaaggcaaagtactatccaaatgggacaataactgatacagcgttcccgtcagtttcatcgccgacatggaaaggaattgtgcatgggctagagttgctaaagaaggggctgatatggaggataggagatggaagtaagacaaagatatggaggaaccactgggttgcacatggggaaaatctaaagattttggagaagaaaacctggaataggcttatatatgtccgggagttaatcgtcaccgacactaaaacatggaatgagcccttaatcagacacattataagagaggaggatgcggacgaaattctgaaaattcgaataccacaacgggaggaagaggatttcccagcgtggcattatgagaaaactggcatattttcagtaagaagtgtttatagattggcttggaaccttgctaggaaaacatcagagcaagcttcttcaagctcggggggagcagatggaagaaaaatctgggataatgtgtggaaagcgaatgttcagccaaaagtgagggtttttgcctggaaattagctcaggacagattggccacttgggagaataaaaaaaagaggaagattgagatgtttggaacctgcccaatttgcggacagaaggaggagacggggttccatgcaacagtggagtgtacgctggccaaagcgttgcgagcttcattgagagaacattggacactgccagatgaaagcttgttttcaatgacaggaccagattggcttctagttctgctagacagactaagcagtgaaaagaaggcccaggttttatacttgttgtggagagcctagtatattaggaatgaggtggttcatggtaaaggtaatgtccctattacagattcggtgcgttttttgattaattatgataacctacagttgcccgcccgaaaacacatggaagacatcaaggggaaaggacctatgtttcaggatccatgtcagaaagagcagacatgtcagttgaatgcagagaaagaaaagtggagttgcccgcctgatggaagtgcaaagctcaatgtggacgcagcttatagaactgaaacaggcgaagcaagcgctgggattatcatcagagattgcaggggctagtactcctggctgcatataaaactttgcatcagtgtacctcagcggctgaagcagaagtgctagcatgtttagaagggctcaaagaagcaatgaagtggattcatatgccgattattctggagctagacaatgctgatgttgttaaggctctaacacagcaggtagcttcaagatcctcctgggcgacgacggttgcagaaatcaaaggtgtgatacaatgtatccaacgggtgcaagtgcacaagattaagagagaagctaatagggttgctcatgtgttagcacaaatggcaatgagtactaggtcgtgtggggagtagaggctgtgcgccgcccccgcataatcctagacttgttaaatcaagaatgtaaccctctatttagtcattaataaagttctctcttgacttaaaaaaaataatctaaacgaaaatagatagatttgtagaaaaaacaacaattttcatcacgaaaaaggttcaaatacagtacagtagtaagtttcctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggtaagcctgcatcatttctctgctttgggtttatatctgaactctgaaatgatatggcttaatatgactgaaaagtgcaatgttgcttggcctgtagctttggaaaaatatggtccaagcttgtggcgggtatggagtgtgattgttggaaatggaattaattcatgtgtttgcttgtgtgcattaaaaagggcatgtgtggaataatttttttaaggatccctcatcattctgaaggaataaaaatatggcagaatagtgcaggcagagatttgaataataaagaaaagtacaagcactctttatcctttcctggtgttgcactgggcacagtctaaacaggaaaagtaggaattattcaaatatgagcttagtctttgaatattgaacattcattggtgattggtttcttttatatatgttactttctattaagagccaatctatgtgcatatactgacaaatggacaatattttgctgatgtcctttttgcatgttttgaattacaataacttctacacttgcccctgcagaacagggcagtgtcaactcggtttacatattagtagtagtttgttctgttccatagtccttacccatgtggcacggtcagaatgataatgataatgccatttgtcagatttcgtagtttttttttgggtctcttttaacctcaactgaacttgaccactttgtgtggatcaataattatatgccagatctgatatatatgttcttttatgtgctgattttcaggatcttccgggacatcttttactccccacataataacagtgaagcctaatgaggtacctgaaaatgctcccctctctgctatctagtacgagctgaaattcattatttgtctgcttatgttgtcttgttgtgacaaagttacttttggagaacttaagtttttgatttcttgcttgtggtttgtaaattgtaataagtctttgtgccttacatattacatctgtctgctggtgggatctcaagtaatacaaccaaatacataagtgagagctaagaagagagatgtgtagcataagcttcctataataaataccaaactaacatataatgtattcttcagcatctttaaacttgttccctttttgagtttatttgagttgtcaatgccatttacagaatactccgtataaacctttcatttgtttctgaattagtaattttacaattcaggagattgcatatatttatgtcattatttgttgacttgattctgtcttggccaatgagtgtccttcctggctttgatcatcatacacttgccacttggttgtttttttagcgccaatctactacggattggacaccttttagcctattctcctcttctatgtttctacctgaagtccaagctgatgagcatgcatgcatcacctcttctttttggcaggatgttgcttcaaaaataatggcattttcacaacaaggccctcgcactacatgcataatttcagcaaatggcgctctttgcacagcaacactacgtcaaccagcaacttctggtggtatagtaacatatgaggtatattcaagctaaactatctgtgtgcagtgtgcttactgctcagagcaatgcttgagctccactggtgttctttctgtgaaatagtaatgaatatgcttaattaaagttttctcgatgtctttgtttcattacagtgcagtacaaaataggtggctagatttttcttagtagtatatgtgctactgtacagtggtggatccaatgcctcttgacaccgatgagttgcccaggcttgccatcgagccacagtagagcagtgctctgcagtctgcacttcctgtgttcggcaacaccagttgctacgtttgcctgaactacaagaaactccagtgtctgtcttgcactaacaaaccagatatatacatcacaattgccagcaacccctttttgaactttgtatgctttggtaggatgcactcagttgtccagctttctggctatgataacttattttctgatgtattccaatgataagaggagaaatgactagtatagtagtatgtttagaatgttatcacaaattgggggtgggggatagaatgaaaattttattcttctttgttctcaacagtcacaccaggtgcaagtaacataatatctaaatctgatgataaaggcttctggtcattttcatttacagcatgtggttgttagtggccatttctatgtggacagacaaattcgaacaatattcagttgctttgtttataatataattgtatttttttattgtagaaatcaatatatgaatatgaattcttactgtgatgtttcacagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttccccattcatctatttgctgctatcactttgttttcagctggtttgtgccctaaactagcattttctttggccttctgttacattctgttttccaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattggatattgtcgtttttcttcgctgtgtttcaccctgcaaaaccattccactactgatgcgttttggtgtagggatcacatagacatgaattctgatcgcattcatacatggtaccagtaatggtgtgtataagtctatggcaaagtgccaaaatctatcgagaatccgcaaggaaataacttgtaaggacagtaagaaaataattcttgtgggataggaacactagagaagaattaataattgtgtttaaagacaaggtatttgccgtcagctcggcctacagcttccaaaatggtggcagcaggtgcgtctctgttttcggtcaaaggcacagagccgccttcgattctctgtgtatgttgatctgctggaagctttggaaagaaagaaacgtaaggatttcgattctatgttcatgttgatctgctggaagctgtaaggatttcgattctctgttcatgttgatctgctggaagctttggaaaggaagaaacgtaaagatttttataacagaaagggtggtagaacacttggtggcagacatcaggaggtcctctgatctgaagagtggccggaattttttctttcgaggagtagcagcatgtttttggcctccttaaatagttttcctgttctttttcgaggtttcccctcgactctgtaatatcatgtatattgtattaccctctttttttatgtatattgtattaccctctttttatcttaaagaaatttggtttacgttctttttcgaggtttcccctcgactcgacagtgtaatatcatgtatattatattaccctctttttatcttaaagaaatttggttgacgtccttccgccgacccggcaaaaaagttttctttttaggctatggaaatgatatatttgccgaacaagttttctttttaggctatggaaatgatatatcagtatttcgttctaaaaaggtgaaacaatagggatactaagttctaaaaatattttacatgaggcagaggcatgttggatcaatttgatttaagagaggcacgtggataacatattctcttacctttattggattggcaaaactaaggatgtcaatatcttgtactccctcggtttcatatttgactcttaaaactcctttatgtttttttgtttgatcaaatttataaaaaaaatagcaacatatatgataccaaaataatttaattaaatatatcattaaatatattttaatagaatattcattttgtgttaaaaatatcattatatttatctctgaattctatcaaacttcaaaaaaatggggaaaaaatcaaaacgactagggagcacagcatacactgacacggctacatgattacattcatcgatataagtagatccgtagatgcgtacttcaaaaacacatgaaaacgaaagccctttcattgaacagaactacatcaagcatgttaattttacatctgacactttttattccagcacacgcatgtgcacacagcatacacgcgtgcgtacgaacacaagctaacacgatcagcggccgggctgggaccagatcactcgctacactgaaaaaaaacacactagcgatccagatcgatcaagcccgcccatgtccatctaccccaaatctagatgtacgatttgtcggacgccgcgtacgtgccggtgccggtgccggtgccggcggccgggtatgcagggtcgacggcggggccgccgaccggagcgtggtggtggcggttgccgccggccgtaagcggcacgcgcgtgccgtggcggcccgtggtggcgttggcgcggtgctccgccctctcctggtgctcgtcggccttggcctgtgccttgccggccttctcctcctgcttggccatctccttctcgccgtgcgtggccgccgtcgcctggccggccttgccgtgcgccttggccgtcccctccttcaccttctccttggcaccgctcaccatgtcctgcaccttcaccttcgccgtctgcatcttttcttttcttttgctcctacagtacagtagctacgtgcgttgcgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttcttttttccaaaacaaaaagttagacgaagattaagatttttgtagcacgcttttcaaactgtttaaataaacagtacgtttcgtgtaaaaactttctatatgaaagttgctctaaaatatcatattaatatacttttttaagtttgtaataattaaaactcaatcaatcatacgttaataccacattgttttgcgtaaaaagcttaatcttaatcttaatcttcatctttagaaaaaaaacaccacctagattttttttcctatctcctaatgcacttgaattgtttaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggg

SEQ ID NO: 13012 - DNA, 6886 bp, Oryza sativa
ttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccgttagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacatttcattatatataagaaaaagtttttgatatgaatctaacaatatcaaccaaaaacatatgttctaatagactaattgttggtgctagaaaatctttgagaaaaatgaagaatctcagacaatttagtgctagaaaattgtaatacctgatgctcgaaaatctcagagcaaaatgaaaaaaaggtaaatcatgatgcacgagaaaaatgaagatgccatccgtctccttttcatctcaatagcaggttaaatatatgaaaaaaaaatgttttcttaataacgatacgaagatatgagaaactatcaaaccaagtcaacaattcttccaaattaaaatcccgtaggggaaatgcttaaaaagtacagcttgcagcattagtacattatctgttatgatttctaacgatctgtattgatgtaaaatactctagtcaagagtcagacgggcagaatagtaagcgatcgatcgatggctacacattaaagtgccactgtgcaatgcatgcaaaataaataatactaagtctatggattggccgtgatctgtattactcaagacttcgtctcttacctagagcttatgttctatggatcaatttattcgagattttgacgaagaactagagactttttttattccttttgttttgctgcgtgcagggagcaattcgatgggcgtcgactggagcaatctgatgggcgatgatgaggtgacagtttcacaagtattaacctaagacttggtgtgatgctacttgtcagaaacgtaatgaagagaacacacttgcttgcttattcctttctgttttcttcttcttcttcttcttcttctttttttgtggagacagaagaagtttaatttttcaaaacggcaaatgcatctttggagttgttaaatggagattggggaggagctggcagaggatgacggtggatcttgaattgttaatctgtccggttctatttcttcttctgtttgttcacttgcatgttctttttcctctgtctgtattaattagttgcgagcggttgagcgtttcatttgaccgtgattgggtcatccatccatccagccgcattctcatattttctttggatgaaattatattatagagataagaaatttgcctgtaatgtcatttagttagaagtttcacacctctcaacatcatattactgacggcggatgattaattaatggtaaaaaaaacaaggtggattgcctcttgtaatcttgtatctatacaccatcttctgtacccaattatattttacctatacaagggcttttagcttgttaatgctgacttccctcccatgtataatgtatttttcagaaatgaaagatcatgtgtgccagattacttgggagtcaaaattatggtttctcttaatgtggtttaggtgatagtttggcatcattacgacatctttctttgtcatgcaccgtctgccaactcctgaaactaaaatggaacagaaaacgagtacaagtgcagttccaactaaatcactgtctgacaaacgagtactgtcttcagttcatcatatctgagctatgaagatctatttcatcacagagaatctgtttctgctccaattaattagcaagtagttttaacaaaaataattaataagtatcttgtggttgtcatgccttaatctgccagcaaaacattttctatatgattaaaatggctatatcaaccgtactgtagtgggaacatggatgatggatcactttgttgctttattttttatatatagtattttgctaacgcaagccaaaaaaaaaaaaaaatggttggccttaagctgtccattagtgcaccgccagttagcggaagatgcaattttcaaaacaaaaataaaaaacttgcacgaaattatgtttacgaatacttgcatatatatatataagcacccactagttaatacccacttgctagttgctacactgacgttccacacgtcctaagatcctatcgtttgctcttgccatcgccatacgactttaagagtttttatttttaagtcttgtactttgacaaaattaggcatatcgtcgaacaaacgctccctgttcgatttgactgtggcgaaatattcttttgaacagacgttgcaatcggcgcagctgctgatgatcatccataaattgataaattcgttgactaatcgatctgaaaacaaaggagcgtcctgacaagaactgtcaccggctggtggggttacaatatttttcagaatttggaactgctcagagttgaattactagtggtaataccgacacgttactcttactaggttcttatcctttctttgtccaacagtaattaactttaaattctgttcctgtgaacagaagcaataataattccactgcggtgacaaaactacattgacaattggcacagagatcttacctgttcgaacttcgagtttcttctcgggaagacttcagatttcttaatttcggttaagcacacagcgtttgacattaatcagttgcttgtttttgcatccatttcagcaggctaacgttttccaaacgtatgactgcagattgtagaaaaaatgatggtcggatgattcataacgttcaccgaattaacaatcgtgcttccacttggagcagctacctgtacctgcatgattcctttcaaacattgttgtttattcctacattgcatcttgctagtgggaattgatcctgacagtttagctttgaccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaggggcagagggctcacagagaaaccctgtctcgtcatttatgactgtttccactggaccaccactgttgcatgcaattacaggtttatatgcggccatggcttccagaggaacaataccgaaatgttcatcctgcaaaatgtcagacgcaggtttattatgggaaaattctcatgttgttgagaatcaaaagacatgccagatatttacctttggagtgtataacacacaaaggcagttggagagaagttcgttcctttcagaagttgaacaagatgtcacaaatttgacatgttcagaaaccccttcactcgctgccaatcttttgagctcctcaaggtattcaacattttctctgagacgcttatcatatccaccttaagcataatcttttgtaagtaaacagtagttgccagttggtaattcataatgcagtgacgatgcaacattcaacctgtagtggaaaggaaattacctgctactgttaaggttacttcctgtcgagcatcaccaggtagcatagaagcaacagagcgaagcagagaaaatgctgaaatggcaagaccaagattcttttttctctcaaaccggttaattgagaggaaattcaacctgcgcagaaagatgatggttaaatttggctagacctgaaggtgcagaaggtgagaaaaatgcttacacttcacactatactatttttttttaaataaaatgaaacctaagcgagttacagagagatatacaagcatgcagttacttataagcatgaggttcctgaaactgttcaacagagacagctggatatagaacagcaggctcgactcctctagcatgaaggctgcaaaaggtcctggcaaatgttgttgcagtgaacttgctgtttactagaatcaaatctgccatacctaatacatacaaaaaagggataagcactacagatagaacaaacactagggaatggtaaaaaacatagcaggcaacagttctagatgaacaagaccataccagtagttgtttcttcaatcatgtcaattggcttgcgatacaacctccgaagcatggtagtatgttgagcaagcaacatatcaggaaagtgacaataaaatactatctgaatacacgggaaaaagaagttatcaacatatatctacagtggaaacatactgatcacataaagcaagggatcaataccttggattttgccttcagtttaagcagtggaatcacaaccgaaacctggtctactaatatgatgtcaaatgagggccaccaaagtagcacacacattgcaacaaaaatgcagcgaagatatgcacagatagcgtggaagcggtaaaaaatatggcgaggcaagaaatctccatatactttaacttcaaatggacctgcaggacaatagaaaatcaagtaaagtttccattggcataagaatccctacacactattgagcgatttgagtagggtatccgaggaaacgttttgtgaaattttgtacgtaatcaatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattctagggcatcactactcactacttaactagaagtatcaacacagtatggaagtgaagaagaagaaaaatctttccctaacactcagactaccccgtaattgcagcaagcaactaagcatacgtcgaaccttgagcaaaattgaggaacccaacaaatatcccagctacaagctcaggcagcaacggttcctcaaatctactgatgcttccaccgcgtggactcggaattgctacatatcgaccaatttacaaagtagcacgcaaccaatcgtttcggggactcaaccggatctaccaaaattctgcccacgagagatgagggttcacccaagcatcgacaggagcaacaggaggggggagagagagtagaggcgtacctatcccgagatcggggtggatcacggcgaccttaagctgcttcgtcctcgtccccgacggctcgccggcgactcctcccgccgccgctgccatctccctcgcgtaaccagatgggcttcggccgccgccgccgccgccgccgctgcgggccgtggatctctgctcgctaactcgctctcgctagtcgtgtcgtcacgattccagctgagttgatgtgcgggtggattgggcctcatacagcccagtatctgataacgcgtgcga

SEQ ID NO: 13013 - DNA, 7009 bp, Oryza sativa
tatttcggggatggctaattagcgcgtacgtgccctttacctaagtcgcgcgcgcgtagagaagcggtgggcccacttgttttcggcatcacgtacgaagaaaagccaaactcccgttcgtgtttctctctttttttttccggaaaaaaaatcgtcacgggagtgcttaattctcttaaacacttttaacttagatttgaatcttttcaactttgattcgaaaactttcaactctatatttgaaagtttaaatttatatttgaaaattttcaagtcaagcttgaaaacattcaattcagatttaaaaaattttcagctcagatttgaaaactttcaagtccagttgaaaacttttaccttagatttaaaatttttcaaatcaaaatttgaaaactttcaactgaagatttgaaaattttcaactgaagatttaaaatttttcaactcaaattttaaaacttttatcttaaaattcgaaactttcaacttaaatttgaaaatgttcatgttaataatagagctaattactggaaaaaagaaaaaaaaaagtatgagatcatagcgctacgtactcatgttaatcacgttagatatggcgttaatcacacactaattgtatgagttggcacctgcacgtgctttactaatgagcctgcgaacgtccgaaacgcgcgctgagttgacccgttggcgcgtacgcacacaacagcaaatccgtattatttcttgcaccaggatcctgataaaagatgtaggtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataatgcagtcgtcctactgctacaccagggcctcaaaagaagaacaagatagtgatccactgcatttgcaaaacagttttcaggtaactgctgtactgattttacacgcgagaagatttcaggccatgatgcatctttcacacataagaagggcagtatcccactgggcagttcatcacaagaccatatacagtcatggcagttattaaggccaagggtcctgatcacagtctcagcatttagcgacacacgctgggacacgatatccacacttggaagtgtaagcagtaacatggtcacacggttaattaagcctaagcagcagcggtgtccttgggagagcacggcgtaggctgggcatcaggcgacaggttggagatggagatgagctttgatctgtacttctctgccccgtcatcgtcgtggtggtggccattcaccatggcgccgctcggtgacttgatgttgacggcttctcctgccgctggaacagaccgggagatcgcaatcagagactgacgggcagcttcctgagtgaactctctcggtgatgcaggtgaggccatcaaacaaacaaaggctgcaattcaagcataacaggaaggtgtaagtatacgatacagcttattagaaggcttggcatataaatggaatgaataactaattaagtagatgctagtcattgagctaaattaggcagcttataattgtactactaccaacactcctaatataaagcaataaaaatagtaatgttgaaaacacaacgtaatggtccacatgaaagctcctaaaatattctgcagtaactgcatgtcagtttcatatgaaaaatgttatacataaagggcgattccatcctccaacctctgcttaagcctgaagtgtgctgccctgattgagtttccgaaaaagtagagttattcaatttaagtggagcatttggtatacatgggacgaacgggttcagtttgtgtagtcgcacaaataattgctgagctatgcacccgttagcacacactgttttagcatgaaagatgctatttttgttgcaaatgatccacccataaatctgttgtggataggatatcaggcagacaggcaccaaacaatcacactgtattcttgctaaaaaaaatgacttgccttttgaatgaagagcattttgatcatgtgactactgaatttagactggaagcatagactgggtacataatctggagtgagattttcatgctgcttgaaacgatttagtacgtttttcagtactaaggttaaacatcaaaagagtggtagatcgcaaaaattaggtaggccatcactcaaacagtccctcatatatagactaaatacaaccggtcgttttggtaggaccagctaaaatagactacttactagaaaagaattactactccatataaggaaagacaacctcaaattgcagattactatttcaaagcgtcgctactatagttacgtaaccttatcctcagcgtgaggtgcacctaccaaaccgaaaggcaccaaagaactcacaagcatttcactagtattacgagcttttcggagttccagtatcagccatgtggactaaatcgttgacgctccgaataccgcgaaacaggggcggatccaacttgggacatgaactgaacccccaaaacttttggggaaacaaacaaactgtttacttgtagtaagttcaaggctctgaaattaagagaagagcttcttccagatctagaagagaagctaggattgacgaacgcaagcaaaatcccagacaacagtactcccggtgggagagagatgaatcagaaagagggtgtggatgctcaccaggatcccctcccctcccctgttcagccgcgacgcgagatggcgcacggagctgaggagacgacgagacgggtgtttttccttttacgccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccataaacaagactctttgctggtgttctttttttctgaaaataaatatgaagatgaagattaagtttttttaaagtaaaacgagatggtattaacgtatgattgattaagttttaattattacgaacttaaaaaataaattaatatgatattttacaataattttcatgtagaaagtttttacacaaaacgcatcatttaacagtttgaaaagcatgccacaaaaatttttatcttcaaccaactcttgttgaagaaatgaacggacctttatcccaacaaatcatgaaatctccccacacggaacggtagacaagaattacttccatggttaaatactcacgtactcgcgactgaaccaaaatcaagtaatcaaccaagcgacgagcggtcaagcaacacaaaccaaccacgatatactgtcagtacacaatccaaccggagggacgcctgaccagctagcaataatccggtgcagaaactaacgcgcttataaatacacgagatgcagagcgagcgcttaccagataatctggcaggacagcgggaggctgcagggacgagcgatgaggctgcagcctgcagggccgaagatgagagaaagctatgggcgatggagagttggagacgattgggggaaggaggccaaccgaggatgacaaggacgacagggtgtgggttcggtttctttacggagtatatgaccgtgcacgttgatcacgacgcgcgggggttgagctggtcggtgagccatcgtggactaccgccgcatccaccgctcgtttgctcggtggatggtggggtatcaggctcggtccatagaccaggttctgggcattatgcctcgcccgtgatgaaacggacaagagctcgagttgtaaaacacttcgagaggtgcacgtgaggtgtcgtatctgcacgaatcgcgaggccatgtgtctctggagaagtcggcgaggtgaggcgcgctcggagctgcgggccccacccgcagatacgtctgtagcctggagcaaggtggggccgggccgtgctggaccgaataggaaggggagcggacacgggctatcatccagcccagtttgttcgtcactattctgttccggcccaaactgctggtgttactgttacgctccaaacctaagaaccatcttctaactgcattgtgtcacatgtaattctgttgcaaaacctcatggcagccattttgttagttgtcgaactactttcatttcattaatgaaatagaagaggatctcctctctttctaaaaaaaaactcatggcagcttatttattcttcgcgttatccaactctgaaatagtttggctttgagagtttcagttattggttggaatagctagcttttctttgcaagctgcacagctattttatcgctcgaatacgaattgtatgaatgtgatagttctggaaatagtagtgatgcatttgtgctcattagatatatgcgttacacttgaagaagaacaaagtgaaaaaacacacatcacatctatatgcagcaagtatcaacggaaccaaacggtcccctcatttattaagcatggattacacttgaaaagcgaactgaaaaacacgatcagagaagcagcgtcgccaactgccgctgccgcccggccggcgaggaagaagctagtcagaaccagcgccgtacggaaaatccgggctcgggctcgccgtccgcgagctgctcggcggcgactccgcagctgccacgggcggtgagcctccactccgaataaccttcgggttgggtcccgtcgacccacccacacggccggctgcaccgtcatacgcaggcactgccggggagccactggacacggccgtcggagaacatggtggtggtggacgaccagtcatgttaccggaaaacgtcggcgacggcggtggtggtggtggacgaccggtcatgttaccggaaaccgtcggcgacggtggttcatctgggctcttgtgcctgccaccggaagctctcggcgtgtcctcctccggcggcgcctgcgttccaccgccggaaactcttggcgtggaaggtggtggcacacgtacactggcgtatgcgtccggcggtgtgtgcttgccaccggaaactctcggtggtgtgtcctgtggtggcggcggcgaacggacactcgtgtttgcgtccgggggcgtgtgcgtgccaccggagatctttggtgtgcgtggcggcggcgatcttacacttgtgtatgcgtccggcggcggcgtgttcgtgccactggaagaagctgtcggatgttccggtggagggagtcgcacgcttgtttcaaccactggcgccggcggcggtggtgttcgacggggaaaggtctttggtgaaccaagggaaaatctgggagcaggcggtggaggagagcgcacgctcgtttcagacatcggtgtctgcggtggaggtgttcgacggggaaaggtcttcggtggaacggacggtggaggagagagctcgctcgtttcagccactggcgccggcggcggaggtgttcgacggggaacggtcttcggtggaccaagggagaatctaggaacgggcggtggaggagagagctcgctcgtttcagccactgctgccggcggcggaggtgttcgacggggaaaggtcttcggtggaccaagggagaatctgggaacgggcggtggaggagggtgctcgctcgtttcagccattggtgccggcggcggaggtgttatacggggaaaagtctttggtggaccaagggagaatctcggagcagacggtggaggagagcgcacgctcgtttcagccactggcgccagcggcggaggtgttcgacggggaaaggtcttcggtggaccaagggagaatctaggaacgggcggtggaggagagagctcgctcgtttcagccactgatgctggcggtggtggtgttggaccaggaaaggtctttggtggactaagggagaatctaggagcgggcggtggagaagagcggatgctcgtttcacccgttggtgttg

SEQ ID NO: 13014 - DNA, 5569 bp, Oryza sativa
actcatttcagccgttggcgcggacggcggtggtgtatggactgggaaatgtctttggtggaccaagggagaatctgggatcggacggtggaggagagcgcacgctcgtttcagctgttggtgcctgcggcggtggtgttggactgggaaccgatggcgcgcacgcgccaccgctgctggtgggaggcctcgggctggcttgagcaccagcggggactgacgacgaccgtggtggcgccctggaggtcgccgcgacgccggcgcaatgccgcagcaggccatgcgggaggagcgaggcgacgaaggtgcgggtgaagggcccgcagtgctcgtcggcctcgcacgccgcgaggcggcacgcgcgcggaatggggcaccccgtgaagaaggcggcgagcaggtcgtgcttgcagcggcccagcgtcagcagagactcccagcagatgcccgagtcggtgtgcgggccgcccgggaagatgctgtcgaacgtgagcgaccgccgcgccggggtcgactgatcggcgccgccgccgtgcgcgacgcacgcggccacgagcgccgcgagcagcaaggccgtcctcatggttggcctcgcaaaaccgcagctctctttggctgcacctgttgtgttttgtgcttcactttggagcaccaaggccgtagtagcgggaaactgtatttatagagtgttgccaagctgttaattgtcccgatcgttttgcttgcacgttgggaggttgcacgtttagattgattaatgctagcgtgttaattgtgcatgtgtaacccaccccgaagatttgttgaatgttcatcgatggtttctcatctatgttctgagttctgacgttttctctagccaatgctgtgaattgccattactcgtagttgttgaccagtaatgtttaattcatgagtaaatagaatgcgagtatgtgaccatgtctgaacggttatccagatggaaaagtagaaatacaagtaaggaattttggacttgaaatgcaaatcagatgagctgaaagtctaaacctgtatgtttgtggagtaatatatttcatattaatctatgttgtcggtttttttcatatttttttttgactatttagatgacatgcaaataacgagaggatgtcctcgagagggatgaaaatccacatctcctataccagattcaacctgtttggcagctgagttttccaatttgtcttcctcgttttccgtgcaaaagcttttaaaactgttaaacgatgtgtttttaataaaaagccttttttatgatagttgtttttaaaaaatcatattaatctattttttttaaaaaatataactaatatttaataaatttcgtgataataagttactccggtttttttttgtatgcgggagattagttcccaactggaaggaacaaaacgcagcccggcctgatgatgaattttttaataatccctaaacatagagtacctattaactttcatattgtcaagttgcaccatttttttttaaaaaaaaaactgaagcgcctgatctcgatgcctacctacatatgaggatatatgacgcgtgtttttttttttctctttgatcattcgacagaatccctccttgtccgataatgaatagaacacacgcactcgaatcggattcaacagagcccccgacttttgttataataagttagcgtatctctcgcgcactaacttcaggcctcatcgatcattcatggcagtcgaggcatgcagcatatgtcgtcgaaaaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagagtgagtccatgaccatggttgcgaggtctacacgctttgcaccccaagccgcccgtggaggccagcctccggaggcataccggggcgtctcggtggcgtggtgatctgcgccctcctctacgagggcgcggcaaccaaggtgcccccggtatacgccaatgggttcttgcactggcagctctaccctgacaaatacttgatcaagacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagtgtggagcggatcaagaaaatcctgatcgctacctcgcagcacaaggtgcacgcctacgacccagctacggggagcatcgaaacggtggtcaccgtcccagaggatttcgccggcggccgggaggaggcggtggccggtattcggattggtctgtacgaggacagccttgcccgtgtaggcggcgagagttgtcgacagagggaagccacggcggcgatgactgagatcctactacggttgccgcccaaatcaatcgccatgtgcatgctcgtttgcagacagtggcgcacactgatcgagagcgagcgctttcttacgtcacacatgcttgctaacatggaacggaagaaggtcatggtagtcacgaatggccgtcgacgggagaatttctttaatttcatgccggtggagacctggattgggcctgccgccaaagctcgttcggacgttcttgtcaaccgcaggatcctctgctctaagccatgccatggacttaacctgataagcaccagcagcgacgactacctgtgcaacccttgcactggttctatccggtgtcttggaatccgtggaaagtttcgtgagattgatccaactgtcagtattgatgacgatcgccgccatgtcacgagagttggcaggaacatcgggctaggattcgaccggttgtcacaagagcatgtagtggttgagatgagccgcttcaaaggcgacctgcagctgtgcatgatcaagacgagctgcgtggattactggagctgcgctggcaagccgccgaggccggtgaccgacatgccaccggcacatgttgacgggacgctctactggatcagcgagccacagccgacggcccgagaccgtgtcattgtggcatttgacatctcctcccgggagttctccgtcttgccatgccagccatgctgcagcgagagggacggcggtgattatccgttgctcgtcgagctggaaggatcgctgtcgctcgtcgtcgcaaacgcggaggagaacaatctgcagatatggacgatgcaggaggctgacggcacatggcacaaaagttacagcatcttactggacgagaggtacccggacttctcactaaaaacgggcgtggtggtagtgccactggacgccgtcgccgatagcaatggcggcggcaggatcttgctcgacacagggcgagcattgggctactacgatctcgagacgagaagcatcgacaccttgtactcgctcgaccagctaaagcttccccagtgccagatggcattccccatgctgtacggggatagcttggtgcccatccaggacgacgaaccgcccgactacgtcgcgccgactcttcgcgacgacgacggcgggcggcgctgctactaccagccgcaacacgtggagatcagcggcggcgagcagcctgcggctgcctcctgcgtattccggccatgcgaggcggccggcggcggctgcaggggcatgggctgcgtgtacgcgggtagctgctgcaggagggtgctgtgccgggagtgcagcctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggacgaggtggaggaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaatggtcctttttggggcgccagagtggctggcgccgtcgtccaactgcagcctctctggcgccgtccccctgccgacgtggcggggcaatgctgaggtggctagggggagcgcgccagagtggctggcgccccccccccccaaaaaatttttttttaatttttttttatttttttgatatttttttcacgcttagggacatagaagaaccaaccatagaaaaaatgaactcaaatggacgtaatatgtgacatgtagaatttttcctctcctctcctctctctccgaactagtgcagaggagagagatgtgcaactttttttatttttatttttatttttttgatatttttttcacgcttaggaactcacaagaaccaaaaatataaaaaataaactcaaacggacgaaacatgtggcctgtggaattttccaaagctctaccgaaaaacttctctcatcgaaaacacaatcttgcaagcggaatttggaggttttaatatcgccgaacacaatcttgcaagcggaatttggaattttgaattagattaagtaatttcataaagtggtagagtgcattatgtttaacatgctgatcaaagggtagatcaaagtggtagattagtgaaggtgcaaagtagactaagtggtagttcaagtttaattttttttttggttggttgtatcgtgatcctgagagtgaaaaaacatccgagaaataaaacaaaaatgacactgttgcaactccatacagagaagcaggaatggaggcgagggtttgggagggggggggg

SEQ ID NO: 13015 - DNA, 7227 bp, Oryza sativa
  unsure (1)..(7227): unsure at all n locations
cgccgtcanccaacggacgacgccagcctctcnggcgccctcctcctaccacgtcggttcgcgtgcgccatggtggcaggaggacggcgccagagaggctggcgtcgtcccgttggatgacggcgccagccactctggcgcctcaaaaaggaccatttctgggataagtttttttaggggtctatttgcaaaataagtttttcaaaaggaccaaaatgtgaaaaatctagacaggatggacgggaaggttattagggagacgtgggtgcgcagataccgcgctgtgtcttttaatagagaaattttacggtactttaaagaaagtatctaaattttacactgaaaattttgatatatgaaaatatcaaattttacattataaaatatggtactatgcacagagaactagagaagtcaagtactttcttaaggatggtaaaatttatctatttagatatgatgcaccatatgcacagagaactagagctttgcagaaatagctcgggacaatgcccgacagtttatatcaaagagttgatgaccgtcattgcgagcagtccggattccataacacgagcattgcgataaactaaaatggagtttttcacgaactaaactagtagtgttcaactctttgaactgtatatcatgaagtaattatgatttctctacacagatctgtcggactgtcaaccatacaacactgtctaggtgaagttcatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttctcaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcaggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctacaccactatatatggctgtgttcttaagttcaagttcccaaccttattctctcgtttaccgcgcgcatacttcccaaactgctaaacggtgtatgttttgcaaaaattttctatagaaaagttgctttaaaaaatcatattaatctatttttgaagttttttaggctaataattaattaatcacgtactaatccattgctccgttttccgtgtccaacccttacctaagaacagaaccttaatgtttttttatgacgtggcacacggccatgtggagggatgccagtcattttgcaggcaacccctgccaccctcctaaaagactataaaagggccgtcaatgtcattttacaaccggccccttagaggctacaactctctccagaggctacaactctctccagatgcttagaaatgtcctaggctgccattttataggtgagcccctttgcaggcgataaggtgactgcttgtaaaatggtgtcttcctccatgtgacattgtagatttgtgaagggcaacataggtgtagatttataaaactttaaaaagaatatgttttaaatattttaataaataaaattaaaaataaaaattcgaaaacaacaatacactctttagtggaattgaagggaattttaaaggaattgcaaggaactttggaatgtaggattttgaaaacataaagcatgaaaagcacaagattggaatatatcttgccttgcaaattcctaaagaattagatgcactcaaatgctccaaaataatcattcgggtggtacataggaataggaatgataaaataatagtggacacaataatagaacaccacgggataagaccttaattgtatttccacataaaattttaagcatcaaccctttgttctaaaggacttgataggaattttgccataagtattcaaatcctctaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaggatgcaagatgtgctgtatgttttgcttttttggaagtcgctggctttttgggagaaacttgggggtgataggcgtgccgagtggtgggaggaggaattgcaagacaacaacttctttttatgttactaaagatattttccagttgtactcctttttttctactaagattttagtcttatattttgttttagtgtaccgcgatatatatttacactttttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagttaggctgcctctcgtatagaaaaatgtcgtaagttttcaagcacatcgccattactgcaagtccagtaaaatgtaaaaaaaaagtctttagtacaattcaagggaatttcaaaggaattgcagggaactttggaatgtaggattttgaaaacatagaagcctgaaaagaatataattagaatatcttgccaagcaaattcctaaagaattagacacactcaaatgttccaaaataatagtttggatggtacataggaataggaaagataaaataatagtggacacaagaatagaacaccacgagaggaaaccttaattggatttccacataaacttttaagcatcaaccctttgttatgaatgacttgataggaattttactgtaagtattcaaatcctgtaaaaattcattcacttttcttttttttccccagaagtgcctagtggttatgattactaagaaaagcttcactatgtaaccgttttgatcaaaggaaattaaaacaaatgaaagtttccctcaagtcaaaaa

SEQ ID NO: 13016 - DNA, 3889 bp, Oryza sativa
ttcagttctcctggtaaattgctcatgctatgctcatatcaaattctattatttgccaaacacaaatcatccattttttggccagtttttctagaggagtactgatcaaatcgtctatattactttgccaaaagattgccacacctcatattaggcaagtttgaccaagttaactcattgtttggttcatggccacacttgtggtattccctttcatttctcatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcatagaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtgatgggcgaccacgcgcggctcatgtccttcttgtggttcgccatggagcttgccatgtcatcgccgcttttcgcgaagctctccgcgctcttctcctccgatgccgcgtgcctcgagggcctggagcgcgtccgtgggcgtggccacgagcggctccgtgtcgtggcgtataggctcggcggcttgcggtacagctgggcgccacggttccgcctcgccgtgctgctcctcctacgggacaagtttcccgagctggttggcgccatcgaggtggttgatcccaccgtggccccagtggagcgccggccatggaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaaaggtgccattatactcctctacggccggtccactgtctcttttctttattgtcattgagattttaaaaatcgaacataattatctttggggttcatttttactttctagaagtcccgccaaaccgtcagcggctttgtcattgtactcctcgggggctcacccaggggctcccttctttattgtcagtgagattttaatatcgcacaagaatcacagtgttttttacactttagaagaggtgcgcacctttaaaaaataagagtggaggcttcatttatactaactttaagaaggtctccatcaaaggatgccactatgcccctctatagcccgtccgccgccgactctttattgtcattgtgattctaaaaatcgaacataactattgtgggaattcatttttttattttctagaagtcccgtcaaccgttggcggctctgcaactatactgttatacaccccgcctactgcttttattgtcattgagattttaaaaatcgaatatgattatcaatgaggtttgtttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattcttaaattgtattcctacttggactctcatttcctttt

SEQ ID NO: 13017 - DNA, 21262 bp, Oryza sativa
gcttatttttaattccgaatttcagctatttttaaattgtatttctacctggactctctttttcttttctaattttgaattttattttatttttatttttatttttgattaatatcgtattgggttcttatatggaaacttctttcaatattgcttatttttaattccgaatttcagcattttttaaattgtactcctacttggactcttcttttcttttttttctttttctccgattaatgtgggaatttctagcccccacagcgaacgtggtgccttcttttcgagctgtcttaataatataatagattcctttccaaatgaatcaattcaccatgtggcatttaaatcctagtgatgcatacattgaggacagacacttatatgaagctgaaagcatagttaaagaaatgcgtgaaactatttctgatgttaggaattctacgctatcacaaagtttgttgatcacatgaagaaagatcagagcatttgttctcacatctcaagcatgttgggagctcatgaatgcattcaattggttgtttatggcattgggagctttgaatttgatgtgaagtcccaatatcagattgcttttgctctactactaaaggaagacaatatattcccaattagtgatatcgaaatctatgatccatcactacctcctgctgatgtgaaagcatgcttcgacttggatctacgggtgctcttggttaatgaacaatgccaaagaagtgttgacaagccgataattttctttgttccaggactggcatttgttggaaacctcattgagtcaaatttctctcctgagcaattaaacaatattattctaatttcctatggggtcaagaatatcggggatagaatttctgccgaacttgaaaattggaacaatggatttaccagtttgaagggttccccagaattggaaagagagaggtttatttgggcaagcataaattatattaatgaagtcattgtgatggaaaattttaatgcccacttctggggagtctctgatatgagatttgagttccttgatgttgctgctgatgtggacatgaactcaaatttgccaagtatgtgtttttgcttccgaacatcttcgatttataccaatttacctcatttttttttgttttcattacttttgtttgatggtggagctgactttgcaaggccgactcttaaggaaaagtttttacttaacttcaaattggagctggaatataattctttctttgcttttgagtacgccttcttgagacttatgggcaatatcttgttacttagtagcattcattgtctagtgttgttacatgctgaatcatgtactgttattgtctctgtattttcagccatgtgtcttattttcgtatgtgcttggaagaaagaatgtcgcgtccatttcaagacgatcaagacgattgcaaggatggtaaacctcaagactgggcacatgaattcctgcaccgaatcccagcaatgcatcggaagacttggtctcctcctcccaaaggttggatcaagttcaatttccacggcattggtggttccaaagatcgttctgctggcatgggtggtgtatttcacaatgaggatggtgtgctctccttctttattggttcattaggtaacgtggatcaaaccgtggctagtattggagcaattgaacttgggctaaaggtcatgcttgagtaccatgaaccagttaaaaagctgatcgttgagggggacgatctcacggtgatacgttggttcaacagagtctctcacccgcctgcaagagcgcatgattcattcctacgtagttacttgcacttgacttcgatgccattgccatgtgagggggctgccgtgcctgctgagatatccaaagaccctgaccatgagaatggtagttcttcacatgatgcatcacctactaagccaccgaatgacggtaacatcgagaatggtaaagatagagaatcatagttctttacaatattctttatctgctattaagctatctgaagtctgtaacagtaggaatggttctttgcagatgcttcacctgctaagcaatttgaaagggagtacatagcttggcgggtcgatgaagaggctaatcaggtcgcaattggattggcacgtctaggcagtatgctacctgaccatcagaatcgggtaaaggtacacagctcaacccagtgtgactgtgaaatccaaagagaaatgaggaatggcaggctaccagacatcacagttggtgagaacctctccattttgccgatccattatgtagccacaagtccacaagtgctatttttgtgcattattaacgatcaccatatgctacaggtttgcctgttgaggagccaagctaataaggagtggagggccttgtcgtgtggaaccagcactctgatgctaaaacagttttgcctgtgtctggcattccaaatattctcaaatctgaatgtatgtttgaatggtccgatgaaaaatttaaattatgtgttctttggggaaatttttatgtgccttttgatagttcatttgcagattcaattgtagtttttggtatatcttttttttttaaaaaaaatctttctaccaggccagctgaagaattggctgaccaaattgtattaagagttgaagaatttacagtatgggaacattacaatatcgaaatgaaaatgtgaagacccagcgttcaggcgaaaaacctgaactccggaggagaaaatcagcccgtacggttatctcaaaacaactcggcctccttccaaacaacaatctcaaaatagcttcgaaaagttgcactaccgttcgtgatcattgatcgaaaatcgagcattgtgttcctttcacaccaaccagcctttatacaaagataatttgttctacgtatgcctctagctcgtccgaaaacacagtcttgtgctcagtcaccaacctgctagcttttaggctccagttcgctctcgcctggcagcagaaagcacacaattgtccatccttcgagcatcctccacactcgattggacggacacgctacaaacaggtgatggcactcttcctgcattgctcggcattcctgaaattagtgcgaaaaatgtaaacatatatagcggtcggaaacacatcgtttataaaaaatgattatcggtcgatctggaatttccatattttattagtttaactatttagtggcaaatgcagtatggtgctagaagaaattaaaaatagctaaatataatatgtggttaaaagtgaaaatgattagaaactatactatttttacataaacgatactcggtgagtcaagaatttcgctagcgtttttatccccaagtaggcgaaatgctgcagctgaagttgtaccatgtgccaacagtcagcatcatattatatccaagttaatgagggggtgtttgggaactagggtccctcttacaaaagtataagtccctatgatagggacttatgtttttgtgagagggactaaagtttagccccactttagtccctccaaccaaacaccacctgaatatctgcaaaaataaaactcccataagaaaatcattactctcgctccaaccaaaaatatttaaatatttggtgcttggaacaaagttcgatccaacttttaaaattttgattatcaattttttttatagatatttagtttaaaaacaaaataaataatatacttggatttgcctaaaaaaatactaccataataccataaacttaatattaaaatgtactttttacggtaaagagatagctttattgataactgaacgaagggattagattcctgattcaaccaattcaaaatccgtgcaagcacacataatctcccctcctagcaagatcttgaattcgtcgtcgtttgattaagagtatgtactaccctcttagcttcttttcctattttgtgcacttgcactctttgaaagcattgcatcgcacctttcgtttcatggaccgtcgttgccccagccgatctcgagggattcttgttctcgagggattcttgttcgattaggacgcaacaacttcagcattgtcagttttcaagattagcggcgtatcatatgaatccatcccattgccacccgaagtcaaaatttacaaacacattctaatataaaattgatttttggaactataaaagcatgagcaaatctttatctaaacatcaaatatttaaaagggagcactacatttaagtatttaacggcaccctatctgtaacttggtgatggactaataagcacaaccataataataagggtatcaatcagatcataattttctttttcgttttatcttcaactaccgctcatctcatttaatgataaacaccaaagttatttccccccaactttattctctgctacacaaataaaaatgagatgagcgtggatcaaaggcagtactcgcttgccataatcgcgtgattcgagacatgctttcagcgttcagcctccaagcaaatcaaatctgtgtgattcatacacaaatcctttttcccttttcctttttgccgcaaggaagcaacaaaatatctctgacacactctgaaactgtgacagacttgacagtcaatggaactgaaaacgcaacccccgtgccaagaccattttcttcccacagtccactgcgcgagacgggagagacggccgcgacacaaaggaagcccaggagagacgcagacgcccgcccacaaagcccactttgcccatggcaacttccgcttcactgcctcctcctcctcctcctcgcagtagtagtaaccgcctcatcgcctcctcctcctcttcgctgcatactgcatactactgatcagctcttccgttctcgcggctccagatctctgcagggtgacgggggagatggcggagacggaagaacctggccaagatcgacgagtactccctcctgctccacatggtgagggttttaccttctcctctccaacttttttgatttgctgcggcttctttctcttcacgcggcggtcccgtggccaggcctgatcatggaggagttcgtgatgggcgaccacgcgcggctcttgtccttcctgcggctcgccacggagctcgccgtgacgtcgccgctcttcgcgaagctctccgcgtgcctctcctccgacgccgcgtgcctcgacggcctggcgcgcgtccgcggccgcggccgcggacgcgagcggctccgcgtcgtggcgtacaggctcggcggcatgcggtacagctgggcgccgcggttccgcctcgccttgctgctcctcctgcgggacaagttccccgagctggtcggcgccgtcgaggtggtggatcccaccgtggccccggtggagcgccgggccatggaggagctgggctgcgttgtcaccgcgtcgcctgcgctctgccttgtggtcgaacagccaactctgatcttcatgccctacgcggatcgcgtcttctttgagaatttgctcaccttgaactggaccccagatcagctcggcaagatcgtcgttctcgggcacagtttcagtgccatggtgaagatgcttgagctcagcatttcgaagcaagagaagtgtggtgtcactgagcagagggagaaggtgaggagggtactggcaattcagagctatgttcaggaattagagctttgtgctgagatatctggtttgttcgataaccctctcttgggagatgagtatcctgatgaattgaaccggtctgtctacaatcattcatcagagaagtgtatatgcatgcactgcattgcgcatattgagagggctgccatgatttatgctcttcccagcatcttttcagttcatttctttcagtttgatcctgaagttgatattgaacacttgataccaggttcttttgcagcccatttccctttttgtaaaagcttaacgtggtgcctacatggactatgttgtctgatgacttgttgctgctttgtttgatgcagataattgtgctacaaaggtctggagttatgtcaatgtccaaatgaattgtgatgctcagttagaagggtaagactgcatactgacaaaacaattaatttggaccagtttcccatgattatttgcttgctgaattctgtgaattttaagtaaacaaaatgatgctttggtttaaagaaatatttaatgaaggataactcaagcaaagatgattacaccattttaggcagctttcttgcgtgtaccctaaaaaaagggtttcttatgtaaaatgggctattttaccgtttaagtgagatttgcattaattatagtattgctacaatgcatgttcttcttttacttcagtgattatagtattggcagattgctgcagcctgcagcacctgtttgttgttttatcaatcatcgactatgtttctaggccatctgttttatgatttttcacgtgcgctaataattttgtgggatgtattttgtcgttcgctattgttgacttcacaaattaattccttttctaaatgaattaatcgaccaggtggcatttaaatcctagtgatgcatacattgaggacaagcacttacaggaagctaaaagcatagttaaagaaatgcatgaaactatttctgatgttaggagttctgcactgtacacaaagtttattgatcatgtgaagaaagatgagagcgtttcttctcacatttcaagcatgttgggagctcatgaatgcatccaattggttatttatggccttgggagctttgaatttgatgtgaagtctcaatatcagcttgccttcgctcttcttctaaaggcagataatatattcccaattggtgacattgaaatatatgatccagcactctctcctgctgatgtcaaagcatgcttcgacttgggtctatgagtgcttttggtgaatgagcaatgccaaagaagtgttaacaagcctacacttttctttgttccaggattgaaattcgttggaaatctcattgagtcaaatttcactgctaagcaattaaataagatcattctagtttcctatgggttcaagaatagtgggaaaagtatttctgctgcacttgaaaacaggagctgtggatttactggtatcaagggttccttagctttggaaagagacaggtttctttgggcaagtattaattatattgatgaagtaattgttttggaaaactttgatgaggaattctggggagtctctgaactgagggttgagtttcttgatgttgccgctgatgtggacatgaactcaaatgtgccaagtatgtgtgtttttcttctgaactcattttttttttcggtactcttgtttgatggtggagctaactttgcagggttgtctcttaaggaaaagtttttccttaactttgaattggaactggaatataattccttctttgcttttgagtaagacctcttgagacttaagggcaatatcttgctacttaacattcttcatttgattagtgtttgtacatgctgaatcaaaatttaggtcaataagactaattatgtaatgttcttgtgtttgtgttttcagtcgtgtcttatttccatatgcacctgaaagaaagaatgttgcgtccatttaaacaagatcaaggcgactgcaaggatgatgaacctcaattctggggacaggagttccagcaccgaatcccagcaatccatcggaatacttggtcccctccacccaagggttggatcaagctcaacttccatggcactggctgctccaaaaatcgttctgctggcatgggtggtgtattccacaatgatgaaggtgcactctcctacttcatcggttccttaggtaacgtggatcagactgtggctagtattcaagcacttgaacatgggctagaaatcatgcttgagcatcatgaaccagttaaaaagctgatcgttgagggggacgatctcacggtgatacgttggtgcaacaaaatctcttgcccacctgcaagagctcatgattcattcttacatagctactggtacatggatttgatgccgtgtgagggggctggtgtgcttgctgggtcatccaaagagactaacaatgagagtgatagttcttcacaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagctgacggagaaggccaagtccgtccgtgtgtgggtgaggtagcgaaggctccccacaagacgccggtactgtgtagcatccacttcctccgccgtgctgtcgcggctcagcttcagtctctcatccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgatgccgaggaccatcacccacatgtagcgggagaggtcgtcgacgagcagcaggaagtaacgtcgtcctcctggtgtggccggtgtcactgggccacacaagtccccgtgcacgagctgagccgctccttggctcggaagctcgtctgctggggaaaggggagccgccgctgcttcgtcaccacgcagacgtcgcagagctgctccatgtggtcgaggcacggcatgcctcgcaccatctccttggcactgagctgcctcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggttcatcaaggtggaggaaagccgctgcggccggtgccgctggaggtagctcgatgcttgcgtgagctaggagcagagccggctcttcctcctccacccatgcgacgtgggcctggccgcgtcgtggctgtcgacagtctttggcctaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtaagatggagcttcccgccgatggtgatgggccccgagagaggctgtggctcatcaccatcaacgaccttgaggcgacctaacgcctcctcgatcgacatcgtggagaggtccagcagagattcgatcgagcgagcgatctgtctgtacttctcagggacgcagcggaagaacttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtatcggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgccgtggaggtgggctgctgcccaccgctctgctcgctcccgtgcccttcctcttgccagctcctcaagctccctgtcggcggtgatgtcaccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagtggtctgagccgttgctcgcctgcgctcttctgctgcggcgagctcggcgtcctgctgacgccgagtgctcaaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggagcaattttctggttttcttcatttactaaacacaaaagccatgtcctcccaaagaggattggatacatatttatagctgcttgtagcagccatgcagccatgcaagtctaagagggtgctgtcgtagagcatccaaactgaaagtagagatgctgtcctagaaaattgaaaagcaggaaaaggcaccacaagaccaagaccaaccagccaagacttattcctacagatgcaagaagtggtggcgcaatccttttgtaatattttgcagattatagtatgtctatgttagcatgttacctgccatggattcataacgatgagaaagaaccaatgatgctaatacaacagatccaggattgacatctgtttttttttagtcacctgtgcgtgagtatctccttgtgtatttgcagcttgtgtgacttgttaatataaacatgctacaacatcttggtttttttatttcagatgaacagtgggtttaaactttttactcctttgctagtagaaagtggctttgattctgcgcggactagctgcagcctgcaggttataaccctgacgtcacgctatgttgagctcccaatgggcctaacataacggcatagtgggccgttaacgggcctcgtacctgtacggccgaaacggatcggagtagcaaaccaaaggaaaaagtacacccagggtctctcaacttgtcattgggttacaaaatcatccttgagctgcaaaacccgatatacgatatacgacgtcctttaacttacaaaaccgttcactttagtgcatagacggttttgatcccgggctgagtcaacgtggaacccacgcgggccccatatgtcagtataccacgtcatcgccctctctccttcccctcctctccatttctctctcttctctgtcttctcgcaggccggccggcaggtacggaggaagccggtggggcgaagcgggagaggaagagagcgacggcggccggcgacgacgcgggagagtccacagccgccgtacagcgagggggcggggcggcgggagaaggcgaggtgggggcgaccgcgacgcagagaacgaggcgagctcggaggtgcggaaggaacgccagtagacggctcgggcaccggcgatgctcgcgaccagttgaatgggatggtgccgcagccagctgtgggcgccgcggtcgacggcggtgcgcactgctctccgtcagggtcgacggcgcagcgcggcattgggggcgccgtggccaacggcggtagcgcgcggctctccgtcggggccgatggcgcggagcggcatgggggccgccctcaggaatgacgccgccccggatccagcagtcggcggcggcaaatgtggcgagggacagcagcaagaagatggatgagatggggaagaaaagatggatgagatgggaaagagaaagagggacgacgccgccctggatccagccttttccgctcgccgccgcctcgctggcttcgcgcgccgccgctccgcctcatcgtcgccccacttcgcccgccgccgccgccgccgccccgctccatcccaccagctccgtgcgccggcgctccgctgctcggcttctcccatgggaagatgaagagggacggcgccgccctggatccagccttcttcgcccgccgccacctcgccggctgcgtgcgccgccgctccgcctcgccgtcgccccgctccatctcgccagctcagtgcgttgccgctccacttgctcagctgctcccatgggagagagccgatagacacacagaagagaaggaagggggaagaagaggctaacacgtggggcccacgtgggtcccaagctatgtcaggtgccaagtcagataaaaccagagtgaaaaccaccggggatgtgttgtatctggttttgtgtggttcaaggacgattttgtaactggatgccaagttgagggaccttcggtgtactttttccgaaaccaaaaccaaacctccaaattttctcaaaaaaaaaaaaagaaaaggaaaaagacaaacaacctccggggcttctgctctcgcccctcgccatgccaaacacggcggccctcgctggcgtgcgcggaacacgaacctgaggccctgagctctagcgcggcgccacgcgcgtctgcgtggtgtttcgcactcccatctccgaaatccgcagctgcgcacggccttgcgcgcggttgcaggccaccgcccgccgctaccaccctgcttgaccagatgcaagctccatcttcccagtgttcaaatccgtaagcactgctcaccaaatctcagtatcaagtctcaagcattcgttaaaatcagtgtgcattcgtagacccagaagtctgggattaccagtctgtgctggtcaggggacgcgaaacagctgttcgacggaatgcctcaaccagcaggatgttttcttatctgggaatcacaagctaaggtagtgccatttttctgtaaattaatcatttacgctgttttgctattcataggttttacatgcaacatttagaaaattttacttggactacgaagcaattccctgccccttgctgagttgctgtggcgcggatacttcaggtgtgtcgtggggaatatagccatgtagaatgtagtatgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatgtttgcttctgcacgacttatattccgggtggcttctgataattgtgtattcaaattccatgcatacatcactaccagcccaccaatgcctgttttgcagcaagagaacatcaacccttataccagaaaaaagatatttatccttcaagtttgaatgacggtagaacagcatgagtttacgttcaattaaattcatgggtccgaacaagtcaaaacttacttggattaacaaaaccttgtggaagacgcacaagcaaaaccaacgagaacccaaagacaaagttgcataacaaattcattctgaaagagagccattctactgcagccatcaagtgaaaccatggtcttgaatgattgtcaagtagactcagatttgatctgtagaaccggtcttcttggcgaaatgctcgaattattgcagctccatagaaagtttccccaaaatgatgaagaattggagccttttgaattcctgataggcgagctaattctgttgctgttagactgtaatatctctgcaggatattatgggagatatgattcattctcaataggcatattgtgtgtactgatactattttgaatctgactaagttacagttaactcttacctgatacctgatgcaaatcaatattgatggaataaaaataatgagaactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatggactgaccctgtttaagattcgccctgtaggtgtcgagtcaaagaaagacataggagcatgaaagatgcaatgcatcatgctcttgaacaatttttctgatgtgaggaggccggttacagctacaagaactgctcgaatcaagatacacaaggcgctgccaactgatataaatacatataccatgaactgggtggattccatttttgatttgcttccagttcgtggatggcaagctgatgccatccaatagttgcttcccacttcaaatatctgaaagaagcattgtgctgcaattatcataggaatgaaaagaccacctcgagcagctgtgaggtatgaccaatacacttgcttgctaatgtatccattctctctttcttcaccctgcagcaatttcccttcttcagtgttatctctaaatacttcttgtctgcaatttatcatatttgtgttttgccatttgctgctgatttccttttctgcatcggactcattgatgcttggtaccttttctgattctgcatgatgctttgacaaatatatgcttgtgccttttgcgttacaaacttgttcgacggcacaaaagtgagccccaaagataactccaaaagccatgttctgttggagttcttgaaatttccctgcttgtgctatccttccattttgcatcacctgcaatattgcttcaaccagtcaagttaaacatactagtttcttttctgggatccttatgagttattgagaggtagtagtatctcctagtgtggatcatgagaactgataggtgtagctactgaaagttatacaaaactaacactaggagatacctctacacctcaagcctgcaaagggctgtaaattctctaaaaggattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtatagagccaatgttaatggttatgtaacagggcttctccttgccagtaaaaatatagatatgagcaatttattttagcgagagaaataaatatcaataataatatggacaagattattgaataatcacaagatctcaaatatacgatgcccattgtttgtcctagagaacatgatgacttcttttaactatggaaaatttgaaaccatcaaagcattatatttttgtgaccctggtgttattttcttttgttggctcttaaggggaaaaggaccttgtatagatgcctcccagtttgagggtctacagcactgaaaggatcatcaaacaggtagacatcagcatccttgtaaactgctcttgctatttgaatccgttgcttttgtcccccactcatagtcgttccccgttctcctatatctgtcatatcaccatccgagaaaactccgatgtctttaaccaaggcacatgcttcaattgtccgctcatacctatcagtttcaaatgggctcccaaagagaatgttttctctaatagtcccagaaagtatccatgacgactgtggaacatatgctttggttccaaagaccttaaccgttccttgcacttttggcatctctccaagtacacatgacaacaggctagattttccactcccaacagctccacatactgccactttcatccctttgtgtatctttacatgtatatcttgaagtgttgggatttttgcatcagttttccaactgaatgctccctgatcaatctctgcagaaaattcattttcgtctattgctacttcctcaattgcatcagatcttatttcttcttcttggagatatgacactattctgtcagctgagatcttcccctgtgcaaaggcagtaagcaattctggtaggctaaa

SEQ ID NO: 13018 - DNA, 3463 bp, Oryza sativa
ggattcttgtaaaaggaatattgcaaagcattattatggctgttgttgctattccagctaaagaacccagaccaagatttttccaaagaatataagttgctagtgtaatctgtataggcatcatgaagaccatgttcacataccatgcaacattaacaatcctctcgatgtcaacactcacatagttaattatctcccctgaggtatgtttctgccttgactggcttgataaataaaggaccttttggtatacctgagatatcagagatgttcttaggcgcaaataaacctgtagacttccaaagaaccattgtctgtaagcaagagtttcaatagccttcgcacctacaaatacaagaacaagagagtagcctctttcaaatccattatctccacttagatagcccacgaagtccttgattaagtatgcccccacaaaggaggcgactacacttaggactccaaaggttgcattgagtgccgccttcttccaaatgagaaggaaggctgctttacaaatcgatgaaactgtcagaggaaaattccctttcacaatgatattactgaatattctggagatgtgttgggcactttcctcctcaccaacatctggtatgtcatcctcattcaaaggcttattggcacctttagcaagaagaccattcatccaagagaaagtgaaatgttgtgaaatagttgcctctccataagaagatttcctcctgtttttcacattttcttcttttgaagcatctggaaatggttcttgtgtgccgcaggtgaattggatccctgttttgcaatgaacaaacgtgtatttgtacaaaaggagaattaaaaaaatctgatatttcttctggttcaaatgataattgacacaagtgtgccattttgcaaaaaccatacctttaatttcattttatggtacgtatgccaagtaaaacttgtgaactacactatttagttgcttagtcataaagaactcaagtattctttttttgaggaaaagccttagaagaggacagggagagcctgttttcattaaagaagaagagacttggcccagtttttgaggggaaaccaggcccaaaaacctcagaactcaagtattctattatatgaaacttaataaactgcgtcaaagctgtggtcttcttttctgttgttgcacatcgcaagtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaaggtgtacacctacggtcattttgatggaaggtgaaggggaattacctcaactgaacagaggatgctggttatacagaactactaacatcgtaagaacattctatgattctgatgcagacatacagtacagttttaatctaatcaaggaggacgccatatgtgggacaccgcagcgaagtgtaaggagtcctagaacatctaccttaggagttaagagaatctatgagattgtatgtataaacatcaggtttctgcaaatactcttatctaaattcctaatgcctgtattgcaaatacatactttcagttcgcattaaagtgtgatagtatgtatgcacctttgttctcaggtagcttggcaaaatggcaggtcagacggatcaagctgctcccaggtattgtgttctatatatcattttcttcttgtgataatgttgtattgaaatgctccatcaaggagcgcctttataattcctacgtgtaggttaatcttatgcagtattattgattctattgtgtcccaaaaaatactatctattcaacttgctggttctaccgtatctttgtggggacatagtgaaatggttgtgatctgctccggaaggtaggaattccttccaaagtatttataaatgactaggaataattatttgaaaaacttctatttcagtagaaagcacacgataaagcaagattccattcacatgagcatgacaaaaattagcatgaatcttacctgattgatttgcagtttctttgtacaccatgttgaagccgttggcttcagctactgtttcgactagagattgtccttagctgctgaacagtaacattagtgtaaatcagcttacaacttagcacgggggactgccttgctagtagtttccattaggttatatacttagatgtcgtacttggattagtacagtcattaagtgcttaagtgcgtgtaaagtatgcgccctctaatgctcgattacttggctaacttttctggctcgacgcgtgtaaagacagtatcgtatgattcggatccaaccttgaggctcagatcaatgacagatcggcaccggtgtaccaatctgaatctgtgttgtggtggatgatcaaacgatcgagtataaatattccgttatctaatgtgatagctctgctttcattcgctacatgcaaccttttcttcataacaagtttttgtaaacttataaagctataacatatgtctacataaactagttcatggttaaaaaaatctacgctacagtggtatttacaactctgtttacatggtcactcacttcaggtcgacatgaaaaagatcgatttatcaagccggttaaaataattgcctaccatagtacttaaataactcaaactatcaaagttcaaagataatggtgtcttagttcgctcgcacgataggtaggccccaagttgatttgtgagaattgatagacatgtgtgcgcacctagagtagtggaatggcatggaagaatccggacacatacttgtttggtgccggaacaagttttagtttaggcaatttgtaaaaggttagtaaaaaaaaagttcatcgatccagtctacgaacgtggttgcatacaagtgtgataagcactggtggagaaaggggctttactcccggttttcaaaccgggactaccaatccgggactaaagatcactatctttagttccgggtgaaaaaaccgggagtaaaaatacatctgttaccaaccgggactaaagatagagctagcctagctagctagatccggttgctctattatttttttttcttcattatgtttttaatatattgattttactatatccccatcccaaaatcccaaataaattatccccaatcctcaaattccaaatcggccatattcaaatagatcacaaaatcttaaaacaaaattacatcacaacttctacaaaattcatcataaatacatcacatattcacggacatcatacacaaatcaaatacacagatccgaatcacaaattcttaaaaaaaaaaagaaaaaaaagggctgcaggaa

SEQ ID NO: 13019 - DNA, 7599 bp, Oryza sativa
ggttagtaacaccacccggaactaaagatagtaggcatcttttttcccggttagtgttaccaatcgggactaaaaatagatctttagtcccgattggtgttagattaaaaagcagctctaaacttttgaactgggactaaagataatatttaatcccggtttttattgcaaccgggactattgtggattttggctaaccgagcaaagatcgtttctccaccagtgaaagttactctcaaaactaattcaataacatgtggtgagcaatgtttgttatcataaagtgataaaccattgccgtgacaatgaccacactcgtgacggtaagcagggaaattctgtatggtggcttcccaaaataaatcaaacaattattccctctatactaaaacataaggatttctagaacagtgtttgtattgtttgtgatatttaaacacacattgtattgtttgcactcacaaatacactgtaaagtataaatttactagcttaaaaggtaataggattagtttcgtatggaacgcaccgtttgaaaaaagtgctaaagaaaccgaggtaaactctataccttaatgagagaagaacagtgcctaccatttgtaatttttatccatagttcttcgtatattttatattatgagacgttttgaattttttttaaaattaatcttctctgagttttattaaatttgtaaaaaaaaagcaacatctataatactaattggcttcattaaattcaatgttggatactttgtctgtttcatacgtaagtcattctaacatttcccacattcatatatatgtatatatatctagatttattaacatatatataaatatggaaaatgctaaaaagtcttacattatgaaatggagggagtatattttaataatatatttgttttatctttaaaatgttacttttttatataaatttagttaaaacgtcttaaaaaagagagggtagcaaactatacctggttaccatgcgggagtcatacggcctcatcttttcgtttatgcttatacttattagctaaattttgaattttcaacattaaatttggagttgaatttagggttttttcagcctttgcttttagatcactaagaatacgtatataaagtctttattcacatattattttccgtttgtaaatatgcagtttcgtttattccgcgaataagcgaaacgatggggccagtatactcgtatcattcgttgttaagggaactagctgttgttgcaccgtaacgccgtagcggccggctgctgcagaaaaccaagccccaactttttctgaatggcaaccacatctagcattactaccgagcgaagctgaatcaacaacaacaaaaaaacacacacacacacacagacaccactaccacatatacgcgcgtatcgtccttgtagaaatcagaatcggccgacatgatcgcgactttttcctgcgctgtatggtgtgtgagtgtgagccacattggctaataaaaaaaacgagatttgaaatgagaaatgtccctccaacattttttaaaaagaaattacgatttgaaggaagatgtttccctccaagtattttttaagagaaagttgtgaatgtgttaagaattgaacatgaaatcttgaagttaaaactacaccccttgcaactgcattattaacaatgtgagctacattgctaataagaaactgttatactgctaaaacactgttgtggcaataagctaagccaaccacacacaatgaaccataccacagttaccacagttaagttaacgtgacaaaggccatgttcggaactataaattctcacttttactcgcatgtttcgctatgcacatgtttttcgaaccgtaaacgatatgttttataataaaataaaagttattttaaaaaatcatattaatattttctctaaaagaaaaactaaaactttattaattatattatgagttaatggactacctcgtttttcgtgcgagcataagcttctttcgcaaacacagccacgaagttatacaaattttgacaatttgaccctttgcaaaaattaattatacaaatgaaccgtggccaaaacttattttaaaaatgacccttttgttcagtgcgaaatcccatggcgctgaaattagacacctcagcgccaaatagcacggcgctgaatacacattggcgcgccgactcagactcccatccacggtggcacgacattcaattccagttgacgtggcgctgaggtgtctaagttcagcgccataggatttggcgatgaacaaaagggttattttttacataagttttggccatggttcatttgtataattagtttttgtaagagcaagtttaatagtatagccaactactaattccaaattatctatagccaatgtaatagccaattcatacaatacttgcttactatatatactattaatacctgatcccacctgtcatacacacgttacgtcttggagtccgtgctatggttacagatctgtagtccgttactcttctctctcttcctttatctctttaaaatattactcttctctctcttcctttatctctttaaaatatgtttatagttggcttatagcctgctattgtacctactctaaagggtcaaattgccaaaatttgtgcacaaagttaagcactgaaccaaccactggctcacttggcacgccagtttttttaagagagaaaattgtcagataggcaatgtggtgcaagcggttagatcaacgatggacgatcccgattagcccgcctcgcggttcatccggagaatcccaatattctgaccgccaccgtgtccctctacccgccgtcacccctgggcttcgccgccggcgagcgaaccccgccgctccccttccgaatcccgggccgacattgcaagccggtgggcatcgccagttcgccaccgccatctggcttctgccctgaccctcccgctcggatcagcgcgtgttaccgcggcgccggatgaaccgcgaacgccgcctgcctgctcgacggaatgcctgagtggagtgaggcacgctggcgcgtaagtcccctcgctgaaaatctcgctccgttgtattacctttatttgtttttcaagcaattacattcggactatgagtagcttcgctgcattgcatgagttgggggaaagtttcccccacttcagcttgagctcatacttacagtactctacataaattgtgtttcttttctttacttggggatcatcctgaacctaagagctagccaacatcaacggtaggccccttagttggtgtatatttctgtgggttttgtgcgttctttgtcatttgggatcgtgtggagtgcggcccctttctacccaagtgtgttgttgtagtgcgcttggttggcttcatgctgttctcctcgcttttcaaattgtagtgtgccgcactgctaaaagccctttgatctccgtgaatactcctttatgagcctagagaattcagagttctcgttctccagtaatttcaatggtgtgtcgtactctatgattcttcctgctcgtcagataagagcgcacaatttagtggcatgtaaaaaactggcatgtgtttgtcaagggtgtggcttaccttcactgaagacaagaatgagatcactgtcaataactgtgtgaattctatgtgctattgtcagcacggtgcaatccctgaattcatcgcggattgtttcttggataattgcatctgtagaggagtccactgaagcagttgcctcatcaaggatgagaacattacttcgttttagcagaaccctcccaaggcaaaacaactgtctctgcccaacgctccaattttccccattttcgacaactgcagaccaaatcttatttgatcatttcataacttgtggtaggatttctaatctgatccctacttttctcaaattttaccactgaacccaaaaaggatacattacctgttgaatccagcttcttcgggctctgtcgaactatatcaccaagctggcatttatccaatatctggccagaaggagattaaacaagatagctaatcaaataatagaataattgtattctgataaaaaaattaatagaagaattaagtttcgttttctatttgacacagttactactcactatacatcacattcttacagtcttactatatccatattgatttcatagcaggtacccattatccatacatagcaaggtgttatttaacatggattatgatttataagcaataatagctatgatatggctaatgatatgtagagtaaagctctctacttcatatgatgaaaaacattttatttatcatgaaagtgtgcatagttggttaattacctcccatatacgttgatcagagtattcattcactggatccagattccctctcactgtgccttcaaacattgtaggatcctgtggaatgatgctaagtctgcctcgtaaatcatgtaaccctattctgcaaatgtcaatattgtctatctcaattgttccctcccttggttcaacaatccgaaaaagtgcttgaatcaaagttgactttccgcttccagtccgtcctacaatccccacctttttccttcctggaattgtacatgatatgtttctcagaacagatgggagatgctctgcatatcgaacctgtaaaatagtaaaagtgaagacggcatttggatggcttcatttgagcaaagactactaatttaagaaaatttataaataaactttccttttattgtaatattgatttctttcattatacagaaatagaaataaattgtcacttttatcatttctgtttccgattcaagacactctttttctcttatgcaaacatataaaagtgaaaccatgacaagcctacttcagagatttttgtatgcgttcttgttctcctcttcaatagaatattatcaggaaataaagcaccttcctaagatatgttttccttttgaaaatttttcccgagtagtaattttcatttaggcatttattgttctttttcaaacttatattgttttctggtgaactcatcctgatgataaaatttattttatttctgctaaataaaattatatttgcattataaactttcttgtctagattcacagctcatagcaccattgcacttacctccaagcatcttatattgatatttccatcaagtggccagttgtttggggggcggcgataatcaactactagaggagcctcactagggatccttgagtactgcaaaattctttcaactgatatcattttgttctctgtgttgcagatgttccaaataatagatgccaactgtgagttgaggttcaatgcataggtcaccgcaagtccagcaatgcctgcatgtacaatatataagtttgaaaacagccaacatagagtgacttaatgcttccataatcaccaagagcctaagttcttcttagagcttacttggatttataaaaccttcaggaaggctcactagcagggtcaaagagaaagcaaagacaaagttggataacatgtttagcctgaaagaaagccattccattgaagaaatgttatggaaccatggccgggagtgattgtcgacaagtccaaggtttgattttctgaaacgatctttttgtccatatgctcttatacttgatgctcctgtaagcgattctgcaaaatggtgtaggatgggagccctttggatttgtgataaacgagccaattctcttgctgttggtatgtagtatcgctgcacattacacagagtatatggtttcagtattttgtgaatgaacgctataatttatggagaaaaggtgtacctatagcttcttggaactcatcgtggtgcacagagtgacttttgcacatggtgctatggtagtacaaaaggctagtaataaagtttttttttcttgttgggagttcatacctgacacatgaaacagaccaccgttactggaacgaagatggcaaaaactggccaggcaacctgggacataacaccaatggtccccagaatttgtatgactgaaaatacgcaccaaccaagcttgtttgctatttccagatctagaacactttggtcattggaggcctgttaaagcataaatacacacctattagtttaggggtggagagagtacgtgatgcagtataaaatggtttacaaactaagtcagtcttaaccctgttcagaattcttccagtaggcgtggagtcaaagaaggacattggggctcgcatgatgcagtggagcatgttcttgaagaacttttctgatgttagtagcccaattagtgaaacaagcatggaccgagcaaagacacacaaggcacttccaattgacaatgctatgtatacggcaaacatgagccctaatccgacagttggcctggttgctgatgttggaggagatgcccatgccatccaatagttgcttgctacctgaaatatttggaagaaggactgtgctgcgattgtgactggcactaaggcacctccataaactgccctcaggtatgcccagtaaaccttcttgccaatacctcccttttctcgctcttcatcttgtgttaacctccctttctcattgatgtcctgtgatacatcatgtgcagactcttgctttgttataccctgaatttgatcatctgtttcattttctgcttcaaactcatcatcagtatctgctggtttactgttctcagtggatgtcactctgctagaactttcggcatttatgacagactcaagagcctggctgtgggctcccactatggcttcaaatcctatgttctgttgaagaagctcatcaaatttccctttctgaacaatgttcccatcctgcatcacctattttttgcatcgacgtgttattatttaacaacactaaccttttgacatgattatctaccaaaaagtattttagatacataccagtataaggtcagcggtaggaagaaattcaacttggtgggtcacatacagtattgttttgtctttaagaattcccatcaggcaatcctgccaaggcaatttgtttcatttgcttagagtctaacgattattggtctaaaagtaacgaaataggttttgcccttttttttattaacgttatgccacgaagaatggagttaatgccacgaagaatggagttaagacataaccttcatacttgagcatttattgaaagttttaaacaaacagaacaaaccttgaaaagttggcttccagtatgagcatccactgcactgaaaggatcatcaaaaaggtatatgtctgcatcttcatatactgaccttgctatctgaattcgttgtttctgtccaccactcatgttaattcctctttcaccaatctccgtcaaatcaccatttgcaaacaactcaagatctttagtcagcgcacaagcttgtattatcttgtcatacttttctttgtcatatggatttccaaacagaatgttgtccctgatgttcccagacaggatccaggcgctttgaggaacatatgctttgctcccactgaccctcacagtcccagctagctttggcatctccccaagtatggatgataatag

SEQ ID NO: 13020 - DNA, 2621 bp, Oryza sativa
agcttttcttctaataaataggaacattgctgtgtaaattgatttagtatttagaccatgcctgttctcaacatcatctatgatttttttgaatgaatcagaaaggaactcagcggagtccttcccatagacatctggcacatcattcttatctagaggtttcttgtatccaatagcaaacacagggttcatccaggagaatgtgacaagttgtagaagatttgcttttccatatgggcatggccttttgatttctgtctgctgtcctgtagatggactcaatagtggctctgttatgctgttatctacaagggtgattcctgtttttcccctggcggaaattacaaatagaagagtgcagataacaagcatgaacaggttaatccatttttcaggtcctaaatattcatgatcgagtaaaatagacctgagatcaaataccacactggtaattgattgcagaaagctaaatatccaccatgctcgaattataaacggaagctttgcggatttcgtcttctgaaaactgaacactactagtgataatattatccaggatagcacctgcacactttcacctagaacaaatgctggatatttgcagtcacttatgcttccttgtaacaacaaaactactatcttcagagtatgacttgctaagttaagcaggcaacaaactttgcttgcttgatatgttatacccagctttttgtctgtgttcttctgttcctgatatgaatgcttgctttcagcagttgatgtcttaaatctctgcctgcaccaccttattctcttatacagaaactgaaccaagatactcatgatgaatatcaggtgtatcagtgcaaaagcgtccatccagaagcaaggtgagtacatttcttgccattcttgcaaatgttgcaatttagtggaatctgtaatgttgcaatgtaaatttatgtgttaagaactaacaggagaatagatttgttcaagagtcatttttcatatacccttttatcaaaagcttttactacaatgaaccaacacaaagtattatcgttggcttccagctaaagatacaacttctcctaggaatccagtgtactgaaaagaatattccatttccctaatgacaccataatatttcttttaatccattcaaatgttttgcaaccataaatccatgatatctagtaatgttatgtaagagactgtaatatctaataatgttctggatcgtttcctgtagttatatggatttttcttttaccaaagtagttatatggatatgagaacagaaagttaatcactgattgccatgctgagttttccttaaggaacatgtgtatggccacaagcaaatgtatacagctgttctcatagtaaacatgtaacttctgcgtgttatcccacctatcaacatgaatacgtttaacagaaccacgactgttatgaactgcaaccacgtattggtccttgctgtttcctgtctgctaatggttacagatgcttggattgttcatttgttcacattcttcttatccatgtgaagaatgtatgaactcacccaacatgagaaccccaaacttatcatgaacctttcgttttttccagttcccctaatttcttttgcaaacattttgcagaggcaggaaaaaagaacaagaagggaaaaaggagaaacaaagataatagcaaagaaaacccatgcagtgcaatcaaactcatggatgtctcggcggggaggaatcagacgtatgcatgaaccaatctctgcatgcagatgcagggtatgattaaaccttacttgaagaatcacggagcaatccccagcggagaaacgcctgctgcgccgtctcgggaatcctcgcgagaacatgcaagtgcaggctcgctccttccatggcgcaatgcgaatgagacaggggaggaggagagagggagggagagatgggcagtggccgtgaactggtgacggtgatatagaaggtggggaggcctgagtccgcgctagatggttacgggttttggcgtatcacggtacacggtgacagagatccaaaaatacggttttcaccccggtaaggcctggttcagttaatccctacgagatagggattggaggggatttattccacacctattgtgatgtggaattattctctctcaatcccctctaatcctctttaatccccacaccaccgtagaataggggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacttgataaattaaataatccgtaaattttttaagtgcttactcgcatgtggtataattatagacatcatgcatcctcaacttcaccattgcatcttagggctgcagga

SEQ ID NO: 13021 - DNA, 1818 bp, Oryza sativa
aattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagataccgatggcatatctcaaactttgaaaaattataatggcatagttctaaattacccaaaaaataaatctaatattggatgtgtaataatttggaaaacgtaacagctccacgccctccgccccccccccccccaacacacacacacggggggcgaaaccctagcagcgccgccgcctttcctctccccctcccccacctcgccgccgccggagctcaccgccggaaagccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggaggccgcggagcggcgacaccggcgcgacgaggcggcggcgacggcgacggctacggcgcggcgacgcgacgacgacgacttgcacggcagccagcggcggccgccgcgacggtgagatgcgcgcgggcggcggtgctcgcaccgccgggggcgagcgacggctgcagcgccgccagccctggtggcagcaggccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgacca

SEQ ID NO: 13022 - DNA, 5263 bp, Oryza sativa
ctccggcgcatgaagactggccggcgggggacaccggtgcaggggtcccgcatgtcggcatagctggagaggtggtggagcatcggtgcgtcagccaaggattcgcaggtggtgatcggcaggtgaaaatctagtccggccttggccgggccgacaacgatggttcattccccctcctgagggcgttgtcgtgatgtctcacccttcaagggcggttgccggacgaaagcctagtctcggcttctttgaccccgacggacggcggcggcggttttttccgtcgcttcttttcttgaagacgtcgtttttggcatcccttagagggcgatcttgtctgtgttcctttgttagtctagcagcggtcggtcacgcttagcggtggccggtccggtgctagccttctcccgggttgtgtgttggcgctgtcggtgtgcgggtggtggtatatttttttcctttttcctggttacaaccctatagagttgtaatcttgtaattttttcatgatctatcaatagaacttcgcaccgttaaaaaaaatttggaaaaccgtatttctccagcgtaaagtaataattatattaacaatcatttgaataatgaaaaaaggaacaggccactgatgcgagatggcgatgccgcagcctaaagtcgtcgtgccgattgctgtagctggccggaatggtccgcgtgaacagcagcgcgaggagatggctcagctgcctcagaggctgggagccggagctgcatagtgctacagcgaaaggcagcaggggaggcacgacgaaatgggtatgagaaaagcaccgtgacagcgtccctttctccggcgcggatacctacgtgagcgaaagtgcacatagggttggggtcggattgaagcacgcgggagcgggacagcggcaagcctgcaactgcaactgcaactgtatcagaaattcgtcgtatcagtccatcagaatcagaccgatctcctcgtgagctgagctgctgccacgcgccatttttactgccatctcgttcatcatcgatcctgtcaaaattacggctcaaatctccgttgatacaacatggtttggagtttggactgtaaattcgtgccgattcggaagcaatcagagagagatagagaggggatgggtggtgaggtgatgtcactgcttagttcctgcttcttgtccgtacccatccgccgctctgggaggccgcgagaattcattcgctcaccgcctcacgatacggacccccgatcgcgacgcatattccaatttatctcaaaatacacatattcccatttctctcatacattcgttcgcgcgagtgtgggctccgcaccggtccaccaacaacgtgctactcctacctgcaaccattgcactacaagtctaccacctcccttttaaaataattatcgctattaattaagtgatgtagtatattttaggatgtaacgagtacaatactactagtagtaacatcctaacagggcaacacaatgattaattaactcatcacctgcagttaattaattagtgagccgctagccctgactcacttttcggcttgtatcaacgctggcgatggccgcgatattctcgacgccgaccgctcggaccatcacatatacggcctggccatgatctctgcagcgcgacacgcaagcagtctcagtgcacacatgcaaccctatcatgcatccggtgcacagtgcaagccgttggatgtctgtcgattcagttcgtacgtacaccggcccgtgcgctacataatgcatgcatatgcacgtagtgtgatgtatgcaagctgtaggtgggtacatgtgtcgtggtttctttcgtaccgacccatggccgagtctgtacggccattaattgcacttggaattttctagtaaaacgggtcaatcttgattaattagccatgtgcttaccttctactccctccgtcctagaaaaaaagaatctagtactgaatgtgacatattctaaaacaatgaatctggacagatgtatatccaattcgtagtatgtatcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacggagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgataagacgagtggtcaaacattgcaagcaaaaactcaaaatcccttatattatatgacggagggaatactaatttctaaccctgatttgggtgttactttccacttggcaattcaaccaactggcgtacattatactgtgtcttgtcatctgtcactctcctatctcaaaccagaaatcactttgccgtgcatgcaaaggcagagcaactccatgtgtagatacagaaaatcggtagtaacataagtcatcttgtgtgagatagcttttcgaacatatagatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggacaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtttttttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaattatcacaaaactgtaacttttatgttatatgctgctacagtacatatgtcgtggagggccgccctgcatgccggtgtgcttaggaaaacggagaaaagaaaaaggaagggcgaagaagaagaaaaggcactgacatgtggaccccaccacgccgcatcagcgaaaatcgcctttaataatactgtctgggagtcattttgtacctgttttaattgttgaaaatgctgttcgtcggtcgaccgacgggggagcaaaaaatcgggcgctccccccgcggtccgtctctcacgcacatgcatgtatattctgggtcccaccatgatctttattcccacctaccatgtgtctccatcacatactccattgcaacaaatcgctcacatattttgaaaaccctttattaagggaattcgtttcattttttgttccaccaaaaatatttcaactaatgtattcacaatgtttcactatgtatagatataatgttgcagtg

SEQ ID NO: 13023 - DNA, 11702 bp, Oryza sativa
cccccccccccccccctccccctgcggccggtagagcagcacgagcgcgatggccggcgcatgacgagcgcaattggcggcgtttgcgattcctagaacatgaaaatcggacgaggccgctgaatccttcgagacggtgccggaatacaacgagtagcagcaacgcacctcgccgatgtcagcagctaccagcaggttctcgtgcgattgctcaacggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggaccggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcactctgtacacacttaatacagtgaatatattaattacaggaagctgtcccagctagaagaccttttcttgatcaattacaaagcgagtgctaagctaggactcgtcagactgatggcttgcgactcagtcagacgatgctttctggattctgatcttgaagcaccaatgccgctgctgagaagagcatttactggaatcggagcagctctacgtcttcttctcaaacgacgatccgatcctgcccggcgcagccgccggcctcttggcgtccctgctgctcgagctcgaagcggagtgatcggaagcagcaggggaagaagacggatcatcgtcggcgcgcttcctcttgagctgatcatggcggccaggcgagcgaagcagctgccgcagcacgtaggacggcaggtccttccggcggacgtgcgccaccgcgacctccatgccgggcctccagtagtcgtacatgtacacctcctccttgaacccctctgtcgtcgcgcggaggtcgaacagctgatgctgctgctgctgcggctgcgccggtggcttggacaagcccacgaagaaggacgacgtgcgccgccgccgccgcggctcgttgtggggctcggcggcgtacggctgcgggtgcaggtggcagagcagcatcccggacgtgtccgcctccaccctggccgacagcagcctcagccgcgactccacccagcccttccactcgcggaggtcgtcctcctccccgccggtcaccgtcacgtccacctggaggtagctcttgtacgcgccgaagaagttgaacggctggaacagcttgtcccacccgccgccgccgctgccggccttgacgatctcctggcagacggcgtcgccgacggcgagctgctcggtgatgacgcgcagggtggcgtgcgagacgttgtagccggagttcatgcacgggtacgccggcgtcacgatgggcatgaggtgtatcttgtcccgcggattccggcgggggtcccagaccgggaggctgaggccgagctcgccgtcgtcgtgctcgatggcgcgcagcatcaccgggctgggccacttccaccgcgcgaagacgcggaagaagcgcgggagcagcatgctgggggaggcgttggggtagagcaagcacacgcacgccacgaggatggcccagccgacgccgccgaggaagcccgcgacgttggagtagacgccccgcgccttggcccagtgcttcacgcaccgcagcgtggtgcggaacgcggcggcgtccgggaccagccgcaggatctcgtcggccacgcggacgccgttgaggctgcgcgcggtggcgaggtcgaggccgcggagcaccgaccggccgctgaggtccaggtcgccgggcaccacggggaggcacacgccggcgtacacgaggtccacctgcacgccgtggaacctcatcttgatcacgggaacgtgcgcgccgggcacgggctggagctcggcgacggccgccgtctccgccagcgcggcggcgagcgcgccgaagaagtcgcggtcgcagtcgacgtaggacgggccgacgacgagcgcgtcgatgtcggagccgcggccgtggacgccgaggcggtaggagccgaaggggagcaccagggcggtggcccggtcggccatgccgtcggggtacccgcgctgccgcgtgaggcgcttcacccagcggtcgacgacgccgcggaggccgcggagcacctcctcccgggccgccgtctcctcggcgctctcgtacaggccctcctcgcggaggagcctctccagccgcgccgtgctctccaggtcggccggcgtcgggccgacgagcgagatgggctccgcgacgccccgcgactgtggcgactgggaagccattctctcgtgctcagatcggcggcgcgccggcgcggtggcgaatcgggtggcgtggtgcaaaaagcgagggatcaggagagggatgcgagaaatggaccaaatgggagcttgacttgaagcctgcctccctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaatgatcaaatgtttgtcaaaagattaatagccgtatattagaaaacaaagatactataagatgtccacggatataagatggtcttaagtctctcatcagggcaactgcaatgatcatattattacctttttgtttttacataactagtggcatactgccatccggaccgaggtcttcagtccttgcaattgtaattagagatattgtttccaaaatttacatgcttggccaacatatgtcaataatttacacgtaccaagtgaacaccctaatgccttcactaatttactacgcaggctgacagtaaccatcgcctgtgctgttaacactaccaagtaacacgatcaaacttggctatggtcaattggccactacactccaaagcaaaagcaaaatatacaacatatatacggctttagcctaaaaacttgcaaaactttatctatgacacgacctattgtacattcaatcgagagcttgttagctctcgaattgactgtacatccttatttgtcagatctaactgaccgccacgctcagctaccttctcaatcataagtctcaacaatgggatcgttgaaagagttgcagcggatcccaccatgatgagcttcttctgcaaaaataatcactaaaacttaagttgaaataaaaaaagggtagaaatgggagcctattaacgcagagtaatattttgcgttatcaaggcagttgtcattgacagagtttgcacatttgtgtttcaaatgaaaatgacaagcatctaagttagatcaaacatggcatgagtacatcagcatgtcttctttttgcaactattcaacaaaattatgtgttgataatcatgaaagaccaaaacaatttaattataaaagaacgtggttttgagaaatggttgaaatgggaaaaattcattcgatgtactttacctttgcacgtgtcaagacaacgttgatcctgtgccaatcaccaagcaaagaagaaccactagcccttgtattcccgttggaccgtacaaaagatactataatgcattctttatccctcccctgaaaagagtttctgttagagctgcaagttacagagaaaccacaaaactaaggaaccacaagaagcaaaacatggttgctcccaaagcctggacagtttttcactagtgatgagggtaacagaataaccataatgaattactaagaaacagtgcaaattcaaaggcactgattcttctatctttttaaataatttaaataactttttacttatgatctgaatggctgctttaaagatgcatgcatggagccatagatgatttgagatgtaaatgttcactagaaccatgtatcaaagaccaaaatcactcaaatcattgaaacaatcttgaagtgttcagatcattgaaacaggtgataatgataatgaagactgagaaaaaacaaatgctcttcatttatctaataaaaagatgaagggaacttttatcacctggtacttgtcaattgtatgaacctcaactgaagcgtctacatgttgctgaatgagatttgcttgggcattatatggagttattataccaaccccatcttgagctacacctctctttagcaattcattggtgatctacaaaaaggatgtgatcaaattttgaggatgaaagggaagtgatgatatttcgatttttatataattaggctcaatatatgtaggtaaaaaaaggatgcacaacactaagcctcagcacaagtttgtggaccagagcagtttaaatcaagcgatattttcctagcttaaaagatataagataattagatattgctaattatttagcatggcacaacaaaagggcagaagcagtcagcaagacagcagcactatgaagcagatgaactttttaagtacaggattttaactagtagctaaagtttactgcttgcttgctatattgtccacaccagacatagatcagggcatacccatgaaacaattaatgcttctgtaggattgttcacagttctatgttccttggcctcaaaagctggtacttcatctgcatgatttgcccacatgattagcattgaaaggcaaatcaaaaggacagactaatcaaactaatcaataacctgtgttcgcaaagacgacagccctatcagggttcaagatctgcaatttgaagtcaatgaaaaattaaaactgctcctggaagataaagcgcatggcagtagaaaaacacctgacataacaaaaaaatgtatctagtaacagagtacttatacattaagaaataggccgcagcgctacctctttcagcttcaagcgaacaggacctctgccagaaagcttgagtttggcatttgcaatttccaacgaaccacaggataacctattgccgtaaatcaatgaatttgagagctccataatgccagatgacattcggtactacaaattggcagttgcacattgtgagttttagtgaaacaaggggtcttcaactcaacagaaaataagtggaagtggaaatactagataagtaagcataagtgtgatattcaaatagagatacctggcatcgcaatgctgaaattgcttgagggtgtgcttctgacaacctccaaaataaactgacacccataccattctctcgagcttcagaactctgtgatttgtttgaaagaagtaataaaaaaaagggaaaggttggtataaaaagcattaagataatgagtgtacaagcaaagcagtgaaaacctgaacaagtggaggaagctgataatgatctcctactagaacaaactttgttgcaagcatcaaaggtcccagagatacctagtgagtaaaatattacaatgtgagaaattataaatggtataggatgcaagactctttagaaaacaattttacagatcattctggtttagcagctttgaccaactaatgtagtcttgaagttaaatgaggaccatcgtgtggatttttgtggtttccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgctccattctagctttgacggcatctactgattgtatatctgttgctgttcaaaaaaataaataatcaaacacacattcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttatgcagcgatctctgttggtcattgttcaaatttggcaatgattgtatatatgatagtgccggatcttgacttaggagtcctccactatcaaatctgggagcctatcaacatccaaataaggaaattacagacaacaaaaacagtatggagaaacatagcacgaataggctagtggacgaacagacctcgaggtcaacaatcaacttccttaggtgagagttttgtggattctcagcaaatagttggacaaggttgagtctggcaacagttcaaatacaaactttatttaggaagaaggaacttttctaaattactaattcagaaccttcaacaaaaaaaataaaacaagggccaacctcatggtagcaaatgaagaaacagactcatccttatctatacgccaaacttcacattggagatctccttgctctaacaaggaattacttcctggaagtctcagacgtcgtggcaatgaaacctacaaaaattccagttgaaatattaataatcaacctaataaattgaaatggatgcctaagcaggttcgcaaggtcaggtaataccgttatatgggcacggctgaggtcccttatgtatccatttgcaacagctattcgcccagattttgtgctaagcacctaatgaaaagtagaagaaaacatgacacacttcattatggagaaaaataaaccagcatgcatcactataatagctaagtatccatgaagcaaaggggtgtgagctactatatgtgtaataacgcataaaaaaatgacccctttgtggccataggcctacagcactaaagtaaacatcacaaaacaggaggataaaaacaaagtaatataacgctacaatactccaaagtgttagctggctgttgctgattgatcggttagcagtagctgcagaagttttcaactggtattatatttgccatttaacctccttatatgcactgagcatattctatgaacctatagttctacttccttaccaacattaagcacataacagttcaaacggaaagaaccctacactccaaacaaaatgagatggagccatacattacaaatttgcaatatggtgtgccaaatatatgcaataaaaatatcaatgttgctgggaacttgaaatagctaacatagtaatgttgctgaatattgaatacagaaagtgtacaaggtttaccacagaatcaccgcatttgaggctaaaatctacactttcaacatgttctcctggctgatcagctgtctcaggctgcaacttctggcgcagaaaagtatatatgtatcttttgctttttccagatgaatctattgaatgtccatttgtaacatcaaggacaaaataagatggggaagaatgcctgctcccagtatttgaatgatgtggctggaaaatttccttcttcttgacctgaattttgcatgagatgagatcaagagagtacaaatcaaatacacggcacgtgagaaaagctaaagatacctgagaaactctagcttcaagatcgatcaatctgtcccagtgtttaagaaaggtatgatgtgcaactgtcaagtgattcacgagattatcaaataaatcaccaagcccactagttgcagcattgcctccatgcgcctgttgcatcagaatataagtatggcttttcacatgtatatattatgtaattgaacaaatttgtaccaacaggactgtatcaaaaaacacatttatattaaaaagaatagagttattgaaccttgtggtatatggtgcatgaaaccaggtgtcgacatccattacatgtagatggactctgaaagaaagattttgtttgagttctaacaaatgaattacttatgtacaagtttttagttccacctgtatcatcgggggaaaactctgtgaaatcgatgccttcaggatctcagtggcaagctcattccgacgcattattaatccaattaaatcagacctcttgactttgatgcccttcagaaattaacaagaaatggataaggatgggtacagaatttatgttgagtgtcgttttagaagattaccaatgtttggtctgtgtgaagataatacagaagacccaagtcaatatccttgttcaagtatctgaagacatggaaaagcatggtaaggaatatatatatatggaaagcctgcagtggaagaaatagatagatcatacctctccgtcatcaatagcgtgtacaatatcacttgggcagtgtgttccacagctgtctggaaatatataaaccattgtgaagagcaatagagaagtaactggatctattctgaaggactaaattgttgttttttcagacatggttaggtaaataggagacactagagtgctacacagtatgtgaaacaccacaaaaataacacaatattcttttcagaaatggacataaagtaaagataacactaatagtcacaatcacatttcaaaaaaggtatcaaaatatatatttggatgccgctacatgtgacatgtattaattatcaaaactactgaaggatgttgaccttgtgaaagtagaatggaactgaggctccggattattgattaattattattttgtaatgaactatgattgggtttttttaaggtacgattagttgttgtaggacattattattgattggttgttgccacagaatggacatgactaggtggttgacaggtttctagtcaattgtaactaaagcttaaagttttggataaaatagagcagggaatctaattcaagtaagcaaccagtaattacattatggaaaacagacagaaaacaacagttctggcctgtgcaatataaacctcaatgaactcgtcaggttttgattaaaaaattgagagcatgactacttgtaagaattaatatggattatggaatcagcacaatctttcaagaagcctggttgttgcaatacttcactaatttattgcataaatagtttccagaaccccggtgacaaaaatatctcatgccagaaaaagatataatatatcttcaagtggatccactatccaggagcatatgcttacctgaccactagttcctttaccagttttgaactccagaggcattactctgtcgtatgaactaccattgcatgaaacccttgatctaatagaagcatcaataatccctttcaaaccatatcttggagcccaggccatctcctcaatatccattacctaaggtgaaattcatttcaataaagccattaagaatgaggtgtgcaagtcaacactcaagtactgaaggacatggggagagtgaaagttctgtgttggcctaattttgatggctgagaatcacaaggactacaggagtttaccatcatgaaacgaacttgctagatattacatataagttacataatatgaaaaggtcatattccaaagttttgcaagctcaagatgttgcctacctccacaactccaacagtcttttgtccttcaatttgaccaaaatttacattgttacattttgatacctggatgtgccgacgatgattagcgcagaacatgtaacagtatcttctttaaacaagtaaaggacaagacatgcaatatatccaccggtgaactttgcaggcaagttagtccag

SEQ ID NO: 13024 - DNA, 2122 bp, Oryza sativa
tataaatatcaataaagaagctgagctacagtacagtactgtaatcaaacatgacatataccaatatgacttgagtaaatgaggatgtatgagaacaaccacaatgtatgttgatatttcagaacaaacacaacagatttgcagaacttttggaatgacattccatgttccttgtgtaaacatataaaaataataggaaggatatagcacagaaaattggatcaaattagtcaaagcaacattcaaaaattaaatataaagtttcacaaaaaatttagtagcacatgataatttactgataactatagccttactgaatcggtgctctaagaatagagtaagaaaaacattattggtcagggcactcagtataacataataagtcatgaacagtccatgtcatagtgtcatacttttgtgtagtgtgttttttatggattaaaaatgttgtcacgaatcttacctccacatgcatataaactctcaatatttttcaaaagaacttctttggcttgctgctctaagaattgcgttgaaggaacatcttcaagtagccctgcctgaggcacaagaggaaagaaacaaagtgaggcacacacaactgttacatgaagataaagtgcatgatgtattaaccagagctgccaatttttcttgcaccaacgaacctggaatacttgatgcagcagagtaccaatcaaagcacttgttgaatattcattgctttttagtctgtcatcgagaacagaccttcttggacaatgaaaactagaagcaacctaaaataagctatatatcaaaatatgatgacaagataagatgaatgtatttttacaaacagttcttataaaataatatttgaggatatcatagcagcttgttcatattgatctgggatattgactacaaaggttataataaagagatggggggaggctaatactaacccgtgttccagatatgagtaattctggatgcactataacaagatttttgtcatgatcaataatacatattccatggtcagtgaattctccaatgacacttactgtgtcgcctgggctaataaggctatggaacctgtagtggtttgaaatatataggcaatagattgatgaaggttcatatgtatatagaaaataaaaatggaatcatgtcaatagttgcatataggaactcaccactcatcacacaaatggactgcatgctctttcccaccgtgctcattcagcaaacgtaaaacctgtcaaaacagttagcaactttgcaaaataacaaaaatttaattgcaaactagctcatccagataggtaaagaggatatataccttaacaggatagcgatcacatggtaagttatcgcctttgtgcttttctgacacctgaaaagtaattaaacacataaatctctattgtactagaagtctagagcagctccaacttcgatagaaaccaacccatggaggtaaagaaagcaaacctccaacaccaaaaagctatcgaagggcggggcatcaagggacttctgggagggtacattttgatcgctgtcagcaataggagaacaactaatgtttttcggatcaccatttatgagctgctctcctttattctcaccatcagcaggtaattcttcttccatgattgcatcttccacttgatctaaaagatcaagtagtgcctggtaaaaagaaatggcatagttttgtcgatcaattctttggcaacttagttcttacatgtaataatatcatgaaaccaatggcacccaggacatttagtgttatcttagttcacctttttgtgctcccctgcccccaactgctcaggtcctccatcagaaaccacacccccattaagctgctgcttcatgcacaaaaccattactccatcaacacgatttggaactacattagctagcattcacacaacaattcatcgtataactgtatgtacctcactgcacctataggacagtgatggaggagtccgaaatgggctttgggtgtcctccacaccgtcacagccacctggaccagttccacacatatccaaattgcgtgctgaagcagtacatcttgacatgcccagcagtgatgaatgccatttttttgtagactcga

SEQ ID NO: 13025 - DNA, 8639 bp, Oryza sativa
gcggcgcggcagaccgcgaggggccgtcggccttctggcgcttggcgttctgggaggaggcctgggactggcgctcgaagaagtggagaatgccgaccttggccggctgcgacggctgcgaggccggcggcttcttcgaagctgccccccccgccgcccccgtccgcttccgtggagccatggctgtgttgaggactagggttttcttctttccggtcgctaggcggttcgatacggcggaggcggcggacggcggcggaatgggggatcgggttgggaagggaaggtggtgggaaggcgaggaggagaggagaggagccgagaaggggaaggggaatggccgaaagggaggggaattgggcggggttggaaattggagttcccgcgcggtagagatttcggcggggtagactgcgacgtgggcccgtgacggcccggtgaaaactaggcctgaaaggagaaagcattggtccagaagtgagatttggcccataaaatattgggccccccttacacggttctaaaagcccatgtacgacggcaaagtttctttcgttccctcatggaacttgtgcaaatctcatgaccattttttgcgttcctctgatcaagtggtgtacaacaaagtctcctgcgtacggcgcactcctcctgtgattttttttcaactcatcaaccatcattcaggttttgattcgataattggccccctattaaaattagagatctgatgatgattgcctaccacgcgcatttgttcccatgtatcacctgatctaacaattggtggtaaaaatcatcagatttgccggcccgcccaagtacaaaaatggccaatcgttcaccggcgcacgaggattgacagccacgccaaaaagcgcggcgcgcgaggagtgacagcacgcggacccgacagccctgtcggggcgagagcctcccaactcgcgccacgacgagtcgtcgtcagtcagtcctcccccttcgacttcgaccaccagacgatggatcaacgctcgccaccttctccgagacaccgcgcgtccgtactcccatgtcgattccaggcgaaacaccaaagacgatcgtgtcgctcgtcgatcgccattgcccaagaacacacgcctcatcacctcatcgcctcgtcgtcgggtcctgcgcgagttttctctgccggtggttggggcgatcgatggaagagtaataaagaggatacatccaatcggtatggttcgtcttggtgaaagatggttcaggcaacccagcacgggaaaaaacgccgtaatttacttctcttctcgatcactccgtcacggccgccaccgcgaccactttttcccgtcgagaaaatgttgccaccttttgttggttcgccgtggtggctgacagggatccgggtgaagccgctgctgcacacgccgccgcgagcggaaaaggctccgggagaaccaaccccgagtggcacgtggggaggctgcctgccgcgcggtgaagcttcggtcacggactcgcggctcgttttcgcgctcgcgcgcctggtcaatgggttggcaagtggcaattgcgacgcacgcaggtttggatcttggctctggcctctggctgctgcgatcccagtccaagcgatgtctcgtgacggtcacgatggaggcgcacacacgcggccacgcgggcatctaaagtgctaaacccaccttatacaaagctgcattcgaacaatgttgaacaaattcaattcaaaatgtggcgctaaaattggaacgatgtgacggaaaaattgaaagtttgtgtgtagaaaagttttgatgtagactgtgtttagttgacgtcaaaattagaagtttagttaaaattgaaacgataagatggaaaaattgaaagtttatgtgagtaggaaagtttgatgcgatgaaaaaagttgaaagtttgaagaaaaaaattatgatctaaacacaatggtagtggaaaagttagaagtttgaagaaaaaattttgtaactaaactcggcctatttttcaatatttcttatcggaagtttttgtcctactagtgtgcaaccgtgcatctattcctagagtagggtagaggaacacacttccataaaaagccacgcaagcgagggaacagagagatgcgaaccgatcgaacaaacgaaaactacgaaaaggtgaaaagcggcgcctctatatacagaggagagaccgcgtcgtcctcctcttccttccttccttcctccctcccctctgctgctgtgcttgataatggagaaggcaaagagaagagggcaatgaagtgcagcaggcacccgtacgagggcggggttggcgtgtgcgcgccgtgcctccgcgaccgcctgctcgcgctcgccgccgcgcagaacgaggcctcctcattgccgccgccgccggagccggtgccggttttcccgaggtcggtgtcgccgtacgtgtgccgccggaagtccgacgcctccggggcgaggaggcgcacgccgagcctcctctttttccggacgccgcaggtggggccggcctacggcggcggcggcggcggcggaggcggcgcaggtggattcgaggaaggggacatagaattcgagatccggcgccgcagcagcaagttctccgtgctcgccgcgctcttcggagcccatcggcaacacgggtcggaggaaaagcgcagtagcaaggagcggaagcaccgttcttggctcgcggcgatcatggcaccctggggcccccggaagaaggatccggccgtcgcgtcgccgccgcggcactcttgccacgtgatcagcaaccgcgggctctcgccggcgatgaggtacgccgacgaaggcggcgaggaggggagctcgccggcggagtcgccatggcgaccttcgccgatgcggaaaaccccctgccggcgcagaccgggaggcgcgactggggccggcggcgtctcgggcttcgccgtctgcatcagcccgctcgttcgtcccagcccggcgcggcaccaccgcgggggaggccacccgccggacgccgccgccttctccggcgagctggggccgtcaccgctccaccgcctctcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaaccctccacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagcagcatgatatcactatggaaaaggcgtattttttgttcgattttcgcagtaatcccagagcttttctacactccgctgggtattactatatgtttattaaggacaggagtatatgaaaagtggattttgattttttttagataatggaataaataaatatcccggcctttactcaaaagagctacagccaattattatatagaagccaattatatgaaaagtggattttgatgaggaacataaagctttaatgctgactgtctgacggccgttggtttgctagtacacattgcttcgctgtatgaactccgaagccacatgccattgtcaaccgggtcaagtacgcgtattattggctttgggggagtgaacactaggttagtccagtacccgagttcttgttacagtattgatgaggccaacagaaaactcctactcgttgacggtatcgaatgaactaatgcccatccgagggagacgattgccagtgcagtactgatttgtttcggttagctgcaataactcttttcagtgaaagcttgacaagaaactgcataagttctgaatccttatattagattatgacaacaatttgcaagcagggacaagtgacaacagtggcttggttgctgcttcaattcagcacagcaagcaacaggatcaaccttcccaatcttgttctttttccgcgtcagaactcaaaagtctcagaataagcaacgaccagccgaagattttctaaaccacgccattttcagcacagcaagtggtattgggccaattaattaggcattctgaatccatctgcagtccatataagattatgcatgtgaccaaggagttgcgtgtcagcttcagttgaggcctttgtggatcaaaatcatcttgctctatagtctagaccaaacatttttcccttttcttcttggtaatttggaaccatgacattataattttgtaacgtttgagatatgtcatcggtatctcaatgacacgtagaacccacatgagtcaatggcatgtgggtcaggatggtatagctcaaatttttcaaaattataatggcatggttcaaattttcccttttcttttatgcctgtcacacacgtacaacagaggcctggctgagtggtaggtcgaattataccgttgaggtccttaatttctgactatacatttctcagttgaggccattaatttctgaccatacattcctgtcggattactttagttttgttgcatgaatttgacaaaacttcaacttacacgggaaaacttggagcgatcaataattggaaaattcctcgcgaaaaaagagagagaagagaaggtgtagcaatgatacgcttctttgctaggtcaaactgagcaaacaaatacttcatccgtcccgaaatataagaatctaaaaccgatgggacatagtattagaaaatatcctatccgattttaaattattatattttggtttatatcctatccagttttaagttattataatttaagacggagggagtataaagcaaaattgcaaacggagttgtcaatggcgtgacaagtggttggaccttctgtgaaacaacccagaatcagcccattacataattgggccgtggtgagacacacacaaacaggaccagtaaagtgtttgggccctagctgcacctttaccatggttggataaaggaaaaagtacaccgaaggtccctcaacttgtcaacgggatacaaaaccgtcctcgaaccgcaaaaccagatatataggatcccttaactatataaaactggtcacaataggtcccttggcggtttcgatcccggttttatcctacgtgtctaatgagtcagcgtgggacccacgtgcgccccacatgtcagcttgtccagtcagcctctatttctttcctctcttctctcccttccccttctctctctcgctcttctctctggtgactctgggtagcccggcgccgccggccgacaggtggggaggagatcgacggtgcgaggtgggagaggaggtccggcggccggcgacgtggcggcggagacgacgcgggagcaggggagcaaggcggcagcggcggcgagatgtccacggtgaggtactggaggcggagctccgtcggggcggggagcgggtccacggcggcggacggcaggcacgggattgcgtcgcggccccacgctggcgccagcaccggcgtcgcccgcctacgcgcgatctcctccaccgccgtcatgaactgcaacgcgccgagggccgagggccgatgcgccggcggcgacgccaccgatggctgtcgtcgggcggtccgggagaggcgacagaggaaggagagatcgaggatgacggcgccatttcggcgggcgtggcgcagcagtcggtgtgctaccacggcgacaagcagtggacagtgtcggtgtcgtgggggttcgcatggtgcatggcgcatgcatgcgataatggcgcagctgctcacacccgtaatagctcatccagtgataaggttgttaggattagtttcttatctccaaatttgttctatctccttatcacttgtaactgaacattgtaagccacggtagaggctgtttctaccactatttaacagagatgcggcccgaggcaaagggttcaacgcttcacattttatcacatggtatcagagccttttccacctcggtagattgcatctatcttccaccactcatgccgtcgtcgtcttcctcaggcgcggcagctgtaaacctcgctcagggccattccgttacagagaaactcggaaaggcaatcatgcactgtggaaagcgcaagttagcgctgcagtgcgcggagcccgtctccagggctacctcaccggcgctgtgaaagctctagacgccgagatttcagtcaccgtcgatgggaagactgtgacaaagccgaacccggcattcgaagattaggaagccaatgatcaacttgttcttggctatctcctgtcatctctttcgagggatgttctgattcaagtcgccatgtgcaagacggcggctgaagcttggtgagccatcgaggaactctactccagccgcacccgtgcaagatcggtgaataccaggctcgccctcaccaacacgaagaagggaacaatgaaggtcgctgaatacgttgccaagatgcgagctcttggtgatgagatggctgccgccggtcgtcctcttgatgaagaggatatggtgcagtacatcatctcagggttagatgaagacttcagcccgatcgtctctgctctctgcaccaagtccgatcccatcacggttggggagctgtactctcaactcctcaactttgaaactctccttgatctctaccgcaacaccggtcagggaggggctgctttcgtcgctaatcgcggcggcgggcgcggcaacaaaaacggcgcccacaacaacttcaacggcggcagcggcaggggagcgctgcgcggacgcggtggtggccaagcacgcggtggccaggggcgcggcacagggccctggatttttcatattttggtccttttaaaaaacttatttcgcaaatagacccctaaaaaaacttattctagaaatggtcctttttggggcgccagagtggctggc

SEQ ID NO: 13026 - DNA, 24299 bp, Oryza sativa
tccccctagccacctcagcatcaccccgccacgtcggcagggggacggcgccaaagaggctggcgccgtcctgttgaacgacggcgccagccactctggcgcctcaaaaaggaccattttttggataagtttttctaggggtctacttgcgaaataagtttttcaaaaggaccaaaatgtgaaaaatccagggccaagacaggtgccccacctgccaggtctgcttcaagcgcgggcataccgcagcagactgctggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcatcaatgcctcttaaattttgggatgaagcctttgttgcagccacttatctcatcaatcgtgtgcctagtagaatcatccaaaattctacacctctagaaaaattgttcaaacaaaaacctgactactcatccttgagagtgtttggttgtgcttgttggcctcatcttcgtccttacaatacacattgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataatgtttctatcttgtaatcctgccccccattctatataaggtgggcaggaggccctctagagggcatgagacaacctgatcgtcagatcaatacacactcagcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggctgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttcggtgtctacgacttcgccgaccggctggccttcgtcgccgccgactggtgtccccgcctatacggttggtcggtcacaccaccgttcatgggcgtccacgtcttcgccgaccggctggccttcgccgctgccgactggtgtttttgcctatacggttgacggacttcgccgctgttaatgggcttcatcatctacaccactggcttggttccactggcgccgactggcgtttttgtcaccattgatggactgcttcgttcccacatcggctacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgacgaactcatgtcactcatatgtcgccgccgactggtgtcctcgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgtctccgcctgcacggctggcctattatgccgccgttgttgggcgtctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtcctcgcctgcacggctggcctattatgccgccgttgttgggcgcctacgtcttcaccgaccggctcgcctttgccgccgccgactggtgttttcgcctgcacggctggcctattatgccgccgttgttgggcgtctacgtcttcaccgaccggcttgccttcgccgctaccgattggtgttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgctgccgactcgtgttcacttcatcacggcgatgcaactttgtcatcatggtggagcgacttcttctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgttttccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaagaacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgactttttaatatagtcatggtgctgtttgggttttaaagcaattgattggttacaatatcgttgctttttgccacgtaagtgtgcatttttattgaccaatattatggcttaggctgattatatattgtggtcatttttcaggcggttggtaaatcctttatgagtttatttactcggattttataccacatatgccgtatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggccttggagtaatctggttcgagagaagattatcttttcgactgtgaaggtctcaggggctactgtggagattatgggtaccccatacccacacggcatggttatccgactagttataggggataacttatatgtatggaatatgtaacagattatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacacacataaactccaattccgttccaaacagtgcgtgttcctaggttttagtactcaccacaaaggatttaaatgtcttgatgtgtcatcaggccatgtctacatcttaagagatgttatctttgatgaaaatatatttcccttttctactcttcactcaaatgcaggagcaagacttaggtctgaaattcttctattgccttcctccatgacaaattataatacgactagtccagggggcacacatgtagttacaccagtggctaatattccattacctagtaataatttaattgtgtctgatgctgatgatgttgtttctggagaaaatggtacaacacatgagcaggaaatggagaataccatgcatggggacgtgcatggcaacatcgtgcatggggaggcggcactggaatcgacgctacaggacagcagcactgtgcctgaccaggacgctgacagcagtggcgcagcctctgctgcagcctctggcgctggaggggacagtgtcagtctgggagatgccgaagcaaatggcgcagcagcaagtggcgaagctagcagtgcagattcccagccggtgcagcctgatgtgacagctacagcagcccgtgcaccgagaccacacactcgcctgctgagtggtattagaaaagaaaagatatatattgatcgaactgttaaatatggttgttttaattctacttgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaagcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaatagcctaggctatgactatttaccataatgaaaacaggcatataacataccaaggaaatgactatggtaaaaacaagtcattccaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgagatccaagcgacacttcatcttccccgccggaactctcgccattttccccactccctgctacagtacagagctacgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatatacacgaggctgtggtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatgcctggaactctcttccgattggggatgaagcagcccaagccttggagctgatggatcgcatgctaaaactcaaagaacaaggcttacaaggagagcagattactcgacacttcatcaaatgccgattggcaccaattaaagaaagatcccgtacggcattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacccatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgactaaggcgacgacggcaacaaatctggggacaaaggctcgcccaataaactcccaaagcataccactcccaggaaaaaactggctagtcgtccaaggccaaagattagaacatcttccaggtataaaccttttggtacatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgactggaaaccagtcggatgtaggtccagatcaagaaactcccgaagttgaagcgcagacaacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcagctgatgactctcgtcctcctatcttgctcaaatggtgggacgagaactcacaagctgccggcatcgtcataaatcgtcaaaaagaagatgaggaagtgtgccagttgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagcccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattataataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcaacttcactcggcaacattgcttctgccccatagacaaggaaaaaaggtgactggcctgtggtccgactgggtgtagtacgcaaagaccaaagtactgatggtagctgttccacccatttgccggcatagggttttagccggtcaaaaactcgcgctttaatcccttgaagtatcatgccattggctcactccacctgtccattgctcatgggatgtgccactgaggcatagcaaatcttaattccaaagtcttcacaaaagtctttaaaaactccgccagtgaattatctgtcattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggctgaaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcaaaatgcatggtccagtgctccatcttctccgcgggggtatcctcctggcactcggtctattcggtgacaaaatcagctaacgcttgggacttgattgaaattcggggcttgaatgatatgtccaaagacatcaactccaaagcccacttagcaatccgtccgtttgctccgcggttatgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtctcgaaacaaatcggctgagcgccgccatgcatccagtcagcttctgaacatctttctgggtacttggcggtttcatgttgaggatagcagtaactttctccgggttggcttggatacccctgtgagacaccataaaaccaagcagcttccctgacggtactccgaaggtgcacttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccgaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctaccggggtgtcgccgtcgtccttcttcctcgacgtgctttgttcttcgtcggagttcttccgtgtagtcttggtgtattgctccgcgaattgcttgtagacgaaacaatctttggccacgtggttggagttaggatggtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttgactttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttggaagttggcgatgaagtggtcgcgtaattcggcccaagatccaatcgtaccacggggcaatccatggagccaagatcgggcggaatccgctaaagccactggtaaatagttcgccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgaatgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgttgaaatcacgcgctcggcgccctgcttccaaggctcgctgccgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccataagacgccgaagtagagaggggtgtagttgtcatctaggcttccgtcgaagtcgtcgagatccgggtcgttgtagcgagagctaaactcgtcgtactctacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcccccctacctggcgcgccaactgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgagatatccataatctccacactactcgtgaaccacaaaatgatagagaggccacaaaataatagagaggctctaggagataaaaactggatagctgcaatgcaagctgagtatgatgctttgataaaaaataatacatggcacctagttccgtatgagaaaggacaaaatattattgggtgtaaatgggtatataagattaaaagaaaggcagatggaacacttgacagatacaaagctagacttgtagcaaagggctttaaacaaagatatggtattgactatgaggatacctttagttctgttgttaaagctgctactattagaatcatcctgtctattgctatttctagaggttggagtcttagacagctagatgttcaaaatgtctttcttcatggattcttacaagaagaagtctatatgcaacaacctcctggttttgagtcatcctctaaacctaattatgtatgtaaattggataaagcattgtatggtttaaaacaagcaacaagggcatggtattccaggctgagtaagaaacttgttgaacttggttttgaagcttcaaaggccgatacttcattattctttcttaacaaaggagggataattatgtttgtattggtttatgttgatgatataattgtagctagttctacagagaaggcaactacagcacttctgaaggatttaaacaaggagtttgcacttaaggatttgggtgacctgcattacttccttggaattgaggtaactaaagtttccaatggtattattttgactcaagagaagtatgctaatgatttattaaaaagagttaatatgtcaaactgcaagccagttagtactcctctctctgtcagtgaaaaattaactttatatgaaggatcacccttgggacctaatgatgcaacacaatatagaagtatagttggtgctttacaatacttgaccttgactagacctgacatagcttattcagtaaataaagtttgtcagtttcttcatgctcctactacccgtcattggacaggagtaaaaagaattctcagatacttgaatcagtgcacaagtctaggacttaatatacataagagtgcgtctactcttgttcatggatattctaatgcagactgggcaggtagtatagatgacagaaaatcaacaggaggatttgctatatttgtggggtctaatcttgtgtcctggagtgctaggaaacaatccactgtgtcaaggtcgagcactgaggcagaatataaggctgtggcgaatactacagctgagttaatgtgggtacaaaccttgttaagagaattgggaattgagtctcctaaagctgtcaagatttggtgataacttaggagccaaatatttatcagctaatcctgtgtttcatgcaaggacaaagcatatagaggttgattatcattttgtaagagaacgagtgtcacataagcttttagagattgattttgttccttcaggagatcaagttgctaatgggtttacaaagtcactgtcagttccttcaggaggggctgtgaaacaacctaactctatcctgtgcgtggtgcatggcgcatgcatgcgataatggcgcactactggagatgggaaggctcccgtgtgcatgcgaatattaccgggtgtttctctgaacacacggtaacttaccgtgagtagaacaataaactcgggaaccatcaagcgcttaccgtgtgttagagatgactcacgggaacaccggaatccacctactttccgtctgtgcgcgtcaaactctgttggcgcgagtagtatttttctctttggcgcgaacggatttcttttggcgcgcgcctagctccgtttggcgcggcccaatttttcgctggcgcgaaacagaaggggtgttcccgtgtttttttttcattcagcgcacgggaagtgagtgatggcccacatgtcgattggataaaaaaaagaaaaaggaaaacaaatcctaaccctaaaaccccaccggctcccacagcccacgccgccacagtcccaaacacctcgccactgctgcccttctccttctctccctcctcgcggcacctgcgcgccgccccttcctcgccgcacctgcgccgcccccttccctcgccgcacctgcgccgcccccttccctcgccgcacctgcacgccgccctcttctctccgcacctgcacgcaatctgcccaacatcaaggtatgtgattgtcgaatgttggctagcttgtatagtctcttgatgtttgatgaagaaataagaaaggagaaattaatccctttgttctctggatttatcaaataagaaatatagtctcttgattattgcttcagtaatctcatgttttgctttagatcgtagactaaaatgcttgtgtcctctagcagtctttttagctttaggattttaatgtgatggcatgctgttatttctgaagtaattctgacctaccaatacttgtgaagttgaagaagtattgcagttgtatactgttcctatttagccttgcaattctagattgttttggtgcctatggatgtcctgcctgatgttctattaaaggatgtgtttttggtgcctttcttcttgtaacaagagatgattgttatatcctgtcgggatggttatgtgcttgggtttcagttagatgtctacttttgggagtttggtggagggaaacatctgtagtcctgctgttagaaagcttgcaatccgagcatctgtttgttctatttgtttgaccttttcgtgtaaagggtctatgtttgggcttttcctaaagccgtgcaatcaaaaattgtttgttctctaaatatgctgaaatgttttgcaggaggatgcgacgattaagctcgggctctagaggggcctccagttctgcagatggttcagctagtgctgccatctcatctaggaataggacaaggtcatcttcctctcagcaacctactgatcctgttcaagaagaggagcaggaagatgatgagttctggttttgtggccctacaagggtgccaccacgacctacacgagaggaggataaacctgtgcttaggccaataggggatatgtaagtgtgttgcttgtgctatatattgctgttatttcaagtatgaagctaatatctagcttttggttgggatttgtgcaggcaatgggaggtacaagattatggtcagagtactagagtccccaatggtatcctgactacattgataaaagaaaatttccctggtgtggtgaaattcaagggtagagatgagcctgcatggtctccggaacattacttgcttaaacctgataatgcaaaagctaatcaagcacgcttgccaagcctcctccatcgcgttgaggaagaattctgggtatttctttaccaacttagtttctttcaagttacatagatcatgtattgtttggttaacttttggtagttgcaggggttctataggtgggcagaggggacagaagtggaggctagaagagttgtgcacaactgcgtcaagaaactctttgttgatatattctatgaggctcgtatcctagctgtgattacttatcacaagaagattctgaaaacagatatagatcggccaactgcttgcaggacttatctcacaaaggcggagtatatgaaagtaagctcgcttgaacaagaaaatgttattagatgcttagcttttgaacatattagtgactaagcgcaagtttgtttgttataggctaagccatggtggttcctaaatgctggtcgtgcgtgggcattattgtcagatttgaggtggtgcaatccagaatggcaggcttactcccgtgcttgtagcgaacgcagggcaaagatgaaaacgccagcccatcgccaaggcagtgctaaccttcatcgttaccacaagaatttggttcgttagtttttcttagacataataccaagacctgcatagctttagactttaattgtacggtgttcattgaattgcagcagcacattattaatagtgttaaactatttattttgaatgtaggagaagaaaatgggcacaccagtgcatgtattgaaggcttatgctcatgccaatagggtagacccagacgagggctactgtgatgaagattcatctcagaatatgttgctcgtaagtgccttacacattgaaatttgtgttgtactactctattgtctacattccatttggttaactgccattttcatttgaatctgtaataggaggcctatgctcgcgcttttactgagaggcacggagaagacagtaattggcggactgaacccattgatggtgtggctgtgcacatggctggtggtggcaagaaacatggacgcttcttcctgcttaatggactccttaagacaccagatgttcttgctgatgttgggagaagcaggtgctcacttgatgatccacggcctagcagacggctgaggccaaaccctgatgatagtgcccggattgaggagcttgagcgtcaacttcagtgtgagcgtgaggagagggagcaggagagggagcgggcacgcgaggagagggagcaggagagggagcgggcacgtgaggagagggagcgggcacttgaggaaatggagcggacacgcaaggagatggagcaggagagagagcaggcacgtgtggagcgggtacgtgagcacgagttgttccaggagaaaacaagc

SEQ ID NO: 13027 - DNA, 13817 bp, Oryza sativa
tcctgcggcccaacctagaacattgtctgaataaattgcaggtactgcaaagaaagctcaacataaactttctgcctccttgcacacctacgttgactcatccggtgagtgtaatgttgcaggatagacatgtcctgtatgattaatacaaacttgttgtttgttttctaacaaacattgctaattcaggctacatctggatctgaagtctctattggaaatccagttaccaccactgagtgactggtccatgagccaaatatcccagtgcaagttaacctggatgttggtgccagtaatagcaggcagcagctttaggcgtgcagtatctgaaaatcgctcttcaccgaaagaactagaaattgggaagtcttttgtgataccagaaacttgtgggtgttttggtgtgatgtaactgtgaagtaggactgtgccaagtcctgtttgttctggtgtatgtcctggttgttgtgatgggctcatgttggtacccattggttgttcccactaattatctgtaggtttgttgagcagtactaattggtaccagctgatgaggtagtatattttgtgtagtcgttatcagctgatgaagttgtatattttgtgtatgcctaacggtgctgtgcgctgtggtgagatgcacatttagtggtggtaacttaagtactttgtagggaagaacctatgctgatggaaagtattaatgaagcttatgaacttcattatgttatgcgcatggaatttgattctcagaaagatgtaaattgatttggaaaatgttgatagccagatgtggtgttgagaccatgtcaaacttgtctgcacaatactggctcaatctgaaatcacagtgacatggttttcaattcgacacttgatcatagtttacaaatatggttacgtgtgaatattgaacacggtgaatttgcaattaaccaagtggctatagaaagtatagaaaaatgtggaaagtagtggaaagtaatttataaatatctatattttggatttaacatctatctattaacttatttaaggaatagaaaaaagagccttaacgttcgctttcacggcctagaaattctcatattaattagagaaaaagaaaaacagagtccatatagaaatacaatttagaaatagttgaaattcggagaaaatataatgatgctagcgacgcaatctgcgcgggccaccatgctagttacaaatattaggagagtccatagggtttcaatgtgaggatcaagttatcaatagagtaaatttgacaccgcggtattatagttatagttgcaaaaatctaaaagggttttgataaagttgttagtatcgagattctagttagtattgtttttttttcctaaagtagtattgaattgtataattgaattattttattttctttttaactttttaaaattttgaactgtaacaatcgcaatgtaagccgtgtcaatgttgttttgcgacgccaggcagattggcgtggttaaaaggttcatattttagaaataagttcaaaaataaaaaaaatctcgtaggatcctacaaaatatagtaatattgtttcgatggaaactatcagtatactgatttttgtgcgcttctaattattctatgcttcgtatcccgacactagagcgataccacccgaaaacgatactacaaccgacacgtgtcgttttacccggataatatcgtacgataatgacgtatcccaataccgttaaccttgggttttgataagtactaaataacaaaaacgaaattagtcaatgatatgatatctaaactagttgattagaataaatatatttagagaatcttatcaaatgatattttagcaaataaaaaacatttttagttgttctcataaatcatagatgttatctaatcattattacaaaggcacaaattaattattatacacaggggaatgtataataatgaaatactgtagaagtcaaactagttgattagaatgaatagtaacgaaatagaaatagaactagttaagatagaaacagaaatatgtaatttttctgtactgcaggtaaatatgacacagtggcccacaatgtcagaaatccccccgccatatgtttctctactgcagcttgttctatcagccgaacacgctttccccaattttgttttcgcgcgaactccctcacagccaaccctagaatcgattccgccgccgcccacctctttcctctcccgcgcgcggcgcctgcctgcaacgcgaccggctgctttctccagcttcaacgccgtcggctgccttctccgtccgtccggattgcagccacctttcttctcggagaccctccgtcagccccgttttcttggcctgcgcggtcgtcagcctccttcgtcggagtcgcaggcccctctcctgctgggagcctccgcgcggagcgcagccgcaggacgccctcatcggccgcaacgacgctgctggccaccatcgccatctggagcactggagcctgtggcctctcctgaaagaacactgtgtaagtgagcagtagccatttttatttttctctctttctcattcccaaaaattcaatatatgaatcaacccttagtttttgtttcgttgtatttctttgcagcaaaaaaggatggaagaggatcgcagttggatgtacaatggacgtagaaagcgtaatcaggttagtgctgattggattttaaagactacagattttttagatcgggcattcagtagggacacaagtggtgatggtgttatgtgcccatgtaactattgcaacaatacacggccccaaacaagggatacaatgatgaaacatctttttaagcatgggtttaggccggagtacactgtgtgggtttaccatggcgagtctgactcagaccctacacgcgatgatgtgctccggcaacgtacttttgatgaagatggggatgctgaggttcatcggatggatgacatggtagatgatgtgcgtgatgcacatatatcagttgaggaggaagaaccggaacctatagcacgagctttttatgaaatgttgactgcatcaaatcaatctctccatgcacacacagaagtatctcaactagatgccatcacacggttactagcagtgaagtctcaattttccatatccattgcagggtttgatgcattgttgaatgtgtttggtgctctccttccacaaggccacaagctacctctcaatttatatgaggctaagaaatttctaagtgcactgaccatgccatatgagaaaatagatgtatgcccaaaatattgcatgctctttagagaggaaaattcagagaagacccattgtgacaagtgtggtgagagtagatatgtggaggtgcagaacagctatggtgaaaagaagcaactaaatattccaatgaaagtccttcgttatataccattcatcccaagacttcaacggttatacatgtctgaaccacaagccaagcaaatgacttggcacaagtatggccataggtaccatcctaacaagatagtacacaccgctgatgctgaagcatggaagcaatttgatcgcgacttttcggaatttgcatcagacgctcggaatgttaggattgcaatagcaacagatgggtttaatccatttggtatgggtgctgcctcctacacctgctggcctgtgtttgtcatccctctcaaccttccacctggtgtttgcatgcagaaacacaacatgttccttagtttgattatccctggacctgattatcccggcaagaaaattagtatgtacatggagcctctagttgatgacctactccatgcctgggagcatggtgtgcagacatatgatcgggccactaaacagaattttaacatgcgggtgtcatatttattctcgttccatgatcttccagcctatgggatattttgtgggtggtgtgtacatggtaagatgccatgtccagtctgtatggaggtgcttaaaggaagacggctgaagtttggtggaaagtactccttctttgattgccatagacaattccttcctcatggtcacatttttagaaatgacccaaactcttttcttgcaaatactactgttacgactgaaccacctcatcggttcaaaactgaagaggttcatgttcgcttgcaacgtctgcaacctgctgccaatggagaggggtttgaaggttacggtgaggatcacaattggacacacattccaggcttgtggaggctcccatacttccataaattagtacttcctcataacattgatgtcatgcacaatgaaaaaaatgttgctgaggcaatatttaacacttgtttcgatataccagagaaaacgaaggataatgtgaaggctcgacttgatcaagcaatactctgtaaccgacctgatcttaacatgatccggaggcaaacatctgggcagtggttgaagccaagagctgatttttgtttgaataggactcaaaagaaggaaatattagaatggtttcaaacactcaaattccctgatgggtatggatcaaacctaaggagaggagtgaacttcaaaaagatgcgaatcaatgggttaaaaagccatgactaccacataatgatggaacgccttttgaccagtcatgttccgtggctactttcaaccttatttgtgggaagtgatagcggagttgagcttcttttatcgtaaattgtgtgcaaaagaggtagatccaattgagcttgaaagcatggaacttcaagtgcctgttttgctttgtaagttagaaatgatctttccatccggattttttaatccaatgcagcatctaattcttcacctaccatacgaagcaaggatgggagggccagtacagtaccgatggatgtatccaggtgaaagagaccaaaaggatcttaagagcaaagtaaaaaaccgagctcgtgttgaagcatctatagcagaagcatatatactagatgaaatcgcaaacttcacaaccatatactttgctgatcaagtgtacacagttcacaatccagtccctcggtacaatgttactgttgagtcgagagaatgctcacttagcctcttctctattaagggtgattctactagccgaggagtcactagacacttaactgaagtggagtgggaggctgccatgttgtacgtcctcacaaacctgcctgaagtggatgactacgttgggtaagcactttatttgggtcacatccagttcatagcatgaaataatttatcctttcttgacatgcatgagttctgtgtttacaggaaattcttacatgaggagtggagtagacgaggcgagccaacaagacagcaaaaggagaacctcttacggaatggtgctaggaatggttgtcctaatttcgtaacctggttctaccaacaagtaattcctcaatttcaatattcaacttgaacatctaatttctgcacctgttaataactataattcatcaaaattatttcacttcacttgtagagtcttatagacatgaatatgaatgatgatctgaagcaagtagctaaaggatgccatactagagtgaagacctatagtatttatgatgtgaatggctatcgattccgtacaaataaatatgagaaggagaggccaaatgcaaccaccataaatagtggcttggtgacaataggacaaggagaaaatagtgatatcactgattattatggctacatcaaagaaataattgaacttagttttcatggtgatagtgaactcactcttgtgcttttcaactgccattggtttgaccctgcccaaacaaggtacaccccacagtatggtttagtggaagttgcccattcatcaacacttgcagtgtatgagccatttgttgtagctcatcaagccacacaagtttattacataccatacccatgcaaatctgtaccagccctgatcgattggtgggtagtttacaaggttcagccaactggaaaaatagcagcccctgtggataaggactacgactttcttcccaacaatgataatgtccattatttccaagaagatggtctccaaggcacttttgtagttgatcttatggaaggactccataatgtttctgaagccaccactagagatgccgaaggcattgtcaatgacaaggacttgcagcttctaaatggatccaatgtgctacaacaagatgaatctgatagttctgagtttgatgaagatgaggaggagggccccatcattgatgaatatttctaagtaatatttttgcttttttacatgttcattttattctacaattgatgaagatgactcatttgatgtcttattctattgatttccaccctgctttaatagaaccgatgaagatgacaacgacgaggaccacttctgtgctgacttgctaagtatgctttgcttaatgtatttgccttttcttacactttagtttcttctacatggacatgatctgtttttcattcaaaccttccctacttaatcatttctcaaataattacaatgtattgatcagtctccttgcatgttcttactaatgtgtggctaattcctacaggttatgaagcaatataagtagcatcattagagctgatcagaaaaggtatctactttcatctcatcagttttaagatcaattcatggatggtggttggtgctgtacatcaacagatgcatacattttatcaactgtgaaaaactgctcaagttacattattgattgttcttaaccatattgacaaatcacaagatatatagtaatgcatgtttcatttcattacttatatgatagttctgctactctgcataatggcaagtgtgtaggtttgctaggtggatacatattttctcatgtttttattccaagcaaatccatttctcagcttatagaactgaccatttggtcttctttgttttggtttaattagcttgtaacagtacatgggtccgaattatggaggataatttgatactagctcatattattcttttgcttcaaattaaatgtcaatacttctttgtaaagcatcaaacatgaggctggtgcagattagtgaaaaaattcataatatgagaaatgcacaaggatacagcagcacccatagcaccattttcatatggttcctactcaacagtccttgcaagaaaaattaatttcttataagtttctcacaattgcaggtgtattctcaagtttcaactgcatgttctaggaccaatgaactaaataatctggtgctagctattgtctcaaagatttgagtatttgctttaagtgacatggaccatgatcagcttgtatgcttattcattacaaccaatttttaccaaaatatatgcctatgtctgggatttggcatctcttctatgcttggtgaattgtattgtgatgaaaatttgtcttgatgaatctcaaatgatagggatgcaatgcagtgaattgtattgtgatggaatgtgtcatgatgaattgcaaatgattgggatgcattgcagtcttctgtgtgactttttgcaggtgatctatattggcatgcaaatatagaaatagaaatataaataaaaaaagagtgctgagtgtgacttcccgtgcgtcaatagcatacagcacacggtaacgctaaaaagcttaccgagtgcccgatggtgctgaactctcggtaacgctaaaaagcttaccgagtgcccgatattgctcaactcacggtaacactaaaaaacttaccgagtgatactgtggacgcacggtaacaaacaaactgttaccgtgtgatcctggtgcacggtaacccgccgttctgttgggagcgccgttacgtcgtgagtgttaccatgagtcccgagttttgagtacactcggtaaaattttcaaccatcccgtgcgtttttcgtgcgaactcacgggaagtccacatggtaaaccgatgaagccgccgtgtgagcgttaccgtgagctagaactcggtaacgacgttaccgtgtgtttttggcctgttcccgtaggttttgagcacacgggagcctttccatctccagtagtggcgcagctgctcacacccgtaatagctcatccagtgataaggttgttaggattagtttcttatctccaaatctgttctatctccttatcacttgtaactgaacattgtaagccacggtagaggctgtttctaccactatttaacagagatgcggcccgaggcaaatggttcaatgcttcacattttatcacagccgcaacaccaccgtcactgtgtatgagcgccgccgcgtcgtgcctgccaagtgcggctggcgcatccgtgaccctgccgctctgctcgaccgcgtcatcgtcctcaagaagcccgaccccgacctctggaaaagggtaatcaaacacacactgtagttaaaagactgaattgatttgtacgtacaacaaaaaaacccttgattttttgtaatgttgctcttaaaccggcgcgcgtgcagtctccaaggagggattgctgcagggtgatgtcgtcacccaagcaagggaaggaccggaagatgaccatctatgttggcgtctgcagggcgggaggtcaaagtgagtgtctgagccgggaggccgccgggcatcggccggacgcgctgacgcgggacggagagggcgcggccgtgcaggcgccagcgtggtgcgtgaaggcagcgggaggcacggacgcgggaggcgcgcgccgccgccgccgcctgcacgcccgcaccgttcccgcctcactaccgccttcccgggcccatattcggccaccgaggagcttcgctgggccgctgccggggtctccgtcctcgacctcgcccgcgcggcgacgccctccccttctcccatgtcgccgccgacgccgacgccaacgccctcccttctcccctcccccgtcgcggcccccgccgctgccagccgtcgtcgtggacgcgctacccccgcctcgccgcggcgctgtggaggcgctaccgccgcagctgccgacgcgccgacgcgctaccgcctgggtgtgtgactgtgtgtagaagagaggaagagatgaggaagggggaggctgacgtggattgactgacatgtggggcctacgtgggtcccacgctgactcagccgccacatcggacaaaaccagggtcaaaaccaccgagggacctaaagcgaactgtcttgttagttgagggacgtccggtatctgtttttgtgattgggggacgattttgtatctcgatgacaagttgagggaccttgggtgtactttttccttggataaatttggatactccgcagcggccaattcatgtatttccaaggtaaataagttcatatgagatcccttaattgtcgacgaatcctattttcgtccttcaactggaaaaccagatacaacatgttcctaaactatcaaaaccagtggatataggtcccatggcagtttggatggtggttttagctgacgtaacatctacgtgactaatttgactcggtcttcatttgacgtggcttatgaagcgaaatttaacaattttaaaaataaaataaaatatatgggaccacatgttagtcaaataataagattaaaaaatagtgggcccacatgtcagtgggccctacttcctctaccttagcccctctattctctatctcacccccttgtccttccaccctctccacgacttcaccgacaactccgcaaagacattgaccgagctgccggccatctcgatgagcctgacgtcgtgcgctgacagccgctcgccggttgccacctcgacgatctctagtccctccacttgctttggctactggcactgaggcgagaacggtgacgaagatgaggcattgcttgtcgagttcttgcttggcatcggtgttgccggtatctggtccggcaacaagcgtgtcacgaacctttgacggtgtcgtgtgccggttgcggttgcggctacgtcggcctcgctcgcgaccagggcaccggagaaaaatcccgcacagctgcgatcttcgaggaagaggagcagcttcatcttcccgccatggccagggtgcgggaggccgtgcaacgtgctattccaccctcgccggcctccccgcctcgtccccctctacgtgcactcgccagcagatactcgcgggcttagtgacggtgggcaatgcgcgaagagcccgggccggtgatgctcctccctccctgcccttgctcaccggcctccgccgattccgcctctgtcgtgcctctactcctattcgctggcgtgctggtgctcgtggtgaccacctctagggaagaaggggaagaggtgagaaggagaagggaaggagatagtgaagagagaggatgaggtggatgaagtggggtctactgacacgtgggtctcgctgtttttaatcttattattctgactgacatgtgggcctatatattttattttaatttttaaattgttaacttttgcttcatatgccacgtcaaatgaagatcaagtcaaattagccatgtacatgtcacatcagctaaaattagccatgtgatctacattgcaccggttttaacagttgaaggaaaaatattttggttgaaatatgaaaatcagattcgttgacaaattaaagaacctcgagtgaattattcctttccaaggggccctacagatgatggatacacggtttaaaacctaaacagtatctcaaaacacaagccgatgggcctacatgtcctctgtgtattgggcctcaggcgaaaagtagacgtgagctactttcggtttgttgggccgtgagaaaacgcgggcccctcacgcgggcgagtccggatcgctgccggcgcgcgcggcgcaaacgcggcactccgccgccgctctccccttcccggcgccggccgcgcgccggccgtcgatgtactgctggtacgcgtacgagaggaaaccccagacggccatgagcatggatacggccttgatcccggtcatcctgtccccgaacagcgcgacggcgaacaccggcaccagcggcagcgacagcgtgcccgtcacgttggcgaacagcgacgacaccctcacgatcagccgcagcgagcccaccgccatcacctgccacgacaccgacgtcccgaccagcgtcgccacgtacctcgcccttccgtccttgaacgccgccatctccgccggtatcgtcctccagtcccccgacgcgagcagccccaccgccgacaccgtcgacgccaccacgttggtccacagctgcgcgcgcagaacccaccggagcgtccgcgtccggaccaccttctcgaaggtggcctcgaacagcgacaggatgagcgcgaacacggcggaggcggcgagcgtcagggcgaacccggcggggtacttgcccctcggcacgctgctggcggtctcgtcggaggaggccccgatgccgagcagcgccgccgagaaggtgagcacgacgacggagttggcgatcagcaccgtgaaccgctgcgcgttgatgagcctggaggtgacggagttgaagccgagctgcgtcgcggccacgagcgagaaggtggacaccggcaggtactgcagcgcgtacgagtacatcaggttgtcgaagccgatgatgatcccgaggccgacgtagatgggcgccatctttgccgccgccggcctgggctcgtcggcggcgggcgccggcgtgaagaggagaaggatggcgagcagcggcgagccggcggactgcgtgagcgtggccatccacttgctgttgccgccggagttgtagtacaggcggccgaggagggtggccacggtctggccgcagagcaccatgaacatgtccgccgccaccgacagccaccaccggacgccgcctctcggtgacccaccacgcacggcggcggcttttggtgcagagccgtcctcgccatggtcagactcttgttctggcataagtttgcaaacagaagacatggctgtttagtgtcaccgtcatcagtaagcttacttctcaaacacaaaatgtaagcaacggaaaagatcaactttatcatttctcatctgatagttctccattttttgaaagaatatttgtaaaaaaaaaggtacaaatatcacaaggaactggagtgacgatctagttttaagggatcgtggataaaataagggaaatttagggggaaacaaaacaaaaggttacatgtaaaataagaaaacggttttgctaaaaaaatacgacatcatatactatttgatttcagccacttttttcaatgtaattgctacctctctgaatctcatatgtctcctcttttaagttgatttttatatactacttttaaatagcgtgtgtactgcgaaaaaaataccttataagtttcaaagtaaatacttccgccattctaaattgatcatcatatatatttatacaccaagaccaataataatttaaatcgcatcaatcaagacaacatgcacacattcttccacaatgtatacatcaattaaaacaatatgccaattacgccctagcatgcacacattctctcatgttatattaatcgtattccgataaaatttgtgtccatacagttatatcatgcagttatataatgatcaatttaagaaattttggattttgttctatgatgatcaatttgagaagtagagaatatgtcatttacgtatataaaaaatattcctctgtgtgtttttttgtctttttgtttttctttgcaaaatacaacgcgatggggcctgtggaccatgccttatgtgttgttgctaagcctgcttacgtctactctggtcttacttgtgttgaattcaatgacactagtcacactactatatgatgaagataagactaagagtgccctcaaaaaaaaaataataagagggcccatgcatggagaagtgatgtttcccactttctctatatattttttatttattcctcagtggcggagccaggatttgaaagttgggtattcccgtctacaaaaaaattcatagtaaaaaaaatcaatggttcacagtatgtcaataccgataatctaagaaataaaattacaaattattacatggtacctctaattttctatttcggttccttcgtggcttggaagagtagctttaattctgcgttccttcatggcttgaaagcggtttataatatcacactccttgactttcaaaaacatctcacgctcaataaatgtgaccaagcaatcattcaagtattgatcccccatcctgtttctcaatttattcttcacataattcatggcagaaaatattctttcaacactagctgttgctactggaagtaccagaaccaatttgagaagcttgtaaacaatctcatgtctattgtgcaattttgtttcaacaatcataatggaaagattagcaagattttttacttttctaaacctttcatctatacgcatctcagtgaggaagagtttcaatgctgatggaagatggttcatctctgtgcttgagaaatcattaggataaaaccgtgcaagcttaatcaacttatctttgtcccaactagcaaagttatctataggactaaatgcagccatacaaaggagcaaatctgtgtttacctcatcaaaccgttcattaagctcttgtagttgtctatcaatgacacttagaaacatgtcaacatggaagcgatgcatattcttgattttaataaagaacctcctatctcttccaaccggccgatagaaagagtccatatcaggaatcttgatcttatgcttcacacaaaaagattgcacttcttgaagaaaatatcccatccaggatcctcg

SEQ ID NO: 13028 - DNA, 369 bp, Oryza sativa
aattcctgcagccctaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaacggccacgaaagaggtatggtctgcaaggcctgggccggttgatgggtttgcctggcgtggaactggcacgccctgcaccgccagaccaggtcgaccgcatcgttgagagccgttggccaatagaaaccctggcgaaaggccttgccaaccaaagtgcgtgaggcggagtgggctccgcactcgccttcatggacatcggcgagaagctcgac

SEQ ID NO: 13029 - DNA, 605 bp, Oryza sativa
cgctaacaaagtagatgggccgctgcacctttcggcggggccgatcctctccgccaggggccgcatctccagggcgctcttcatccgagaggccacgcggggcgccctcggcttctgcgccgacaacctcggggtcagagggcgacaggcgcggccttcccgcagtggccccggggccatcctgggggtcgggggcgcctggcaccgtcggacaagcaggcggagggccagctccggccgtcgggggccttgggccaccgttcggttcgggggcctctcctccctgctctctcccgggtcgagtcgacacagggtggggatgcgcggagtgagggttgtcctcatcgcgctccacgaccaacgccgagctgaccacctgcggggttgccgccaggtagagtagcaacggctcatctggctccggggcgaccaggactgggggagaactgaggtacgccttcaattgaatgaaggcccgctcagcctcctccgtccagtaaacggcccggagcgtttgaggagcttaaataggggtagcgccttctctcccagcctcgatatgaaccgacttagggcggccatgcagccagtgacgcattgcacat

SEQ ID NO: 13030 - DNA, 544 bp, Oryza sativa
ttgatatcacatatctatcaaaagggactccgcctatcctgcagttcaaggcagaaacacacaagtggagagatcattaactacatgagtgtagatgtacaaaggataactgatgttatatggtacaccaactatatttggatgttacccatacagctttctcttgctgtctatgttctccatcaaaatctaggggttggagcctgggctggtttagcagcaacactggcaataatggcttgcaatattccactgaccagaatgcagaaaaggttgcaggccaagatcatggcagctaaagatggtagaatgaagtcaacgacagaagttcttagaagcatgaagatactcaaacttcaagcatgggatatgcagtaccttcagaagctagaagctttacgaaacgaggagtacaattggctgtggagatctgtgaggttgtccgctgtaacaacattcatattttggggggcacctgcattcatatcctccataacatttggcgcatgcatattgatgggaattcctttgactgctggtactg

SEQ ID NO: 13031 - DNA, 16172 bp, Oryza sativa
  unsure (1)..(16172): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttacaaagatgggaagatgagcttgtagcttaattttttctagtttgttaagtctggattcatcactgttcaagataaaatgactagaacaatgttggcagaatattaaatgagttatcacatagaataattctccacaacatcaagacataatgagaaaggagtagcattaaatttgaatatgaatcaatagtgtttgcattagaaaaaaatagtatccagtactgattcataatgtggatatggaaatcatggctactttcttttattgcggtggcccttagctacttcctccatgcccatttaattgtcacatttgcaaataactccaagatctatgcaagaaacccttcttctttccaaaactaattctcatcgatcaacatgctgtgttaggcatacatgatacatgtacatgtggatatgcaaaagtgcaattgcatacatgggagacatgcaacgatgtcatttactcatgcacagataaacgaacatatgtataacgatgtcattcacttctacgcagataaacaaataaacattataatagatgatgattaattttgaaagaccttaaaaaatttatatgataattaaatgggtatcatagagtgggcagtgtgcatgcatgcatccatcattcactagtaaaaaacaatatttccagatggcccaaaagtgatttttgtgtgcagacctccggtctgtctgtccggaagggtctacgaaaatccaattttttcacaagggtggcgcgcccgcacacaaaaatcaaattttcacgcgcgggtgcttatgttgtccacacgcgaaaacaaaaatccaaaaaaaaacccgcacccgtcggccgctcgccgcgcacccgccgccggatccgggagggcacgtccgtccaccgctgccgggctcctcccgccgcctccgtcgtgctctttccgccaccgtcgtgctcctcccaccactgctgggctcttccattgctgtcgtcgccgtgctcctcctccaccactgccgtgctcttcctcccaccgctgccatgctcctcctgccaccgcccgatccgggcgggggacggccgccgccactggatctacgcgtgggacggccctcaccactcgcctgccaccacgtgcccaccggccgactgccgcgcgcccctcaccacctttgactcccgccgccccacgccagatccaccaccgcttgctcgccaccaccagatataggcgagggagggccaccgtcgcccctcgccgccttcaacgcgtgaagcgcccgctgccgcacgcccgggagagagagagaaagagagataggagtatgaggaggagagagaggagaggagataaggaggaggtaataaggacagagagagaggaggggatgacttgaaaaaatttgaagtgctaaagagggaaagatgaggtaactcagatttctgggcggacccttaagaagcccgtctgcgaaaatatatttttccgtgcagccatttaagaggcccgtttggaaaaatgactctatttgtatatacgactcgctaagagggtcgtctgtcaaaatagattttcgcatgcgagtcttttaaggagctgtatacaaaaatatgagtcgatttttaatagacgtggacttacgatttgtctgtaatctattaatctgcttattcaggaaaacttgtgacttagcttgatatagccactatttagtcatctcaatttggcagttaactcagttagttagctagctatggcaactaacaacgtgcatgcacgtacgaggagaagttgatcagatctgatgcattgcattggcgagtagttgatcagatcaacatgcgatcgatcgatagatgatcagatgtgctatcgctgtcaaattaaagaagaagagaaattgaagggttcgcaacttcaaccgttgccatcatcacttgattgatgatcgatctatcgatatatcgatcgaggtcatagtcacatggtagtactagtggaatgaatgttagttggataggtgatctaagcatggatggttccgttaatcgtttgttgacctcacccctctcggaaagttgactagctctgatagatctctactagctagcttaattagctaggtaaacgccttagttaattacagtagtttgtgtaacacaatagcacaaaatgattactatgtgcatatgatcgccattagagcatatcctatagcaaactataagccaatttaattaaacacatgtcgaggagataaaataagagagagtagcagcgagacacatatctgatgacagctgcagcacggactctaagacaaaatatgtgtataataggtaggactatatattaatagtgtacgtaatatatgtttatatgtaattattgtatgaattgtctattaaattgactatagatgatttggagtaggttatcggctatactattaataaacttgctcttacgtggctgtaggtaggctatactattaatcgcatgcagcactaaataattaattaacaaaattaagcacttgtaaaacttttctcgtgagctagtactccatctagctagatcatgtcagaagcagagtactctagtagttatatatccaatgcagtcagttttcctctaaacggctaccgtttaacggtcttgagctttggattagcacaagctaattaactaacccaaaactttaccacgaaactgcagcttttttacaaagaaaagagaggtcgtcgcgggaagatatatcgacaacaaaaaaagatataatttggttgggtttgatacaaccgacagcaagccactggagattatgaggctttgacctaaaaagagctatagttaagctagctgaacaacacatatgtgcagatgatcacaaagttagtagctggtatagctaattagctatgtctccatgcatttctcattctttctttctttattttgagagagagtcaatcactccatcagccagtcaggtcccatataattgacacctatactaatcaaaatcaaatttgagtcaagctgttatctctagagattccatggccggtctgatgctgtgtttagttgccggctggatgcagagcaggtgaaaaaggccgtacagccagatggaagcagacgagcttgttagttggagtggggccctgtagttggtacacttgtactttggccacttatacttgatcttgcacaattatgtacttctaatttggtacactagtacccctactactggtcatttgtactagctagctagcactaccacctttgatcttgtacttatcatgattcatgattatgcacttaatttggatttctcccatgcatgatacatcatgggaatttagggcaatagggttatggggcactatggttatctatgtactccagtattagagcatcactaatatatatggcaaagtgatccatatagatgggacccacataaatagtttatccctatggtaatgtccacaatgtatagataaaaggtattattagtagaagagagaggagtagagatagataatataatttatttcatatgggtagtccatatgcatatggtatcttttgctattttttctatatgaactagttgcacaatggtaataggtggctgaatgaaatattctattgcttatggactacttttacaccatattataaaatggatagctagatgtgatttagtttgcttaattaatgtaggggatgataagaacacaaatgtactatccacatgctttcccatggctcaatgcatgtctgccacatctttcctttctcgagaatcgagttgtaagttttaacaaattgatgtgacatggataaaatgagtgtgtcagagtggttagttagttgttgcaaaaatgggaaaaaaatgattgagcaatatattggagaaagttcattttgttttctttttattttttaattgtgcatgcatgtcacccctatacttgaatattcaaatatgattgagctataagaacattttcaaaagaaaaaaaatgtatgcaatatctcgaccctttagtagaaactttttggtattggtgggattagtcccatatatagtgaacttagataaattaatgctagtattagtatataaaccaacacactgtgtaatcataacacatattgcctaattttgatgattgagagagtgtcgttgtgtgtgtgtgtgttaagaaataaaaaataaaaggggtactgtacgttcgtagtattacatttctttcggttattgagctttgatatatgctactatggttatggtcttgtttggatcctctgaactattaaatagccatccgaaatcttgatatttagaagtattaaacgtagattaccgacaaaaccgattccataacccctaggctattttgcgagacgaatctaatgatgtatattaatccatgattagattcatcacgcaaaataacctaggggttatggaatgtgttttgccaataatctacgtttaatacttctaaatagcaagattccgaagggctccggatccaaacagggtctatgtcttatgaaaaaccaacttctgagttccgaggatgaactgtaaaatcatttatctagatttatctctagaagttgtccttttttttacggagggtgtatttattttgtttttttatttgaagttggttagttaaaaaagaaattaggggggatgtttttaatatactctagcaaggacataaccaaacatggaatcgaatctacccacgcgtcgtctttgactcttttggtcgatatacatgccatgcgacttgcgagtaggtacgtacaattgtattatatgttcactgttaatggatcctgttagagtgctagtataatagtagtatgataacattgaatatgttaattatcacctgaaatctgtttctgtaaaaaataatttcactcatcactatacgtgtatattgacatttttttttggataatcaaatttgtgccagctatatatatcttctaacttaggatattctgcataaaaacatatttacatccatgcaccaaattatcaagctaaggcactcatgtttcaactttcaaattaaagcatagagctgttttgacgaaattgcacgtgtttttggatcatttgatgacctaggtaaacccgagaatcagtttgcaaaattatctttgtgatacagaggttaattcgatctgtccaaggcttctgtttctgctatcgcaatagtaagctgcagacaattaaccataatgtttctacactgtaatgaggttaacttaattacccttctattagccacagatttttctaccttttcttttgcagcgtataacgtattaacgtggcatggcaggcttgcagccagtgtcaaattaatattcattcgcacgcacgcttcagattgcgtaaaagtgctaaatattttccagaagaaacgtggaaaagacatgcacaatagctcccttcgccagcaacacacacagcacttgcaaaataaggcagctaactaaaaataaaaaccaatttctcctgcctaactttcaaaaaaaaaaaaaactgtttagccattgaattccttggaagccaagggctagtcttaacagtcaacaaagcagtgatcaacttgccttaatctgtgatcaacctcctaatcccctatcattactaagaccttagacattcttagtataacattttttaggcttccattccaagggaccttgttaaatacttgctttgtttcataatacaagttgccaaaatgtcatgtatgctagtattggggaaaacatgagtaatttatagggctttggatactaactatatcttttcttttttccttaacttaagcttgcttacaagcagatggggacggggtttggtaaaagtataatcagaaaaatacattaagcaaccctctaaccaaatcatttattagtgttcaagtcctgtatacatcggaacaggttagcataagaaaccaatgtcaaattatcttcaatccagtttgaaaaacttgtgttggttagcttctaagaaatgtgtaggacctattcaaactttggtcttctcttgcacagtaagcatgactaatacattgcaaagatcttaaaactatatactaagttataactctgtaggaaggagaggaataggatacaataaaagtatcattagccttacaacacaacagaagtcaaatgagcaggtactcttgctcatctcacttttgtctcctctaaggttttggcagtagggatgccaaatctgtagcctcctttgaggcatgtggcgtgtgtacttgccatggtaatgccctaccacatgagttgtgagtacattacaacaataattactgggaccaaaataataggtatgatacaaacaaacatgaaacctaaaggcattgatcccatcaaaacaaaatatatattgtgttcaggcttaagagataaataatcaacacaaaaactaccatacgcaaaatgaagagagagaggttaatgtagatcaccattcagattcagtagtactacacccttccaaaaatatatcatttttagctacaaactttcctcgtcatggcaaatatgaagttttttttgggacggccgtattaagatgaaagctcctagatcgatttatgtcttgatttattcatcttgtgttcattgagtcaggtacttatgatataaaatcacatagtaataatgttctttaaaaaagagcctttttctgcactacatttgcagatctacatcagaacaagggttctagagctatacacgtagcatgcatacctgtgactgtctctgtgagcctgtgactgtaacaaccgccatgctgcttccttcaagaaacggccactgatatgtgcttcacagaagaacaaggctgccggtgacaaagccttggaacagttgaagaacctgctttgtgacaagaatgtaggccatgcaagacacctaacgccgaatcatcatcacgcaccgtgtgttgagagttggtacatggcacatctcgtttgacctgatcgaccgatcccccatctccatgcatgtgttagctaggatatcagcacctgtgttgtacaacaaaatgcaccatggtactacacatcctctctccgaccattgatgagccatcagaactcccagttgatttgatcgctgcaacaacatacaaaaggtaacttagtttggcagtacaattatacaaggacaacagcatatgaaaaatgttggatattatcctttgatataacgtttctactaataagtatacggaatgtagcatcatactttaaatgagccatcaaaaatgccagtttgatcgctgcaataacatagaaaaggtaacttagtttggtggtatctacaaggacaacagaatatatgaagaaaccttagagattatactgtgatataacgtttgtagtaataaatatacggcaatgtagcatcatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacggaagcaaaaccttacttttgtctacgcttttgtgctttgtcagtttgatttcacacatgatgtgcaaattatcatgtgttttgtgaggttaaattttggatatggtccagggaatatatatatatatatatatatatatatatatatatatatatatatatatatatatatatatatatatacatactagtacaacctgtcaggtgtgggcctactatgaggcaaaaaggttaaagtgagaggaacgactgatatatctttgtgcatatgcattgcctcattatggtaatttaaaacaacatctctaacgttctgatacaggagggtataatataatattatataatccatcaaaggtttcgataatgagtagaaagataatgtgtagtgtacaggggcagattatgctgccttctagtttttcatagtacaagcagttatatgaatatttaattggaatgcttatttttaagtagcattttctgtttcatcagaccattttatcctctctccaactgctaagcaatattgagcttcatttttgagagattatcacttatcactccatctacacttgttgacaatgacaagcattaaatcttcaaatgactttgctaaaattaaagccccaaacaaaacaataagacgaccgaaaagccttgcaagcaagttggagttactattagctgataattgatggaattactgaagcagttgagcacaatgcgtagctagctgacttattttatacgcatcaccctaacaacccaagctgccctgccgcgtctcatctcactgtcctctgctccaaaccacccttcctacatgcacccccccacaggtgctatatatgccaccccatgcccgcctcttctcgccacccacaaccaagagaagtagaaacaaacagagagcaattctcttctcctacctagcaacctagtgcagtgcagtgcagtgcagcgaaggtttacttggcgacttccatgggttgcctgttgatgctctgcttggtttctcccctcctcctcgccacctctgtccacggcaacccgtggtatgggtatgggtatggcttgttcccgcagttctacgaccactcgtgccccaaggcgaaggagatcgtgcagtccatcgtagcacaggcggtggccagggagaccaggatggcggcatccttggtcaggctgcattttcatgactgctttgtcaaggtactgtgatttctcttctgctgtagcattctttacttgtcttcacaaagctaatggtgctcggttgacatagcacctgcagtgtagcctgcaaaaacataattcaaatgagttgtatgcttagtgcaactagaaaggcaattatatgcgtttcacttgcttttgcgatggttaaatccatatgaaggtattgcaaatagtcatcaaaaatagagaaaaaaaagacatgtatttgcagatgcaactttagctgttacataacgaaaacgcaaagtgtaggagatcaaacctttgttatatttgtacctaggtattaaaaaaggtacccttaggagcatggaagaatctatagttattaggcaaactttttaccactgataagatagcctaccaacattgcccatgcgagcactactttctgccttggtgatatgatgagtccgtaccatgatttcttgattattcactttcttttcaaagagaggatgactatttaattcaaatgcacaataattggcgctctcgatgtttcatttatcagagaccttcacccagtacaggaccctaaatcaatatatattttgctgttccgttgcatgtgcctaatctatgtactacttccatgtacctaatctatgtaccaacattgtgtaggggtgtgacgcgtctgtgctcctggacaacagcaccaccatcatcagtgagaaggggtcaaaccctaacatgaactccctcaggggtttcgaggtcgtcgacgagatcaaggccgccctcgaagcagcttgccccggcaccgtctcctgcgccgacatactcgccctcgctgcacgcgattccactgtcctcgtatgtagcagagataagctctatcagaaccacacaaaagaatatcacattcggaaatagaaggagaaatgaactgtgtattattattatttctgtatgagcttagagaaaagaaccgctcctaggatgagctcaacagtgccgtgttttgtgactgaatttgcactcaaacctgcaggttggtggcccgtactgggatgtgccacttggccggagggactcactgggtgccagcatccagggctccaacaacgacatcccagctcccaacaacaccctccccaccatcatcaccaagttcaagcgccagggccttaacatcgtcgacgtcgtagccctctcaggtgaacttcttcttaccatcttatgagtatgtgcgtccatttcttgagagagatctttcttacattgcacaaaaatgggtgcatacatacaggtggccacaccattggcatgtctcggtgcaccagcttccgtcagaggctctacaatcagagcggcaatggcatggctgactacacactggatgtgtcctacgcggcacagctgaggcagggatgcccccgttctggtggtgacaacaacctcttcccgctagactttgtcagccccgcaaagttcgacaacttctacttcaagaacatcctgtctggcaagggccttctcagctctgatcaggtcctgcttaccaagagcgctgaaacagcggcgctcgtgaaggcgtatgctgatgatgtcaacctcttcttcaagcacttcgcacagtcaatggtgaatatgggcaacatctcgcctctgactggatcacagggggagatcaggaagaactgcaggaggctcaacaactactaccactgaggttgtcttgtgtgctgagttttacaaggtggtggtagtggcatgttttgtttaaataagtaaagctggttgtaatgcgtcaaggctgtttgatcatttgtgttattgtgattgcgttgcaaaacgtgtatgtttaataattcaatatataaaatgagttcatttggttgttctagatctggttgtttgacttaccaaattctgactctcgagtccgaactcatggtacatatccacctactcttcatgagttaccctagtactccagccgtgctagctttgacatttgtcccctgtcaaaatgatatgatgtagtttgtaagaaatacctacagttactcatgtagtcatgttgtatgctgtatctcaagaaatctcccagtccctgatgtaatcatagtctaaactctaaacatgacttgaccagtccctgatgtaatcatttagtctaaactctaaacatgacctgaacaatttcataataatcaccactaaggtatacaaagtatgaaaattcaaaaggtttgcaacagtaccatggaagaagtaaaccatccaatttctagaccaagaaatcaggcaaaagtgatatatttcagtgtatttatagccgtggactattaacagtctcatctttatttggcagctacagaacaacaattttcaaggatttatggccacaatgttttttttaaaaaaaaaatgaacttaactctatgctttttgatcattaagtttcagaacacctaattctacagccctacaggtggaggtgaccaacaggtagggcaggtcagcaagccagtaaactgtgttttggttactgttgattttgtcaaccttatgagttatgaccttaaaacacagaataatgtgacactagccaaattaaatacctgccgatttctactaatatggccacaaaacatatttgtgttatttactgaaagaatgtgtctggacatcacatgagtacattctttaaaagaagttaaaaaaacatagctcctctaaaggatgcatagaaaggagtttggctgacagtagctccctttctttcgtacaatgttttttctttaatcatagaatctttgtatgccattccctaaaaaaagaatctttgtatgccatagttgtctagttgaatacacccactaatgtgaagagaggaaaccaatgtcaattaagaaggaaaagacctaaatgccaaacatatcaactgaggttactagagttgaatgcaacaagatagacactgaatttcaggatcttgaacaatgtcaccatattggacaaacatatacacaacaattgaccaacatgaatgacaaaaggaaaatacatgtacccgtatgtccaccatcagaggccttctctaactactgaagtttggaacctaaggcattcagggtgctcatccaggttgcactgctcaggctgtaaagagagacaaaaacagttagaccataaaggttagataacgagtcaaaaggacacatcatttttgttagaagagagaaatgttcctgcatgtgatagttaattccacctttatgaaccctattttgccaactgacaagacagttcagtcatgttgacaaatgttttcctcacctacagaacacaggacagaagcaggtctaagatatctcgtggtttcttaagtatgcatcaccaagcttcagttatatctaaaagaacatgatgtacttacaagttagatgacactttgtttgccaatgatgatactacaaaccagcaatactttgctaacagaatgaactagctaccaaattcaactagaattctgaatcattgcttcaattgctttgttggccttaatcagttccccttttaagcaaagtgaagcgattgctggataatatgtgtcaaagtcatcatggaaagaattccgtagcaaattatcatagtaaatatcagtatcatcacttggtgtgcataaattctcagctccatctattgtgggttgaactgtgccttcagaaattccatgaagacagttgctagaaacaccataagtagttgaacataaaacttgtccaggattatccatattacgatcataagccacaggtgtctctacgttcttcaggtgactaagcgtgctacaattattagaatctgaagaggatacagacatgagcgccacttcatttaggatagtcacgacctcatcaatcctcccttgctcacaggcagaaaatagaaggccaacaaaagattctgcttggatcttatccccaacactgtttatgaactctgcaacttctttgcactgaaacatctctctcaagatgctcctagattcttccattcttccttttgcatagagtcctttgaccaggctcatgaagccaacaaaatctggaaccatctccttatgatagtattcactaaagaagcctaatgctgattcaatgtcaccttttaggcagtgtccattaattattgcaccaattgtaatagcgtctgggaatagaaatatttcctcaaaatgtgatataagctccagtgctttctcagttaacccgtagttacaataaccacttattagcaagttgtaaacacgtgtagtgggtttgatacccttggtggacattttctgaaacaactcatgagcgtcatccaaaaaaccttctctgcacaaagcagctataagtatagagtaagttaccagtgtcggaagcacttcactgctttctaggtagtcaaatagccggaatgcttcagtaaggcatccctgctggcacaaaccattcagaacagagttatggatgacaatgtttggctgaatcccttcttctttcatgctttcgcataggtctaatgccttctcaagataaccacttttacaaaggccttccactaatatggagtacatggcaagatccactgaataaccattttgttcagcttccttcaaaaagttgcatgcatccagaattctaccttccctctttagtgtgtatacagcttctcttagaacactgacaggaacacggccattgttcatgtaattggaaaacccaatagcttcaccaacactgttcttgctgaggtggcaagatagcatattaatcattctaggttcatccaggccatgaattttaatgaactgacttaataatggctggatggtctgttcatgaccatttcggagcaagcatttgagtagcctgtagcatgttttgctagttacagtaaatgatttcattcttagaagcttgtaaacatccaatgctccttggtagcaatctcttgtgcttaagaaagcggaagcataattacatagagatgaaaataagtcaatttcagatccatccaccttaagaatgaaattcagcacgccatgttcaccgccttctttaaagtgtgtatggatcaacttcttgtaagtacaggaatcaggccttaaatttctttggataagatcattaaaaatctgctcagccatgtttacctttcctccattacacaatgctataatcaggcaattgtgtactattgtagaggagaacaagatgtcttctttgtaatcatcaaacaactgcagtgccctgtcagtttctccaagtttacacatcatgtcaataactgtatgatatgtgacaatattaggccttaatctcatctcgggcattctaagaaacaagctgcaggcatcatccaccttcttaatcataaataatgctttgataagtacattgcatgtgacaacatcaattgtaacaccgctgctctcaagcctaccttttattgccattacaccagttgcatcttctaccttaatgtgaccatgtaacagcgtgctatatgtgaagttatcagcagcaataccttcatatatttcaacagccttcttggtgtgaccaaccttacatagaccatttattactgaattgtatgttacgattccaatctttatcccctttttatccatctcttcaagcaaagagaaagccctatccaaatatccctttttgcacaaattgtcaatcaaaattgagtaaacatattcatccaccaccactcctgtctgttccagtttcctcactatagaaaaagcatcatccaacctgtttctcttgcagaaaccaccaatcaatgatgtataagtgatcaaattcggcttagcatcccttcggttcatctcatccaagaatcccatcactttttccacactacgttctctgcaaagtccatcaataacagtagtataactaactacatcagctgcaatgcccttatctaacatcacccgatgctcacggagccctttcatcaataacccgctactcatgtatccatgaaccaagctgccatataaaacagcatcaccaaccaaccccttcccttccatctcccttaccaattgtgctgcctcagtagttctccctacacggccaagcacatcgacaaaagcggttaatgtgatcaagcctggctcaaatccattgaactctctcctcaccctcctatagaattccagcccatccccagccttcccgaccttggagaagcctgaaatgatcacgctgcaaacacgatcatccacctgacaccccgctgcagccattacgtcgaacaccttgagcgcggtctccatgtcaccgcgggcacacagcatcgtcagggccacacgatacgtggacggagaaaacacgagcccgcactcctctacgccggcggagagcacctccagcgcgcggcgagcatcgccgcgcaccgcgcaggcccggcggagcagcgcgtcccagaggcggcgcgcggaggaggttgccgggccggcgagcgcgaggcgcgctgccgcgtcgcgcggacgggaagaatctagaagcgccgaggcgaccaggaggtgggtgcgcgcggtggggcgcacggagttggcgaccgcctgcgaggcgagcgcgccgacgaggcggtgcctccgccggcggaggagcgccgccagtaggatgtccacgcggcgcggcgtgacggcccttccgagcttgaccagcgacgggagcggcggtggtggtcggggctcgccgccggcgagcggcatggcggagggtggtggtggtggcgccgccgccgcgtggaagcgaagcgcaaacgttcgaaacgttggaagccgatggcgtgggccgaatttggatacgagcttgttggatctgggcctgaatagatatgggcttgtattggttctgggcctgtttggatatgggcttatttaggtga

SEQ ID NO: 13032 - DNA, 52303 bp, Oryza sativa
ggcggtggtggcccctccggtggcggcggcggcggcggcggcggcgggggcgacggggcaccagcacgaggggcgatgggtgacgcgccgccgaagcaggtggcgcaggcgatggagcggctggggcgggcggggcggctcatcgcggacatccggctgggcgcggaccgtctgctcgaggcgctcttcgtcgccggcgacgcgcccccgcacagcgccccgcagcacgttgagaagaccgcgctcgccgtcgcccaggaggaggccgccatgcaccgccacttcgacgacctccgcgcgctcgggaggtaaacccatctccgccccgtgcccccacactctccgattcagaagtttttcatcgattccttaacctttgactgttacgtcgcaaaatacaactaattccctccgagaagaaccattcccgtcatgattccacggttgcagtctcaaaatgaaaaaggaacattcccgtcatgataccacggttgcagtctcaaaatgaaaaagaaatattcccgtcatgataccacggttgcagtctcaagaagaaaaaggaaaacccttgtctagataatttctggaaattggtggctgggatattgatttaacttctttggattgtatgattggactttttttaaagtaataatctccttcccagtttaggcatggcagcacattttttttccactaaattgttctgtaataatggttaatcaccataaactgatgccacactcttctttggtgttatccaattgcttgtatcttgtgaaacccttctacctatgaaaccttgctacgagagatgcacggacaggcttaactgctcaactttggtatatgaactttagcattctagaatattggctgggtgcctgggtctatcagattgggatgcatttctggaactcgtgttccttggcttgtaatagagcaatatttaaccttaattgaacagcttcagcttgaacttgttttggggctgtttggatcagggactaaaattttagtcccggtcacatcagatgtttaacactaattagaagtattaaacgtagattaatgaaaaaatccatttcataaccttgaattaattcgcgagacaaatctattgagcctaattaatccatgattagcctatgtgatgctacagtacacatgtgctaattatggattaattaggtttaaaaaaattgtctcgcgaattagctctcatttatgcaattaattttattattagtctacgttaaatacttctaattagtatccaaacatgcgatgtgacagggactaaaatttagtccctggatccaaacaccaccttagtgccactcagggctcgaactagttttagtatcactcgtggatggtaaggatgtagggtaggtgctcactctataatattgtctcagcagagcagttatgtgttgggtacaattgtttacatgtgaccacttgaccagtcgtttgttgaagaagtctgcaggcatttggaaaatccatgtttcatggcaacatggtactattctgtctgatgaataaaatgtccaagcaatatgaactgcttgttaaacgatggtttttgagtctttctgcaacctgaagttgctagataaacggaagatgaaatttgcaggtgatatagttatgattttagacagaatagttagtttgtgaaaatcctgaagttaggagtactagataagcttaagccatgtgactgagatttttttaagtcaaaggatattaggagccatcttcaataaagttaggtatgtgaacaggatggattcactcgattttgctggtgctttcttattgttctttcacagtattcttgttatagtgtttgggttagttgtgcttgttgctattcatgatgtttttactttgtgatgaaccatcaatcattgcttacacagttctcctggtaagttccaattatttttattgaacttcaagtttcaagttccactatttcttcataagtgttggcctagccaactgaaagtaaagatctagtttttaaactgtagcctaataaatatcttgtatccattgctgttaggaaggcaattggaagagtctggagttctaaatggagcccttaaagccagaggcaattcatggggcttgcacatgccacttgtttgtccagatggtgcagttgtggcatatgcttggaagcgtcagctggctggtcaggctggtgcatcagctgttgacagaactaggtaatttcattaccatcattgttgtgttgtatgtttgctgccacaatatgatgtgcttatttgtcttatttatattctgttgatgtgtgagatttcatcaaccgtgcattgcagaatgcagattaaatatttataccatgttatttcttcctgcgatatacgataattttcttggccgataaatttgtactgttgtttccctctttcccctttaaatttgtactgttgtttccctctttcccctttttcccttatttctcctttttccctcttttgtttcttcttttgcactttgctttctctaatccttctactatgataattacattcttccaaggtgtggagtgcttttgtaggaattgaagtattagatcagttcttgttttcgttgcatccatattttattttgattttacacagaatgcatcggaaatattccaacgcccttcattcatgtgcttctttagatgtatgtacttatgttgaaggcttcaagccttcggatcatcccctagtccccatgacaagatacccgaagtttattactatttacaaaaatgggttactatactaaacttaacagctatcagccacatgcgattgtacctagtggcctggcctcaccttttttaaatttaaaatttaaaatgtatgccgctgcttaatgcacaaattatttggcttgtgaacaggcaaggacatatggaatttttattatccatttatcatgtgtttataatgttcagaggtatatcaatttcaggtttatgctaacatatagatgtttccaggttagctctcaaggccttcactgaccagaaaagaaggttctttcctcatctagatgatgaagggtttaaccatctgcatgatggtgaacctggtctcgctaaaaagccaaggctgcctgctagcaatggggagcttgaagaaagaactttatctgagatactaaagaatctagaaaatgaagttcctaacatgaaaatattcacataccggcgtctggattggtcaaaaagagctgcatcattagcaacccttatgaatgatgactttgtggatccatctaaggagctgaacctgcaaaacatgagcaaatcgggatctggtgatacaactccaatagatcaggttgcgataattgagttgctagctccttctatatttagagctatagtatcactgcatcctgcaggatctactgatcctgatgctgtggctttcttctctcctactgaggtaatcatgttttccaaaagctaacttgttaattagtggtcatggatgcacaataccttttcttaatgttgacacatgaagtgaatcttatattagggaggaagttacctacatgcaagaggcctatcggtgcatcatgtttttaagcatgtatcggtaaatgcttcttctgtgttctcttttaatattgttttcaataagagggcattacggtgtaacgaatacactgttttttattatatgtaggagcatgcagataaagcattgcaatactttgtcagtgtggaaccaactaaatcactttctctgttgctggtaagtttcaacaagaattggtaaattgttcagaatagtaatccagtttttttcaaaggttcattaaaattatttttactcatcgttatttcctttattttgaacaatcctattgcaataacgtcacattgtaatgctaattatttaacatgttaacttcttgcagcgttggattgccagctatcagactctatttacaaaagtttgcaggtacacacacatattatatatctaacagatgtctcttgtactatcgtcacaattttacattccactacataagtaacactcttcattactttgcgtgcagtaaatgcggacggcttctgctgatggacaagtctttggctctgcttttaccccctgtccagcgcccataccatcatcagacttctagtgttggttcagatcctcaggatgcctatcacattggatgttcttcctatgatgcctgactcttctaatgaactctcgacttttagctaggatgtttcaattctgaggatatattgcctgacaaacatgtgcaagactaatttgtaatggcagttctagattctttttttccatggggttcctgcagtgtagctgttaattttctacatagaaaaaggcgtggttatttgatgagttactgtagttgcagtttcatcttggtagcatgcatttcaggaacagatggtgtaaaacttggaaaggtgctttgagtcattttttgtgaatttcaattatcattttggccctctttggaatgtggcattttccttttggtaacattttgtgaattttctaccaaattccaaagcatgttcttaataagtgatgcctgccgattaggccggtcatactgctgatccatggacttgaaacttcagtactgactttaacgtattgtactcaaattgcccagtaaactagtctcttggttggaacaaagaatttaagagtattttttccttttggaagagaaaatgcatccagtttttttctacatctttcctttactatgaaacttttatggaatacatgtgcttaaatgagtcttgctggggtctggggatcatttgatctgcataattttagtcacggggacaatgaaaggctagtgacagggaaagagctgaacggcaagaatcttactccctccgatcgtaatttgttcagttcgctggtactccctaatacgggatatgtaaagattctccctccgatcgtaatttgttcagttcgctggtactccctaatacgggatatgtaaatgttcaaactaagggtgtagctatatttatggcgccatatttttcattaaaaaatagtcggcatgtatttacattgtaagtccctaaattacatatgtaattttagtgtatttacaatgtaagtatcaaaattacatatgtaagtactaaaattacatatgtaaattcgaaaattacatactaattacatatataagtggggtgtaaatgaggtgtaactactgtgcaagtggctgaaaaaaaatcgactgtagcatatggcgccatatttctagcaaatccgatgttttatctcgagatggagggaatactttttaactctaggggtaataacgacttggcattgtcattctactcatttttaaaagttcttctaatgaaaatgtggattttaacaataccaaatttttgaaaggtgaattttggtaataaattgtacaggtccttcatatttatggcaagtttccagtcatatttttaaggaagttccagtcatgtttaggctgtgttctttactcctatctttccaactttcactctctcatttttcacacgcatgtttttcaaaaagaaaaactaatttgtttttataaaaaacttatataggaaagttctaaaaaaatatattaatctgtttttttattttttactaacaactcataattaatcatatatcactccatcgctcaatgttgcactagagatgaaagattctcaacccctgcaaaaccatgcagccaggtccctgtgttctctcccacgataacttacatccttatttttcgcttgtacgctttttaaagtgctaaacggaatatttttttaagtttctataaaaaattgttttaaaaaatcataataatttatttttttaagttttctttagctaatacttaattagttatgtgttaatgcatcactccgttttatgctcgaaggaaagaggtttctaacaccacatccaatagaacaccacctccaagagaacccagcccaaaaggcctatcatccacggcccacgtagtaggacaaaagctcggaaaggcccacgtggcgcaccgcctcacgtcgccaccgtcccaccgacttgtgatttccaatccctcaaatactgtaacgccacgtcgcccaacttttagtaacggcaccaatctttcccaccccccccccccccacccccacaaacctgaaaaacgccgtcgccggctcgccgccgggatggtgttcctccgcgcgccggacggcacgacgcgccacgtcgacctcgaccccaccaccgccacgctcgccgacctcacagcctccgcctccctcgtctctacctctcccaccgccgcctcctcccggccgtgccgtcccctctcctggcgtcccttcgggtctcgccctcctcctcgctgctcgtccacctccccctcctcggaggcggcgggatggcctccccgaccgcgaccaccccctcggcgcctccgccaccaccaccgccacccgcagcttgcgccgcgcgctacgacttcctcaactccaagccgccccccaactacgtggcgagactgggacgcggcgccgccgggttcaccacccgctcggatatcgggcccgccatggggcgcggccgtgggaagccgcctggggacgacggcgacggcgatggcggtggcgacgaggaggagaaggggtacgacgagaaccagaagttcgacgagttcgagggcaacgacgccggcctcttctccaacgccggccacgacgacgacgacgacgaccgcgaggcggacgcggtctgggagggcatcgaccggaggatggactcgcgccgcaaggactggcgagaggcgcggctgaagcaggagatcgagaggtaccgcgcgtccaaccctaaaatcaccgagcaattcgccgatctgaagcggaaattggtcgatttgtcagcgcaggagtgggagagcataccggagattggggattattcgcttcgtcgcaacaagaagaggcgatttgagagctttgtcccggtgcctgacaccctgctcgagaaggcccggcaggagcaggggcatgtcaccgcattggaccccaagagccgtgcagccgccgctggcgcagagacgccatgggcgcagactccggttactgatctgacagccgtcggcgaaggccgtggcaccgtgctttctttgaagctggacaggttatccgattcggtatccggtgttactattgttgatccaaggggttacctgactaacctgaagagtatgaagattactagtgatgctgaaatttctgacataaagaaggccaggttgttgctcaagtcagtgatacagacgaacccaaagcatccaccaggatggattgctgctgctaggcttgaagaggttgccggcaagcttcaggttgctcagcagctcatccagcgtggctgcgaggagtgccccacgaatgaggatgtttggctcaaggcatgccggttggccagcccagatgaggcaaaggccgtgattgccaggggtgtgaaggaaattcccaattctgtgaagctgtggttgcaggcagcgaagttggaaactagtgacttgaataagagcagggttttgagaaaagggttggaacacattcctgattcagtcaggctgtggaaatcagtagtagagcttgcaaatgaggaggatgcaaggctgttgcttcacagggctgtggagtgctgcccattccatttggaactgtggcttgcactagcgaggctggagacgtatgaccaagcaaagaaggtacttaacaaggcaaaagaaaagctccctaaggagcctgccatctggattatggctgcaaagctggaggaagctaatggaaacaccgagtcagtaaacgaggtgattgagagaagtataaaaactttacagggaaaaggattgggtattgacagggaggcatggctaaaggaagcagaagctgctgagcatgctggatctgtgatgacttgccaggctattgtgaagaacactattggcgttggtgttgatgatgaagacagaaaacgcacatgggttgctgatgctgaggaatgcaagaagcgtggttcagttgagacagcccctgccatctatgcacatgtgctcagtgtcttcaaattcaagaagagtatttggttgaaagcggctcagcttgagaagagacatgggactgaggagtctctttatattctcctcagtaaggctacaacatacaatcgacatgcagaagtgctatggcttatgtatgcaaaggagaaatggctggctggagatgtccctgctgcccaaaccattcttcaggaagcttacgcttatcttcccaattcagaggagatctggctagctgccttcaagcttgagtttgagaacaatgaaccagagagagcaagaattcttttgtcaaaggccagggaaagaggaggcactgagagggtctggatgaaatctgccattgttgaaagggagttagggaatgtagacgaggaaagaaagctgttggaggaaggtctgaagttattcccctcattcttcaaattgtggttaatgcttgggcaaatggaagaccggcttggtcatgtagccaaggcaaaggaggctaatgagaacgcactgaaacactgcccgaactaatctagaggagaagataaatggcttgaggaagtcacgtgctgttctcaccatggcaagaaagaagaacccagctacacctgaactctggcttgcagcagttcgagctgaattgaggcataggaacaagaaggaagctgatgctttactagccaaggcattgcaggagtgcccaacaagtggtatcttgtgggctgcagctatagagatggtgccacgtccccaacgtaaagcaaagagctcggatgctataaaacgatgtgaccatgatccccatgtcattgcagccgtggctaaacttttctggcatgataggaagtttgataaagctaggagttggttgaacagagctgttactcttgctccagacattggagatttttgggccttgtactacaaattcgaactacaacatggaaacgctgatacacataaggatgttgtacaacgatgtgttgcatcagaaccaaagcatggagagagatggcaagcaatagcgaaggctgttgagaactcacacctgtcgattgaggcccttctgaagaaagctgtggtggctcttggccaggatgaaaatccaaatgctgtagatccctagtctgtatcacttttaactttaaattaaggtatttggtgcaatctgttctcagacttctctcatagagaactttgctattgtgtcctttattgccatactttatgaggtcatattgtaatgcttttcgctgtgttctattttactgttcagctataagatatacagtatttattatttaagaaatatcatgaccagtttttaagatttgacctccaagtaatttgtttgagacaagcagtgttatcatttattttgttggtatcattaagtagctctaccttaaaatctagctaggttgtgtgtcaaggtagtcggaaaactcaattataagcactacgactatgaaaatctgttgatgctgtattatgctctgtgcacaaatgcagcaaaatccatggtaattatacaattgtgtttattcttggcatggccttaaggttctgaaagaatatacttatcaccttctcatctacttaattatatttcggttgaagattgattttgttttactccttaggttgactatgttacctcaactgaagtttttggggaatgtggtgtggcaattctaggtcaaaatttgtcaatcttactacttccgtgccataatatagcaacctagtatatgttcagattcatagtattaggatatgttacatcctatactagcaagattatgggacgaagggagtaacaatgtaacattgattactgagcaatctgactaaaaactcaccagggggctgctccaaccatttgtgatttttgaatgtgcattttagccagtataatggtcaagctatctaattttgcgagaaaacagaataattatcctcttccaattctaactgttggagcagtgggttgataaaatgtctaggacaatataccactttcaggagcataatttaatttctttttgttaccaaatttatattttgtaagaaatcaagcataactatgttacctgttctgctcacaggtcttcttctgcaggtcgataaagaaatatgtagagaaagaaatacaactagacagtgaactgggatgcactcaagcaactgcttctgctacgacctcgcattctctacccaccgaactgattgctgcagtcccccaaccgtgaagcttacctgaagaagcaccaggcatgccattgctccaatgtgattggctatctctagttaatggttagcaatattcttgaactaccatgaccatgtagacaatattcttgaactaccagcaccaggtatattgtttttatgtccttaatggttagcaatattcttgaactaccatgaccatgtagacattgtccttgagatacctaccacaaattcttagcttggtgtatttgctagtcgtcactagattctcaggaatgatgcaatgtttcttggggctctatttattatctgtgcactagcgactttttctatggttataatagctctgtttgccagttagccacattgttcgtggattagtttgtgattgacgaaatacatgtttgcaagtgttctaactttatttgagattagttttctaatttaattccgtagcaaagaattgcttgcaagtaacaaattagttctaaatctgaggttcccagtacagccagttttcttatttggcaggtcattcaaaacttcttttgcaaaggcacaaacgtagtgctgatcgtttacagatataatttagataaaattagtacacatatatcgtgcatctttgtttttgttagtttatttttatgtttgttgaaaccacaccttctggccaagccttaaagagtcatatgaaggacttatcttgttgcaaaatgctaccgcattgtatgaatcataattgaaccttcttaatagatcttccttctatataatcccagtacatgccttccttgttttacctgcatctggctgtaaaccatcatatcgattaaataaagattttagttttacttatttaaatttctgttggaaaatctctggcagaccaggagcatgaagcattacaagatcaactttcagggaaggatcattttcaaacagttttgtgtataaatgggacagtcccactgctgccttccttggcgtcggcagaagagctttgttctacatgtaaggtatagtgttatacagatatcatgccatcaaatgaatgtttctttcggcaaagctcttctccatttcatgtgactaaattatacaattctgaagaaacttcatttcacctagaattttcatgtattccatttcatactatacttaaacaagaaagtgttagtgcttgcatttgatatgggcatccaatgcaatgcttaaaatattataatacttaagcaagaaagctatagaggcattaattgggacggacatccggcagcagtgtatggacgatctaaaattttgaatcatctaactaaatttcttttttttcaaattgtaactaattttctcttattgtcttttaggtaattatcattgtgaaaatactattgtatgtggctgaggctaagatcaatttttttccttcatatattgtcggagggtgaacccctcaagcgggggaccgtgggaccccctttccggttcggaccggggacgcgggtgaaggatcgagaatcgttggggagagagtgagagggggtcgggcccctcaggagcgatgaaagatactaggggtttagacaggttcgggccgccacagaagcataataccctactcccatgtgtggttgatttcggtgggagaatataagtgcttcctgtttttgggatttgtcccccctccactggggcatagacctccttttatatctcaaggggttaccacaaaggcccaagacctagcttcaagggtaaggaaaacattctttacagacaattaatgcttgtcttgtcttccgacgagcggagccacgcgcgccttaccgcggcgtgggtccatcccatcacgccgagcgacacaggtggacacccgtgtcattccttcttaattaacgacgatttccggccgcccgttcccaccgttgggcggggatttctcgaacggaccggtataagaagatttggtatgggttcaaatgagaggcaaaaagcccctcattaatggcgactagacggggtggtgtaggccacgtcccgtgccagcagcaggcgcacgcgcagggcgccctgcccaccgtcacatcagtcactccggtcttgagtggccggttagtgcgcctgcacgccgcatttaatgcgacgtgccacgttgacacccctcaataaatgccgtaggtgggcgctgagagtgcccgcccaagccgcacacacgaggcgcaacatggagggggttggggcggcccgacccctgccgtggcaggtagccaacacatcaaccctaggcatagggatggcaacggggctgcacccgacgggttttgccatcccgtccccgcccccgtggctaaataattttcccgttcccatccccatccccgcacacgggggagggttttcccccgtccccgcccccgtccaggtaggaagcacccgacaggtgcccacacccgacgatgaattctcagatattggaggagcagcaggcagagagtctaatttgtggtagagaataaaaaatcacccagagaaaaaactatttgaaataagcatagacatccacaaacgtcttttgaagatacacatgcatagatctatttgattcatccccaacagagagctatagaagcatagagtccaaagaaatacaagaaaataaaaagggcaagtaaatgctagtaagagtttgatgtgcgatggagctcttgctttgtcgcacaggacaagcaagactagaacacctcgctgctgcagtgcagctagcatccgatggttggaagcttggatgtggtaacggcggagcgagagcgacgcagacgcttgtgtaatgttgcctttgatccggcgacgacggcgcggcacttctgctgcttggcgtggctcgtgcaggcgtgctaccttgaggacggcgacggcatggatgcgtcagtgcagtgcggaggaagggactggaggagtgcgtatttggatctgagaggaggggtgtgctagggtttcactagaatatatatgtggaccttcgaattgggccgtgtaactgagcttttagcttctatctgggctgcggccttgggggatatctacctgtccctgataactcttggccccatggggattcagggccggggtgtgtagaacacccccggcccatgcccacccgacgggtggctcatttggccgacaacacacccatggggagtgatatgctcccatttacagaccctaatagaggttttccccgcgggggatcgggggtcgggtcccattgccatccctacccaggcacaaccctcctcgaggggggggagcgtcacgtgggcttgaggcggccttctctctttgtacgtggtacccccgggcccatatcaccgacagtagcccccggcgttagctctgaccggcgctctttgcagatggctagggttgacgccactcctctcggtcaatggcttgtgggcccggtcttcgtcccacgtggacggattcaacgagtgtggcccccacgcctaggcggggctagagccacgagataacctcgaaaacgtggaatccgggcgaagtgggattgcctcccttgtaatgatgggccatcacttcgtgattactgcatcttacgggggccgtgaagataatgatgggtgcacgaaacgaaaagggtagttcttcgcggtaaccgtgcgcaattagggtagtcgtggccccacccgcattctgaccgaaacggccgcgcgcgtgcatggcgcgcgcgctggaaacaggtgcgtggtgaatcgagggggcggaggaagtggccgcgagaaacgaggagccgaggtgcagagggaggataaagggcgcatgaaggggttttcttcccctcctttcgccactttgcttctgccgctctcctgcgccccaactcaactcgcatcttgctcttccttcgccacactctcgctccccgttccccctcttgatgacgtcatgacgcggagctcagcgccgctcgatggcagcatccttcccccctctcgcattacaaacgagaggttcgcggggttgccgaggaagttcgtgccaatgccgtccgggcgggcaacggtgatctacggcgaggctcgtccagcgccgcagtaccccgagcgatctgtgttcttcctctcctatgcgatggtgggactgatcccgcccttctcttccttctacgacatgctggatttctatgggatccaaatggcgcatctcaccccgaacgccgtgctgactctggccatcttcgtacatctatgtgagatgttcatcggggtgagaccatgcctccagctcttccggtggttcttcaccatgcagctagtgtcctccgacggaggccgggggctgctacttccagccgcggccaaacacgcagcagcgctacatcgggcagacgctgtgcaagaagtggaacgactagttctacaccgtccaccccgaccaccctcgtcagtgcacacggcgaactggcaggaggcgccggtgctgggggacgcgttcgacacggccctcgattacctcgtcgggctgcggtccctggggctaaacgacactatggtcttcggtgattacactcgccggcggctcgcgcctctccaggagcaggcccggggcgagtggacgtacaccggcccgaacgactccacccggacccaccgggaggagacctaggactggagtttgggcgacctgaaggcagtggtctagagggtgctcaacctcggcaatgtcgagccgtcgctggtccccgagggcatcctccctctctgctgtgacccggtgcgggactccattttggccattatgcagacggtggctgccgacgcggggcgtggtggtggtggcggcgcaggtggcagccgcgttcatggggagcacgccctttcggccgggggagtcaacacggaggacccgcggccgggagttcaggctacgctcgtccctccgacttgagaggaaagcggaagcagagggattcctctcctcccccctcctcggcccccgtcccactagggcggcacggagcgcgtcgctggcgggcacttagcgggtgccacgtcgacggcccacaaccgccgcaccgctagaggccggaagaagaagaggctgcggaagatggggaagaccgagccatgccggggggagttcatcaagcccccggaatggagcttcaaacgttgcccctagaggttcgatctcgacacgcacgttgcacacgcccttccaaactttccaccccgactcttgcttttttcgtcctttctcccccccccttttttctagcgaggtctcttctcggggtacaccatgggtaacccccctccccccgcgtcggcccaaagtacccgggcgcgatgaagccaggcccggcgcgcgggagaccgaggcggagagatcgggtgcggaggcggagccccgggtccagaggaggcaaacggcctctgacaccgcgcccgaggacgaacccgaggcgagggccacaggaggcgacccgggcgcgggagacgatgcgtcccgctcggcagatggcgaggattcctcggccgtgccaagggcggaggccgcccggggggcctctgccgctgacgccgccaggagcgcatctggcgttggcgggggcggtgcccaggacaatgggggcaacgcattcctcccggtgctgcggatgctacggcctcacgcgcgcagtgcggggaccggctccccttccaccccctggaccggggccccgaccaccggcgggtcgtcaagagggcgcggtctcctttttcctcaccgactccaacgggctcggagcctcttctgcaggtgatggcgacgacaaacagcaccgtcatcgaggggctcaacgcccaactgcaatccctacacgatgagcgagccgcgctgcaggaggagtgggagcgagtggcagaggggcagtgtgccgtggaggccttggtggccgcaaggcgcactagctccgcctggcggagttgaaaacgcgggccaaggcgatggaggaggtgatgcgggagacggagcaggagagggttgcggccctcatcgccactgacaccatggaggaggcagtgggcgacatccggcttgccgacgacgcgtactcggctgcgctctaggagaggagcgacgccgtggcagttcgggagctccgggcctcgcaggccgacgcgtccctacacctaagcgaggaggtcgtggaggcccgagctgaacgagcgggccttatccctgctgggggcggaagccgctgagcgccggcgcgaggaagtcgtcgagctccagtctcgggagatggagcggcgggcttgggagatggagcggcgggcttgggagatggaggatcgggcccgggctttggacgcacgggaggagacgctagcagtgcacgagtccgcggcggtagagcggaggaggcgaacgccgagtggggtcgcgccctcgcggacgccgaggtggccgcgcggcgcctggaggagagcctgcgccttcgggaggaaagctggcggaggcgcgacgggaagatctcggagcgcgagtccaaggtctcccgccgggaggcggtggcacggcggctcgccaagcgcgaggatgcatggcgggtcgcgagagccggcacctggagcacgctagcatggagcgggccgacctggaccagcgttcagccgagctcaacgctcgggagaggagcttggccttgtcggctcggggcggcatgacacttgagggcgggggagacgccgcacgggagtgccttgccgcggcggagcgcactatcttggatagatcgaggccctccgcttcgagatccacgctgggcctcaaatgcttagggatgccgttctcctgctaactctcacaggacgctggtcggggattttggtcgaccagaacgccaagctccccgccggtctgaccgggctcgcccgtcggctggaggaggtggccgtcgagttggagcatatccccaaggaggtggacgacacggtgaagttgtcgtcggcagcgctggcacaggaggcggtcgagctggtgctagcgagccactgggcctgcgacccagacttctcgcccttcctcacgctggatgactccccccccccccaacaaggaggcggcacatgccgcggtttgggaggccgtggacgtcatcgtgggccagttcgaggggacagcctccccgttcacctttgcttctccctccgatgacgaggaagacgagggcgaatccaaggacgccaaagcctaggagaagcccggcgatggcgacgcggccgatgctccaggtccttcggggggagcggggaaagctagcccgcactgagccgtagcccgtccccctcgcccccccccccctccctcctttatttgcttgatgtacatagctctttatctttaaagcacttttgttttaccttaaaaccgcgtgttaagcttttttaagtgaacgactgcctttgctcgccgtatgtcttatccacgtttgatgtctttcatgtgcctgcatcgagatatccatatgtttgtgagttttgcgattgacgaagggtgccaacccacttcttgctaccaccaagcctacttgactggggtctgggctcgagctgcgttctcatgcgatatgggccggtgctagaaccgtaggggagatccactagcaggctgaccaggccgagggtgttgcgacctagggtcggggacgacctgatctcggccctttcgaagcctcctgctttcgcaacacctcagggcacgactcgcgtctgggcccctcttggcgtatagacggctcgagtcaccaagagcaacgcgaatgccgagagcgtcccagttcgagtaagcgctcgagagaggaaggcaaaagtgggcgtagcggataaggtagagaacaaaaaaaaaagtttgctatttaataggtacaataatacaagtggtggcagcccccggccaacgcggcacgacgcgaaggtcgtgcggggttggcccaagcccaaggtacaaacacttgttgtcttcacgggtagaacttgcagaggtgctcaatgttccacaggttaggcagctctatgccgtcctccatgggcagtcggacagagcccggccaggggaccgatcactttgaatggtccctcccacatgggggagagcttgctcaagcccgcgcgcgcgtttggacgcggcacaagactaggtcatttacttgtaatgatcaggtccggatatggcgctggtgatagcgccgcaagctctgctggtagcgggcagcccgaagggctgcgcgtcacctttgttcctcgaggtagttgaggtcgtcacgccggagctgatcttgatcggcctcggcatacatcgtggcccggggggagcccagggtcagctcaaatggcaggacagccttgcaccgtacacaaggaataaaggggtttctcccgttgcacggctcggagtggtccggttggtccagagcaccgctggtagctcctcaatccatgagtccccgtgcttcttgaggacattgtacgtcttggtttcgagtcccttgaagatctccgcgtttgcgcgctccacttgaccgttgcttttggagtgggcaggtgaggtgaagcagagcttgatgcccatgtcgtcacagttgttgccaaagagctcactagtgaactgggtgccgttgtttgtgacgatgcggttaggcaccccgaagcgggcagtgatgcccccgatgaacttaagggccgagtgcttatcgattttcacgacagggtaagcctcgggccacttggtgaacttgtcgatggcgacgtagatgtactcgtaccctcggcgggccttcttgaaggggcctaggatgtccagcccccagactgcgaacggccaggagagcagtattgtctgcaaagcctgggccggctgatgagcatgcttggcatggaactggcatgctcggcactaccgaaccaagtcggcggtgtcctggagcgcggttggccagtagaaatcttggcagaaagctttgctgaccaaggagcgcgaggaggcgtgggcgccgcactcgccttcgtgaacattggtaaggagctcgatgccctgtttctgagggatgcacttcaggaggactccattggcgccgcgtcggaagagggtctcttccaccaacacattccttttggagactcgagtgattcgctcgcccccttcgcgatcctctggtagagtcgcgtcttggaggaatgcttggatctccatcatccaagcaacctgtcgaggggcatcaatgctggcctttgcaggccccggggcctggactccatcgggctcctggggctgcatggtcgcgtcgggctcccacgcggggggattgagacgcgcagatggatgggcgagcctttcttcaaaggcgtcgggtggggttggggctcgcgaaaatgcaagcctcgatagctcatcaacgacgtgttctcccatctgggcatgtgacgaagttctaacccatcaaagtggctcttcatacgtcgcacttccgggatgtaggcctccatttgagggtagaagcattggtactccttagagacttggttgacgaccagctgagagtcgcccaacaccaggaggcggcggatccccattttggccgccgccctaagtccgcaaggagtccttcatattccgccatgttgttggttgcccgaaaatctaggcgaaccagatacttgaggatgtcgccggtcggtgagttcaaagtgaccccggcaccggcgccctgcaaggtgagggagccattgaagttcatcacccagtgcatggtcgattggctatgactgggggcatctccgagctcgggggcggaaggcccgagcgttgggtcgggattgaccgatggggtccattctgccatgaagtcggcgagggcctggctcttgattgtgtagcgtagctcaaagtggagatcgaactccgaaagctcgatggcccacttgaccaccccgccccgtaccctctcggttgcgcagtatctgaccgagagggtaggacgtcaccactctgacccgatgcgcctggaagtagtgacgcaatttcctcgacgtcgctagaactgcgtacaacatcttctgggcttgagaataacgggcctggaggttagtgtagtcgatgcacatcctgagcttgtcattggccttagggacgacgtccgggttcaccagccactctggatggaccacctcccggatgaaactggccttcaggagatgcgccacctcttcgcggatgaaggcctggcgctccgaggcctgccgccgcaccttctgccggacgggcctcgcgtctggtcgtacggcaaggcggtgctcgatccccttcctagggaccccaggcatatccgatggcttccgtgcaaaacacattggcatttgcccgcaggaacgagacgagcatgtcttactatttgacgtccaagttaccactaatcttggcggtcttggacgagtcgttgccaagctagacttacttgatgggcacctcatcgctcgaagtcctctgtttcttcgggacgcgtgaggttgaggcctcgtgccttccgccgccgtcctcgacttcgaaggctgctcgcgtgcaactccacgcaagccagcgcgatcttgacatcgccgtggacggtgatggggcagcccaggcccagcatcttcaactgaagataggcatagtgggccgccaccataaacttcaccaacgcgggcctcccgagcaccgcgttgtagggcagattgagatccgccacatcgaagtcgatccgctcagtgcggaaattggagggcccaccaaaggtgacggggagcgagatgtgccccagcggctaggtgtggcatctgacattgcatatggtgggtgaaagcaccagagctagttgaccccccctggcggcgcttgcggggtggtcgatttggtcgaaggtgagcttcacctccgaccagcgcgaccaccgtgcagcctcgtgggtggggacagtggccagaagctcgtgcttcatggccttgaagcttcgacgggaggcgtgggcacatgcccctccgtcgatggtggtgatgacgtgttgcggctcctggaagccgaggtctgcgtcatcgggttcctcgataggggccttttccttggcctcactttgccgggtgttggacggggccgctggggctttctcctcccggcgtccctctttccgctcctgctcgtattttttgacgcgtttggccaaattcttgaccgagcggcaatcggcgaggttgtggtgggaggtgttgtgcacggagcaccatttgtccgccgaacgccccccgctggaggtgccggtgtccttttgcttgccacctgcagccttccccttgcgctggggccgcgaaacacctttggcggcaaggacatggccctcgtcgttggagcgggccgacctcttctttctccgcttcttccgccgctcgttgcgagcggcaagctcgggcgtggctgcggctgcgccggagccggaggagttccaggtccaggccttctccttgcaagccacacggtccgcgagctcaaagagctctgcggtattctggggctccttggaggctattttcttgagcatgcggttgtgccgcacgcccctcccccccccctgcgcgaatgtatagatgaccgcatgggcgggtatgcaggggatggtgttgcgcacctggcagaaacattggatgtactaccggagggactcatcgtcccgctgccatactgcgtgtaggtccacttcctctcctgggcgcggatacgtgccctggaaattaacaacgactaccggcggcctgttcacaccgttgggcgggatttctcgaacggaccggtataagaagatttggtctgggttcaaatgagaggcaaagagcccctcatcaattgacctgtaccgctctgtgccaggtgaaattagtgtgatacacatcaaattaacagggcttcgttaattttaatgatgggtcagatgggtactgactactttcgcattattttcagagagaactagtgtccatcacgtcacatgcagtacttgattatctgaaattattctatgaaacaaaagccgaactgtttgcttcttttgagtaattgtctgaagttaaatttcttggcagcggatatggattttaataattcttatagatgcttaatatatgtacggaaaaatgaaggtttttgtgttgacatgctctgctatcttaatcctacttaaccattttatccaagtttttctggaatcattgctcttgtatgtcttgaaatttgtttgtaatgttttgctatcagtgcataacaactgataatttgaggtctatttcaataacttctgtttctatcaaagattgtgtgttattctgtacggatggatagctttcagcaacttcctcttaaatactgataaacatggaagtccacaatcgaagtactggttgaaggaaaaggtcggaacatggatgtatgaacgtgatatctgcatctaattgtatactgtgaattcatgggtgataacttgatcagcgtatttacaaattaagactacttttaagataatgaaagtgatgttcatggatgaccaccttttagggaatcaagctttgtttttcatgcaccagtaaaatttctcgttcatttcttcacttctatttagatttttaggataatatgatttgaaaacacttatgattggttgttttgaattgcattggtattttggggtacggtttgcttgctcaatttgatgcatatccttttgttcttttgccgtttccagagcctacgttcgaaggaccttcagcttcatgttattacctccaatatgatgattgacgctttgctcaaaggaggcagataggaatatgccatggatatgtttagtccagaataatgtggcctacaatttatttaatgattattttcattggagcttctactgcttcccagctacctctttttctcaaagaggaaatatatgcagcatgtgcagtccctccctgagaaataccgttttcaagtatcacatgcagtatttgataatcgaaattctggtctgacaataagaccaaattgctacttcctccgtttcatattataagactttctagtattgcccacatttctttgtaggactcatctgaatccttagtttttataatcgaagtattgtttaaagtcaaagatgtcagaacatggatgtataaacctgatatttagatcagttatgtaatgtgatcatattcttgggagataacaagatcagtttttcagttgttatgtgcttatgagttaagactgccatttcgggaattaattatgctgttctatgaacagatatattttcttaatcccttattcgtttcttctaagcgttctttatgttggttgtttttgagtctgctagctcaatttgattcatctttttggcctgtgtcatgaggtggtgccattgggagcagaacaagctgtgtgaagattgatttcccagagaacattggaaatgacatatagattcttacgcatggcatttaatctttttcaacttactcttgctgattattgtcataatttaacaaatacggttaatgatggtcctattgacggaaccatcaatatcctgtatatccattcagatgctgttcatattcatcttttgtccattactgcacccaactaaaaatctgtgccatatgaatcaaatcaagtgtggttagattgattaatctgaatcttttgcactccttttttttcttcaaaaacaaagatagacataccaatgtagtataatatactaggagagctaaaccaggtgagtgtattttcctgacttaacctagatgtacacaaccagtttgtcaagtatttacaatacatatacatctcgatgtagtttctcatgaaagccctttgcaactcctatccacctcaagttagtggctgcacaaaaagctctctcctgatccttctgaataccgcaaaacctctactgctatacacattttacagtacacacactgtgctgacaaaaactataggaaattcaacaggtaaagagtcaagaagtctcctggaacgactgcgaccgcgacaatgcagctgggtttgccttaagagcacgagcaggacgagtctctgatgctgcttggcctttgctctcacctttggactggaacggcttgaagatgccagggtctccaggcttgatccccagggtggcccagatggagctcttcgccgcctcgtcgggatcgtcgatgcggagcgtcttgggaacccacagtgatttctcctccttgtcctccttcagtgggagagaggagtccctggaatgcttccccagaggggagccattgcctgaacagctgctgttgctcgacgacgatggagacatgcagccgccattcgttctgatccacggtatgttccatgccgtggccggccagctggataagcaaccccatagtgcaggtggcactagagggtatggaaatggtggtgcagaaagcctcgaggcaaccggcatcatgggggagttcatgttcatccatggagctgaactggtgctgcagctctcagattgggaagcagactctggcatgcttgtacctggcaccatcataggaacgttgttccatcctatgttccatgggtacatgtaaggagctccaaggtagtactgcggcactgggccgactccgttgcaatacaccggcgtgctgttcttgtcaacttgggctgcattttcaggtaacacgttgtgtgatgtgattgaagagatgcaagagttatcttcctgattttcacccgttggtactgctgcagcattgggtccattctgctcctgaatgttcagcactgatgccatcgattcacagagtggcacctcaggcccaaatttgagaactgtttcgtttctgccaattggttgtataggggtcgaatgcgcagatgcgaaagcttcagggttcattgacttggatatttccactctagaccccatcatgcaatcaggggccatcagtaagtgacggtagtgcaacgatgagctcttgcttttgcgcctcccagcaccaacaggtacatttctcatggttcccccggcagtccaatacctttggcagttcttacagaagtgcctgggttgattaacattgtagttgttgtaataacaaaactttgtgtccatactgttgcaccgagggcaagggagaatcttatctggcttcttaagtactttgtcctggcctgattcatcatttgctgtcttttcattttcatcttttgagtctgatgctgctttctcttcaacgttgttcatctgaccctgatcttcttttttattgtccaaggtagatctgctgactggctctatgctttctattgactctgatgcatcaaccctcatttcatcatttcccttctcttctggcacatcagccgtcacttcattatcctttttctcttgtggtgcatcgaccttcatttcgttatcttcctcctcttgtggcacatcaaccttcatttcatcatattttctttcttctgtttccttgtgatgatcctaaaatattgccgtagtggatattagcaaggtacttcagttcaaacttcaaagaaacctctaataatgaaaccctttttgaaaaaaaatcactttagcaggaagtttggaaattaaagaaatgtaataggatcacaagtctatggcatggcaaaagataaataatatcatgaatgaatctttcaagcaaatgatatgcaactataatcacctttattcagctttgtgtttcttttcttccaaagaagagacatgttagcaagcagatattctacctttatgggcctaacacttattgtgttgctccaaacattgaaaattgggagcatgaaactatgaggtgtacaccggtatgtaaattcataagttgggtatctgaacaatttggacatgctaatccaagcccagttgcacagatcctaattcaatcgactttagcttcatccatccacagaacatgctgcagagagatatgccaagatgatccgaaggacaacggccaatcatcactaaaaataaaatcatgcaggtattctactcttatctattcaccgtctcgttctgcctcagtacaatcggctacgcggattaattgcttttactgaaaccagaacacatcctaattactagctgagaaaaaaagctgaccactctttcgctaaatgaaagcgaaaagccatggtgtagaaagagaaagaccaccacatgctcaaaagaaccttagattttgcatggatgtcctactttacactcctaaccactttttgaggaggcaaggatgattacacccaaagtacccaaccaaccaattatgctaattgccctctctcacctgcaaatacccccaatcacaattagcaataacacagaacaattatgggcaattctctacttaactgccgcctaagtcgaagacaaggacaaaacatggtgtacggacaggtaggatcatcctaattcttggccttatccacacacctaaaatccaaactgaaccttttttttttcatacacaccaactgatcagggaaagtgcaccgtaactttcacccatgacccatagttcgaattcctcaccttaatctgatcaagaagagctcaatttcacagaaacacataaataacagcctaaattaagccgatcatatcaatcttttcctttctcttccccacaaagcaacaaaaccctccaaactcgaatgaaaagcaacaaaatgcgcacgcgattattctcacctcatcctgcgccgccggctcaacctccgccgccgccgccgccgccgcctccggctggtcggagccgtccgccgccgcagcagcctcagcctctggagccagcgggatcacccgcccgaagagctttatgcccggatccttgtcacacatcctcgatcccccctcacccaccaacaacccgacaaccaccgtgatcctccgccgccgccgccgcagccgctgaccggagcggcgagagaagagaagacgagaggggctaatttggaaataaaactagctaagctagtctcctctacgcatgggacgaaatgggaacaaaaaagagcacgagaaatttcatttcagaggggattgctcttgctatattaaagaaggggattaaccctcttataccctcccaaaacccactattctcaaacacacccctataaaagttcggagcaacatcggttagcataataagccaaagcaaaagccaaaatttgaatttttaaacttgattttgaagttaagatgttttcgatgtaatttcttgatagtattggcttttaaatcgctacgaacaaatatatacctataaataacttttatttcctaataagctgctttgtcatatccgagaatatgagcaatcgatgaggctcttgcatactccctctatcccataaaaaatcaatatagtagtacttaatatgacacatcataatacaacgaatttagatatgtctctgtctaaattcgttgtattaagatgtgtcatatactctctccgtcccataatataagggattttgattttttccttgcactgtttgaccactcatcttattaaaaaaaaattatgcaaatataaaaaaggaaaagttgtgcttaaagtactttgtataataaagtaagttacaaataaaataaataataatttcaaaaaaattaaataagacgaatggtcaaatagtgcaagaaaaaaaaccaaaatccctaatattagggagtacttggtttttttggacggagggagcgtaggtaaagcctgtactgacagggagtgtttatgtaaatatcggttcatataggggcgtggaggcgaattgtccgaggctcgggatggcgacgcggggggcaccaggggcggacagctggcgtccaggtcagcggcgcggggggctcgtcagccacgagttctcgtggctgggaggcgcccggggtgacgtcagctgctgcgggcggaaggcaagcgatcgaatctcgcgaaaaagcggagccaaaaaggggcggtccaggcggccaccccgccccccgctttttctcttctcctttctttttccttctctttttttctttctttctcctcttcctttatcctacgtggcacgtgctggacggaggtgggccacgcgtgtcagtgggacggcgcgtggtggggggcctagcgcaagtggggagttggtaggggttctagccttctaggggagctgacggtgggcccggttggcgctgattggctgataatttttgtcactcttgagctgaactggcgtgggaaatacaagataaataaaatcaccaagaattgtagtataaaatccgaaccccaaatacccaaaattggggtaaagtgacaccaacgtgaattatatttttttaagaaaattaaaataaccaagcgttttagtataaaatattgaaccccaaataccggaaaattggggtaaaatggcaccaattgttttttttaaaaaaaaacaagattagtactctcccgttttacaatgtaaatcattctaaaattttccatattcatattgacgttaattaatctagacatataaatctatctagattcattaacatcaacataaatataagaaatcctagaataacttatattatgaaacggaggaagtataaaacaccgaaccccaaataccataaaattggggtaaaaatgtcaccaagcgtgaattgtttttttatataaaaattagtatcaccaataattttagtagtataaaataccgaaccccacgtccccacgctctactaaaaaaaccagctgcagatcaaaatccgttagctcatgagaatggtcccgtcgtgctcgtaggccacgtggctagagatctttccctggagacaatcccatccacaagttttgttttgagtaaattttttgaaaaaaaatagtgggattccaacatttattcgtggcacttgttactcgctctcggtctaagcaaatcatggatttgggttggttttgtgtgcacatgtggggccctgggttgctctcgtccacgtggtgttgcggataaaatggtggtgagaaaaggacgtccatttggtggaatcaatgtgtcaaaattttggatttagaagtacgtgtttacatatgcaaggtcgcaagaaacttgtttgagctacggcttataagtagaaatggtaaaaggtttaaatagtggactaatttttttcctcatctaaaaatatatgagagcaagatgataaagttgtataagaacatcccctgcagctcatctaaattttatcctccatactcccatttggatggccatccaaaaaaattcccactctatataacttttcacttcaacagatcatccatattacatcctacatataccaacatcctatattttactaatatttttcaattaccacacatttttactcctattgctctcacctttcaccacttaaaaaaaatcttgggaagtgggtagttgaggatagagtgaggagagagaacctccatatttggcttgggaagggctaggtttggaggacctccaaaaatggagtacgtgatagagactctgttggagcactgtttttctcctccatactccaaatatcagatggatgactagatagagaagctgctggggatgctctaagtacccatagctcatgacccattaccacccctatttataagccacaaacaattttggactttaaactcaattctctcattttaaaacataggggttcacaatgtgcacaatcaccgttgtaaatacccacgcccaacttttataaacacatcgagaagactgacatctgaaaaaaaaactcaaccttaaagttagtttagtgtgttgttttatcccttcctaatcttttaactctaaatttagactgctagaatttgaagtacaaaaatcttatccaaaattttctactccatttgctacgtactccatctcgtcttggtttatatataattcacagtcgtagttatacgagcaaatgccagtggtgtgtgctagcgaaattacccagaattgatacgcatgttgagtatcatgttgatggcttgtttggagagtttaagattaagagaagcagctgataggtagctagcttctaagaatctgaaaaggctgggtttccgagcttctgacttctagtttatttctgaattctataactacaacttaagctgaactatttgaaagaacttttgattgtaagaaaaactgcggcagctataagctccccaaatagccttaggctacgctcaggaggagggttggcacgtaaaacgaagcacatattattgcatgattaattaagtattaattatttttttcaaaaatagattaatatgatttttttaatataactttcgtacagatttttttttaaaaaagcatactccctccgttctaaaatataagcatttttagcatagtgttaagtcaaatatttttaactttgactattaataaaaaaataaaaaatcaatcatataaaattgatgttactagatatatcattaaacaaactatcataatatacaactctttttatttaaaacatcttacttttatatatattattagttaaagtagtatgtcgtaaaccatatcaaacttaaaagtgtttatattttgggacaaagagagtatccttcagcagtttaaaaagcgtgtgcgtgaaaaaaaaaaaaaagttgagttggccaaacttgggggaggaacgcggcgcacgaagcggaagcgttcgaggctgcgaccgagcgaagcgtccttggccacaagcaggcgggcaaccttttttctcttggaatccttttccagtttgaggatcagaacgggcccacccccatctgccgctgtccaaccagcagcaatccaccatctactagcagcggggaaaagggaaaatggctcgcggcgcgggggccactttcctttccacccgcgggccgcggccacgtccacttgtcacgtcttcttctctccgccgtccacggttcggtctcccggcgcacgaacgacggcgcgaacacataaaaataccgcggcgcgccgcgcgtcgcgtactcgagtccaccaccgctgtgggccccggcacctttttcctccaaagcgggtggtgtgggaccaggagaagtacggctacgtcgcctgctatgctgtctactagtatatgtttgtgaggcccacctgtaggtggctgtggctcggagtcggagtgaggtttgtggtgggagtgctttttgtaggtttgtggtgcgggttgcgtccaccgtacgcgcggcggctcatgggccgtgccaagtggcgctggtggggcccgcaggttgcagagaaggattctccggtgaaccacactgttcgtggctgccgcctgcagggattttgcctccggcgaaaggcataccaaccggctttgcttcgtttgtctgactataacaaagatcatgcttgtgagacatgaataaataaataaataaatagaatgaaattttctggatcccaagcaaatatttcatttgcatttttttccaatcatggaaagtacattcattataactgttttttcttatccttcctcgtgtcctgtcgaaacagcctagctacgatatttttactctcttgaccctcttcctccttaattttggtggccttgctgctgctagcgggagagagagaggtcaaactcctcccaatcgttagtactaataccgtagttgagttagtctcgcagtcgagccattctcgttgatgggttctcattttaattttcttcttgctacgacttaaattacttcatttttcccgtgtttcaatcaaatgctagttttgaaactttcatgtgttttaaaaattttataagaatctaatgagcatgacattccattcctatattttctctatccctatgttttgagtcttgcatttcaaatggggccttaatctctaactcttgctcaatggattgggcctggttgtagttttacaaatttacaatacaataatgtagaagggaaagtctatttttttctcccttgattataagtcgagtctgattggcatccactaatcgcacaaccagatatagagagtccttaaactatcaaaccggcttgttttgactcctcatgtggttctgatggtggttttgtcctatataacatttgcatggctttacagacaattgttttatctaagagttggtatactcatgccaacatggggcttagtggcaattctagcatgagaaatttacaaaaacctatgtgggcctacaagtcaatcacatgaaaaaggaaaaaaacctagtgccaccatcccacccctcccttctcttctcgatacggcctcgatcccaacacagtcaacggctacggtgaagggctcctagatgaggtagagtgttccttgacaatgtttgtacctttgctattgctagatctggcgatgccctggatgtccttggccatgagcctatgcaacatgctctaggcgtagttgaggtcgacaaacgaccaccgccggcgacaagctagagctagagctcgcctggtagagatggtagtggcaatggtggccaatgagcccatccattgttgctaggcacatcacccccaactatgcgtccatctgctaccattgatcacgttggctctggtagtcgagcttgcttcaatcgcacaaagtcgttagcgtcaaggactatgttacggagctcaaacatatgctataggtggtcgagacagagcttgcaagtgtgcaagtggagttggagatggagaggaccaagaagaatgccaccgtgcctcccccaccacgcctcgctgctcggctgcttgcgtcctcgacgaggtcggacgttgcagctgcccgtatgagctcgagatcgatgaagccacaccttcctttcttttcctcgggtgttgccgcctttctgcttgtgtccctcaataaggttcactactttcatcaccaccgcaacaagctcgagctcgacatggtgcgccatgcccaatgaagagaggatgggagaggtggaggaagaaggcacttatatatgggtcacatgacaattgtttttctaattgtgatgccatgtagacaccagtacgcgacacgtcagatgaaaccactgataaaaccactatatgagaaaaattgatcttgttttgatacttgagggatgtgctatacttggtattacggttgagggaggcgaatcaaactcggcctatacttgagggaagaaatgtagacttttcctatgttgaggttggcagctatatgtgcagcccaggctcaatattgactctttgtttgaaggaataagttcactttggatccctttatttgtcacccagtctgattttcgtcccttgatcgcaaaaccggatacgacaggttccccaacttacaaaaccgtttaaataaatttgaccctggttttaactgaggtggcgcctacgtggctaatttgactcggtcttcatctgacatggcattgacgtgacgcttacgtggcaatttgatccgaataataataaaacctataggacccacatgtcagtttcaattgtgaggcccacgtggaccccacctgtcatcctcactacccttttctctatccccctctctctatcctctctctctctccctcttctctctcctgccggagcagcgggccgagcggtgccggcggcggagcagcggggaggagtggcggcggccggagtggggcagggaaggagcgtcggcggccggagtggggcgggaaggagcgggccaggcaccccgacgaggaggccaaagaacaggaggtgcgcggccacggcgtcggaggcagccgccgcggcgccgcacgccatgacgaggcatgcccgagagaccttcctgatggccctcaccaccttcagcttcctcgccaccttcccgtggctcgacttgatggcgtggagaatggacgagtacctgtcgtggatccgcccgaagctgctccgtgtcgccgcgtcgctgaacgggacaacgggttgctccgcacggcggcgagcggcgccacggtgccatcggtagcggcgacgctgtcggagatggtggccaggaagctgtccgtggacaggtagtttctctgcgcgttcttgatgttcgtcagcagctgcttgcagatctccgacgcctcgtcgttggcgtcgaagtagcccgccatcgccagcttgatctccgacgacgtcctccggtgcatcattcgctgcaattccgcggggacgacgccttcggtgcagcgtgctgatgtactcctcaatgctcatggattccatggctgtgttccaatacaaaccagaatttctcaccattattgatggcaaaatgaactgacacacaagaacatataaacagatgacgaaaagctcaatgttctatctcttttttttcttctctctactgatctcaccttggtgtgatgggcacatgaattgccccgattccaaaactcaatttcttcgagtttcttgatcttttgggacaagcaaaaccggagtcaaatactgccgaaggatcttatttaaacggtttcgtaagttaggggacctgtcttatccggttttgcgaccgagcgacgaaaatcagactggacaacaaatagagggacccaaagtgaacttattccttgtttgaagcctagctctttccagatgggtagaattcggcccagttcgaaaaatgaaattcaaaattagggcgcaatttcattttgtttagaagaaaacagaatccatccatgtattgcagtactgggaaggtcgttccaatcacagttctaacttctaatcatctagccatctagacgcagtattacaatttgcgagagaattccggctggttccatttgattccacacgagatgcattttgttctgcccaagcaaaaatcaatcaagcagagccctaaacaaaaacaaaacaaagggtgaattctttttttcctttaaccatagtccaactccatccccatttccaccgcttcgagaaaaaaaggtaaaaaaaaaagaagcgacaggtgaggtgacagcctgacaccaccctccatgttccgtggtctcggtccacaagaccagtgtgctccccgcccctttctccccgtgtgcggaacccgtagaccacgaccacggtccacggggcctcgtgccggaagcgagaggaagacgaatcaacaaacaaaaagcaacgccacgccacgccacgccactgcagcgtccgcggggtttagggagggttcatggccttctcgtcggaggcgtggaaatcctccgccactgccggccacggcgacggtgacggcgacggcgaccggacccctcctccgacgcccccgctgccgacgccgctgctgcctcctacgctcgctccactgcagcgttcgctggtttttgggagggttgagggcgaggcgatgtcgtcggaggcgcgggaatcttccgccaccgccgtcgaccgtacccctcctccgacgccaccgtcgccgccgccgccgccgccgcctcctcctacgaacgggacgctcacgccgccaccgtcatcggcaccaagcggcggtcgtgctacctcgtcggaggcgcgcgaatctccccacgccaccagcgtcgacgacggcggccgcgctcctcctccgccgccgctacctcgtcctacaagcgctcgtgctacgcctgcgaccactcccagcgcggacggctcctcctcctcctcctcgtcgacgtcgggcgggtcgcttccccgcggtgaaatggcgcacgccgtggagtccatggagaagcttcgagccgccgtgtccaagctcgacgagatgaggcgagttcgatctctcctttttcccggtctcctccctcgaatcgatcgttccgatcctctttcctcttgcaacttacatgcttatctctggcttttcccctgtgcagtgacgaagacaaggactccttcatgcacctcgtctctcgctacctgatcaggtagatggagattatagtagattcgattcggcatgatttctctccattttttagtttctcgtttcgatttgttgagtttttttgggtgcatttgtagggaggagaaagagatgatcgactggaacaaagttgagcgacccacccctgagatggtggtgccgtacgactcactggtgcaggctccccgaggtacgcacgttgttctggatgcctccttcgatttcagcttgatgatccgatgttgttgtgctggtttcgtttgtaagtgctgtgagattcacatgctgtttctgcgattgaaactggatcgtgtttggcgctgcagatatccctgagattagaaatctgcttaataaacttgctgtgctcaagcttaatggaggacttgggacgaccatggagtgcgttgctcccaagtaagcatataaatattcgaattggtgcattttacctctgaattgatttgtctggtcagcttctgctgactgttgttagactcttcctcagtggaacgggtgtacggctgtagtcccaaagcaaagcaattagatggttcttcctccgtagggtgtttatgatgatgcactgacgtggaagatcacattatcatattatagcctgatgatgctttttcttgttattttgcttgtaactcttttgttttaacaaatgtatgttcacatcatattttaatgtgcttggtaagatgtataattggttatagcatactagaaatctgccttgatatgtcttgattttactgccatgtttcttttctggacactgcatgctgaaaagaacatatttcttgctcagcgtgtatctatgatatctgaatggtgtcctaaatgttcttttgagtgctttatgtttctattccttttaatttcctacactgcagctcaaatgacagatcgttcctttccttgaatggatgacattgatcttggttatgcatgttcattgtcattaagtgtcctgatatccacatatatgaattatcttaggtactacattcttacaggcatattcatcgtttcggttgagctatatctgaatgctctaccactgtgcttaatttttctgtattcaaacattcaaatcattacaggctcactgccaacatgttttttctaacatatttgatgcaatgcatcgatattgggtggactaggaatcattatgttctccttgcaccatctttgagattttgccttctgaaacaagtaattgtgcaggtgtacgattgaagtccgcagcggccttacctttcttgaccttgctataatgcagactgaggtattcttaacatatattggtgttttttctttaatgactggatataacatgtaattgtttgtgccttacaagtttcacccatctgcagtttctgaacaagaagtatggatgcagcgttcctatccttctaatgaactcattcaacaccagccttgtgaataaggttgatattcccttcactcatcatttaagatatccttttagcatcttgattatgaccttttatttttgaagatcgtggagaagtacacaaacattgaaattcacactttcaatcaggtataacattcttttcataatattttcttcattttttcttgatgaatatcacatatttacacaattatgggttcaacttacaagaatcatattctatacagaataagtaccctcgtatcattactgaaaagttcttgccactttcaagcgaaggaagtacagggtcccattgctggttagttttctccaataattctaaagttatcacattccgagtgaattgtctgcttaatgaatacatttcaaatacacagtcgtttggcctgtgctatattttgaaatgtttatatttaactcatcccatttccttaaacctgaacattccaatactgtgatcttttgatgaaggtatcccccaggccacggtgatgtgtttttctcattgtgcaaaagtggaatacttgataccatgttgtcacaggtaagaaaaagtctgaagtcttacccttttatataggcaacagcattagcacctagcactattcgttggtttacaatgattgtgtaaaatatattgtattgttttccagaaatatgtaacttgatttttgatatgctcatggtgtttttcatatctttgtaacatggaatgttaatgtcttgcggtaatcttatcatccttgagaaggtaacatattttctagtgtaaaatttagtacctcgaggtactttttcaaggattataaaatttctctaatgtttctccataagaaaagaaacatggtagatttttttttcttttgcattttatataagtgatacacaattatgctttagtcataaatcatgtccaatgatgaagtccaagtatctgtcgtgtaaggggaactttcagagtttgctaaaaacaatattgttgctcagaatagttgaggcataaaaaatgtgttagggtgggaaacaaaagagggggtagccaaaagaaattgaatgcaacccctaaaattattttagggactagattttttaccatacatgattgataaaaaaatgactataaatatatctttttagtaatttattgcatattgatattcctgtgcttagtttcttttccaaatcttctttcagggcaaggaatatgtcttcatagcgagttcagagaacttgggcgctacagtcgatattggtatccaaatatgagtacaacatccttattaatgtctcatggcttgcatcagaaattgaatccttaaccagcacagaaatcctaaaccacttgatccataacaaaaatgagtactgcatggaggtatgcaagtgtgcaacaagaactaattcccattgaatttggataatacaaaagtcaactcaagtatttatgccaggttactccaaaaacatcggctgatgttaaaggtggttctctcatatgttatgaagggttaaggtatacttatttaatcttaactttgttgccggcgcttaattacatactgctagttcaggagaaaagactatgatttacatgcaagttgcaatgttaaatttgtagcaaatcatcatgttgcttgtttctactaattgcacattgcgatataaaaccgtaaataattttctctgttgttatatacttgtatgcagctgttggagatttttcaggtcccttatgagaatgtaggtaacctctactaaattattttgttccaactcgtcaattttaaggtctgatggatgcttttcttcttttcttttgggggggggggtggccttcaggtagatgaattccagtcaattgagaacttcaatatgctcaacactaataacctgtaagaaacccaggttgtctgtctcttattaagagtttgaacccttgctaacagcttttggatataggcgggtgaacttgaaggccatcaagaggctggtaaaagctgaagcactaaagatggaaatcattccaaacctaaaggtgcaccatccgggtgaatttgttctctacttctcatttgcactacatttatctaagcattgtttttttgtgttacaggaagttgatggtgtgaaagtcttgcaacttgaaaaggaagctggttcagcaatacaggtgcaagacactttcttagtcttgaacttatgatatgttgctcctcctttctgttcatcttcaaaataatatgccctaatgcttttcattctatttatctagtgctttgaaaaggccattggtgttactgttcctcgctcaaggttccttgcagtaaaaaatacatccgatctgttcctcatcctggtatatttgaatcttttccatgttcttgttggtctagaatcataaatgattggttctaagtttattttttttgttccagtctgatttatatattgtgatggatggcactgtaacccgtaacccagctagagataattcaacaaaccccttgattgatcttggacctgagttcagaaaggtatggcagttgtatttaaaacatctgagatattttaaatttgaagatcaagaagggtcattgaagaaatcaagaaatcagtgaataaatctggaatttgactgtaatttcccttctttttcctcacaaaactgtaggttgacagtttccttgaccgatttaaatcaatccctagtattgttgcgcttgatagcttgaaaatctctggggatgtttggttcggttcaagaattactctcaaggtaaacctcacaagtcacagtaacatattgttatttttttttactccttggttgccattctgtggtgcttggtatgcctcctaattgcagttttttttctgcccatttcaagattttacatgcttttgggctgtgtacgtccattgtggatgtagaggccggattttaatccattttctaaaaaaaaaagattttacatacttcacaattcaatgcctctttttgaacgcatctcttgcggaaaaatggctttaatgatgctactcttattacagggtgaggtgacgattgctgcccagttagggttaaagctggatattcttgatggcagtgtttttgataacaaggtaaaagttcatctctggataattatctgttttgtggttattttggaaactgtactattatttcaatgatgttggcctttttatctcacagcattcaacacatagttctggagccatcaaatatacaatgaaattggatgagggagcggactgtgcatctattgattctgcgctcaatcggctgaacccaggatcaactttgatcctaaagaaagatgatttctatcgatacattgacccaattcaggcacggaaccgggcaatgttccattcagaaagcagtaagccctcatccagcaacaacgagttactccaagacaatggaactcccttcactccaaatgataatagtgacaggatacaacccctaccccttgctcccttctcttcttcacttggctcttcatcactgcttcccttatatcactctagagcccgtcgagcgccttactggtatacacgatttattttcgtgaatccgcgaggggcactgcattcacaatttaggtggctgtgggggcgtataaagtttagcagtgcgaaagatcttgccatattttatggtatttatcatatcgtactgtatggaatagattgcattatcacagcaactttgaaggacaattggtttgccaaactggtgcaaggaaagctgtggcttataatattggtctttcatcagttcaagttgcttagccgccggcgcctccgctggggtgagaggaggaggaggacgctcagatctattcatcaggatatccagagttacttggacaattactctgactccgacatgtggcatttgattgtacacagtgttgctagagtgatatccaatgtgctggaagatgtaaaccgcaaatatatgaagaatcactacctaggctttcttgccatacattcaacggtgtttgccatcgaagtgataggttcatacgctgttgaacttaattacgacattgagcactatgcagaaccgccagagttataggtatgcaaattttctcttatctcattatttgttcccatcttgctctatctcattacttattcccatctttgaacataaggtgaacttcacatatctttgataagtagatggttaatgtcgttggaacagcaatagatattggctttatctgagtaatatattgcttctactttgttacttataatttataagacaactaaaacaatatttaataaatatcattggccggaagttccattatctaaaaaaaattgatagtggaatgattctgtagccatatgaggggctttggttagtgtttaatccagttgcaacacttgctaaatatgattggtatgcttgttggtctgtgagcaaaagctctcaatcgtaaacattttgtcaagaattactcatcagcatttagtatcattatcatgatgctaattcattaaggatcatgtcatgttcaatacataacgtatgccattggtagtgctctgcgcactgtgcccatgttcaattagattgatttgtactctcttcaaaagggcatatctgttagttttttgccatgttttacttgacttgcttcatcatgttaccagtaaacatgggatttcctttgttaatcctatgcactgttgtcagcttatttgttgtttcatttactaatcatcaccagatcatccttgctagaattatgtatgactgatagcttctaacttctctggtagacaggtactcaaggtcccctttttacaaggggaacccaaaatcaagttcaagatcatgatgcctgcacagctcaatccagtacctgatcctgatcccacgcaaggtatcaagaagccacaagaggttttaagccaattgctaatgctacgtatgatgccatctatcacttactaactcatgatgatattgttactgtaatcacacaacatgttcctgatgcgtttctgtggttaactccgtatcatgttctgaatgcgtttttttgtggttcatggtatccatatatgcttacactagcatgactctgtcgtatgtcgtatatctcgtatgtactatgtgcttgactgtggcgtatgtcttagtatgtaattatgtgcaaataagtacttcctttgtttcatattatgagacttctagcattgcctatattcatatatatgtcaatgaatctagacatatatgtgtgcttagattcattaacatctatatgaataatataggcaatgctagaaagtcttataacctgaaacggagggagtactttatagtactttatcttattatctgcattatagggttttgttgaacggggacagctgtttgtatagactagttgtgccagctgaatactataaaacataagtataatggccataaaacataagtatgcgtaaataatgtattcccttgcaatgctactatcccaacaaactgaaaaaaaaaacacacacatactccacgtagaagatgatctgaagaactaggaacagagtacagactggcagtgtgaaactgtgaataatcaggcagcgggtggcttgggcttcttgttcggtttgaggatgagatcggctagaggataccaaattattggtcgcttgtaggcttgtgcgccggcagcgaagaagaggagcagggcgcattcccacatcacggcctggtacaccctcggcaaggggaggaggctcatcaccacgagcagcacgccgcacgagagcgagaagcccatccccaccgccgccgtctggaagtccgacgatctcatcgccgcgcgcgaggccgccgacgccagatccccccctccgcccgacgccgagagaattcctttttttttttttgctgatcgatcgattccgccgccgccgtcgtccgtccctatcaactttctctttcaatctgttgtgtttaggttatctgattggggttggggtatatatgaaccggaaaaatatatatactcatgtaatccgtgtcctaaaacatctccgtctccgatctgtttggttatctgatgcggattggctcgcacgcgcgcgcgggtcacgaggctggtttcggtcaagcaaaagttgcaaaacggatgtggattttcatctctgcacttaggccctgtttctttcaacttaggattattataatccagattattaggagtaagctgaaagaaacagataatttattgaagtagcttattataatctgataagctcatttaggtgagctttttccagattattgggtgaaaaattacccaccatgccaccccactccctttttagacttgcaaacccaataatttaggctctaataatccgaaaagaaacaactaaccgcttattatactacagattataacaatctagcttatagtaatctaactcaataatctagattataataatcccaagctgaaagaaatagggccttagttcatggatggaaagatggatctatgtgttcttgctgaattttttttataatgctattcaaatattcaagctatttttgatggtgtgtcaattatatataatatttgttattgctgaattgatgattatcttgtatttttttctgattggagagagatactacctaatgcgaggcctcggaggggttgtggacggggcttgatttgaccccacatctccagtcggggccaggggcaggggcgaagtcgagggcgggggcgttctagcccaacccggccccgcactgccccggtgctatctttactaagatgtataataccacactaaaggcccttctcaactgtatgtatatgcggcatctaacgggattctacgctttctaaaatatcccacatggtaatcagaactaggggtgggcattcggtctaaccgagaaattcggttcggttcttcagtcttttagaaaattcggtcttcaaaatcacaagaccgatcggtcttcaagaaaactcaatatcgagagcttggctcttcagttatttcggttcggtctcagtcaaaccgaactaaccttagcagcgatttgaagttttgaacaacaaaataaaaccgaacaagatcgacgaatcaaaggaactcaagtcagatgaaagacacaatatgctgccactagtgaatagagcatgattcaggaaagaaaaaaaaaaagcaaattgagcaaatctatcctaccacgacttggatccccgtcgatctccaccactccaccacaagctccagatcccatccatctcgtctcccaccgtgggctcacagccggcctcctctggcatcgaaatccccagctaacggcatcttcctccaccggggtgtgactggccggcagaagcagccggtaggggtcgctactcaccagagggcggaagggtggtgcggcgccagagacggtctcttccactgcgaaaggcggaagggcggcgcggaatggcggaagggcagcgcggtgcggcgtggaagggcggcgcgacaccgtgcaggtcgcgctagcgtggagatgggagaggataaggttgcgcctcagagaggccgaaggagcgatttttttgtcgctaaacttggagtcacgggatcacgggatggggagctaaactttagccgatggggagttagttttactctagatgattttactctagatgatgaggcggtattgggtctagtgggctgagatatcacatgtgttattgggccatttatatatttcggttttttcggttaattcggttacccgagacccaagaccgaattaaccgaactaaattcggttagttgaaattgcagatcgaatttgtgaccgaatctctcggtctcggttatttcggtttctgtctcggttatttcggttcggtctttttctgcccacccctaatcagaaccattttcctcaaaccaaaaccaatcatatgcatcctcgctgtcactcgcgtttgtccccgtcatccagtgactgacaaactcaagaagaaaatcatctcctgtggaaaagcccatttgcgccgcttagagcaagtttaatagtatagccaactaatagctctaaatcatttatagctaatttaatagtcaattcatacaatagttatctataaacaaatactacaatatcaatacctggtctggcctatcatacacacattatgtcttgaaatctatgctgcagctacctgcaaatctatagcccactatttttctctcttttcttttatctcgttaaaatatgtttatagctagcttaattatagtctgctattgtacctgcttttgctgggtttcctggatagaacgaaggtagcaccaccaaagactcttgaagtcaccaacaaatacaagactttgacgatgatctccaataatgagtactagtatgtaacttgggaggctcgagaccagtaggtcttgggcggttgggctatcttttctcctcgctttctcgcaaggtgctcataagtcataacagccgctgcactgaagacgtctgccaaggtgtggtagacgattgaggacatgtttgcatgtcagtctcaaacttgtgttctcaacacgcgtattttctctcgtggccactcacaaagagtttgagtatgttaaatatggagtacaggtggtatttgaatcttctgaagatgaagataaagattaaggacctgtttgttagagctccaacgcctaaatttagctctaggagttgggtctggagtggagttgtgtagttgcctaaacccagctccatctctctagtttattttgtgcgctccacccaactccactcccactttagtggagctgaaactatttgatccactcccactttaggtggagctgaaactatttgattgagctccagctccaggagaagtagaggtgaaactgtgccaaagtgccaaacatgccctaagtgttttacgcaaaacgagcaaaacgaggtagtaataacgcatgcttaattgagctttaattattacaaacttgaaaaatggattaatctgatattttagaacaactttcatatagaaagctttgaaacgcaccgtttagcggtttgaaaagtgtgccacgagtatcgaaaagtttatccaatttttattggagaaaagaacatagcatgtcaacaagatgaaattaaaggccttgctgacgagatggagtccgcaggaaagcatcttgacgatgatgatctcgtctcctacatcgttgctagtatggatgttgattttaatcccgttgtgacgtacgctagttgcaaaccggactgaagctatcaccgtcggtgaactctttgctcaacttgttagcttcgaaactcgtatggagattctgtaaggtggctccaactatgattcgttggccttcactgtagcttgcgaaggcttcgaccgcaggcaaggtggtgactgcatgcggccacgtacgtcggcgcgaaaacaatattcatcccatagaaacaaatattaattgttagatttgtcactataattgcttccaaattatttctcttcctccatttcatattacaagatactttaaatttttttcaaaattttaagtttaaccaagttaacaggaaaaaaagcaacatctataaaattaaattaaattagtttcattaaatctaacactaaatatatatttaaataatatatttttaaaaatatcgttacatttcttttatgaatttaatcaaacttaaaagaatttaatttaaaaataagtcaaaatacgatatgaaatggagggacgaatattctttaaaatttagggtcataagtaacaaataatagtcataatagttgtttatcgaagaccgtcttataatatataaacaagccagttagtttttttgccatgttttacttgactcactttgtcatggtatcaatcgattctgttttttctgtacatcttttccctaccagtaaacatggggtttccttttgctaatccttctgcactgttgtctgcctatgttgttgttttcttttactaatcactaatcatccttgctagtacaactatgcatgactgtgatagcttcttactttcaggtactcaaggtcggaaggtcccctttatactcaagatgatgatcctgatcccaggcgaggatatcaagaatccacgagaggttttaagagcatcctagcagatgctccattcggtactccatctgagatttagcgcacgaaagtgaaaatcggagctccagcagacacaccatcgaatcatccaaaaatagaggatacgcaaaaacggagagaggaaggccaaatatagcgtttctctctccaaacgtcatatcgcaacggccgcagctcccgcccctatctgaagttccgcaaccttctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacctgggccggggtcccaattgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttattgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatatcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtatcgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttggtgcggctttttttttctttttttttttgcacctttctaccttttttttcacttttttcttgatttttttttaacaaaaactgactcaaggaccttaatgtaagattacagggactcaaacataaatataaaatttacagggactcaaatgtaaaagtctaaacctaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaataatcttgactacttccaaaatcagatatggtaattcaccttcctcctctcgtgcacgacagaggcacggccaaaacaaacacacacaaggatcggcaaactctagatgcaactcaagaactctaaaactaaccgacagaaacttctgaaaactacaaaaatagaactgtggcagcgagtcgattccgttttcgtaggtcccgacaacaatagagacacggtggcagcgacgactgtggtacaaaacatgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgattttttttgtatggctattttctggttataggaagataaaaactcaccgagcaacgaaagctctgataccacctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaatag

SEQ ID NO: 13033 - DNA, 17791 bp, Oryza sativa
tgtgattctggccacacgagatagaattcagagaagagggtggatccgtagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaccttcccctccgtcgtcgactcgtcgtcaccggctggaaggagagggaggggcataccagatctagaagataacgtcgccgtggtatccatgctcccttccgcccctccatgcccgtcgcctacctccacccctcggctatcgcctgtctccaccacgcccaccggccgccgccgccgcctccgcgcccatctgccgccaccgctgcctccgcacccgctgcctttcacgcgcgccatccaccgccgctccacctccacaccatgccgcttcgctccgcccgctcgggcgtatcggttctgttcggctggagaaaatggatgctggggttggggtttggtcctgggaacgttgatgtttatatttttttttctttgctctcacagtaaacttggtagactgttgttaatcaacctcaatatacgtgagagattaattagtaactatgtgaagcatgtttagcaaataacattattttttaactaattcaggcttaaaaaacatatacataacaaagttggttagaagatattattaaaatatatgaaaggtgatatggaggatgtaatatggatgatttgttggagtaggaataaatatagagagagaatctttttagatggccatccaaactgagatatggagtaccgaaaactgagatatggagtaccgaatttagatgagttgctgggcatgctctaagccagatgctaatactacatatgcatggccatctatttcacatactctcatgatgcaactataaaacaacaacatacgtgttcttacttcgtttttgtggttaatttcgccgcatgttcttaatgcgtttttttgtggttcatggtatccatatatgctacaagactacactagcatgactgtgccgtatatctcgtatatgtaccatatgtgttttgattgacagtggcgtacaccatgtagctgcactaaatttagtaaaaagaaagaaaacatgcatctgaattattcatataaaagaaacacgtattcatagacagatctgaactagtaacggacaggctgaatctgtagtgaatctagtaggcagcgggtggtttgggcttgttgttcggtttgaggatgagatcggctagaggataccagattattggtcgcttatgggcttggacgccggcagcgaagaagaggatcagggcccagtccgacatcacggcctggtacaccctcggcaaggggaggacgaggctcatcaccacgagcagcacgccgcacgagagcgcgaagccgatccccaccgccgccgtctggaagtccgacgatctcatcgccgcgcgtgaggccgctgacgccatcgatccccggccccctcccgccgccgccgccgccgagagaattcccttttttttttcttttgctgatcctatcaatgtttctcttggcccttgccccccttctctttcaatctgttgctgtttaggttatctgatgttggttggggtatatatgaactggaaaaatataaatcatgtactaatccgtgtcctaaaacatctcggtccccgatctgtttggttatctgatgcgtattggctcgcgcgcgcgggtcacgaggctggtcgctcaccactctccacgcctcccgccattgccgtccagttcctctcacacggagcttggccagctcggcctcatataatagcatatatgttttctcattatattattcaaatatattaaaatgacaatataattttaaattttgtaataactttacaaaactactaatgtgcaatattcatatggtattttatatacgtgtttgttattaattattttttaattccaaattttctgtaaataatatttttatatagactataggctcttcttccaatattatttatttttatttttgaatttttattatttctaattgtatttctatgtgtactctaaactcatttttcaattttctttagtttttaatttcgaatttcaattacttctaaattgtattcctatattgactttaaactcttcttcccatgtttttcttaattttgaatgttagttatttctaaattatatttttatacggactctgaactctacttttaatttaattatgtttattccgaattttagttagttttaatttctatatgaactctatactctacttctaatatttcttatttttttaattccgaatttctatttttttaattgtatttctatatggactctatactctacttctaatattctttatttttaattctaaatttctattatttcctaattatatttctatatggactctatacacttctaatattccttatttttaattccgaatttcagttatttcctaattgtatttctatatgactctagtctcatcttctaatattccttattttttaattccgaatttcaactatttctaaattgtatttctatatggactcttgtctcctcttctaatattccttatttttaattccgaattttagctatttctaaattatatttctatatgtgtaagttcaagtgccttaatttggtttcggtgattaatgacacatctaattatatgagactaacgtttttatgagcctttctttgactagtcttatttggatatgaaagtaaaaatgatgagaggtatgtattaaaaacttcacatattctaacttggtctctcttgtggatccaaaatatagtgtgagctccctcattgatcttgattgataatgtgcatatgcattccttcatatccatatatatatgcacatcttgagggggagcttattctatattttattcattataagatctctatcttgatttgaaattatctttcatctcatcttattgtattgtttatatcaggttattatctatcacaaaagagagaaaagattgaaagattttggattaaacaatttgtgtaattgttgctttggtgatagatgataaatcgatgtttatgggattaacctctctttttcataagttgttaactaggttatttcccgatgatgagatgtggtagatatgcattctttggtgatggaccttaatcatgacaaggatgaaatgcatggaaataaaacgatatgtaccacttcttatctcctttttgataggtttatatgtatgattttcatgttattgttatataagtgtgagactaatgtttactcgagtcatatcttatttagtctaatttacattaagagcatggagattatgaaggtatatgttttatattggtctacatcattactacatatgccttctctatgtgtataggataaaccccccattggttcttctttacttatgcatacacttgtctctcttgtatatttctttgtatgcatatacttagggggagcaaatcctatacatttattgtgtatgttctagatccatgttgttcacctattatttatatcggatctttgcacttgagcttgcatacgggtatatgacacttgaggtgtaaatgaatactcaacaaacatatccatatctttcatatgcaaccggttggtcatcaagtgaaggatgacaaccgatttgttgagactaatgttctcctttgagatgtgaaaaggaataggttccatcgtaatgaggctaatggatgacaacatgggttgatggtcaccaagacaaggacatcgccatgttgacaatagtgaagtcaagattgtgatgagaagaaaggcttgacaaaggatggtcaagacctcgggataaacatggttcaagcaaatggtcacgagtgttgatcttggctcaagcattgaccccaagttggatggcgcaaggcaaagatataatagaactaaaaatgttttcttagtcttttcccggtcttggtgtttggtgtagaccggatttgctagataggcgccgtactatcaagaggggtctatgaagcgagcatgtggatgatcttgtgccatattagttcatatgcatataggtgtattttgtgggcttgtctagacaagtgtggtgagttttatcaagtcccaaacaaagagagaagtgggcacatcctataggtttgggtagcctcatgtggttatgtccggtggagtatcctttggagtgtgagctatttctccctgataaaagttgtgtttattggatggattgttcatgggttggatagccctttgaataagctttccatatagtccaagaacgccaaattccgagatccgagtcaagagatatcgtcgttttactaacggttggttgtgctgaaaagtgacctgcggtctgaccgtaggccttaggtcggtctgaccggggctgttagccggtctgaccggtgtggtaaggccggtctgaccggccctactggtctgttgcactggtctggtttttggtggcgatacagagccgccagagccgcaaccggtcagaccgagccgacggcggtctgaccaagccgtggacggtctgaccggccactacactgctgtcagaccggccaggttgagtgggctcaatgattgccctgtaacggctagttttctagccgttacaaagtagtccggtttgaccggccactctatggcggtctgaccggccgagcacagagttggggatttcgactccaacagctagtttaggtggttgggagtatatatacctactccccagcagcaagattaaggttttggcactccattgcattatcttgaacctttgcaagagctctcacatccttgtgaacttagtttatctagtgatgtgttagagagtgggataagccaatccaagtgcattgcttcattgttatagctagtgtggcacttgatcatcctcagcaagcatcctagacttgttactcttggaggttgccgcctcctagacggcttgtggaggtgttgcccggtgacctctccgaggagattgtggaggaggcccgacgccggttgtgagtagtttggagttcaccaacttcggagtgaaggaagaactactctagtgatcgaggcttgggtagtcctctccgtgggccggctcccaccttgcccacctcttgacgaagggggcgtgcggtggcttcgtggttgagcggtggagttgggctcgcctcaacggggattaggaaaccagcgagtttccgaacctcggtgaaaaatccctcatctcttgtcccatttatttgttgcatttacatttgagcaagtttacatagtagagcttatttgtgctattatcaccctaggcttgcaaaccttaacatagagtagcttctttgtgcacttacgtgagactagttgatttaggttttgaattgtgcaaaaccgttttgatttacgcttccgcatacaaaactcgattttagccaaaagttttaaaaccgcctattcacccccctctagtcggccaaaagttttaaaaccgcctattcactcccctctagtcggcctccttgatcctacaatatggactatgcttttttctttttctttttctccgattaatgtgagaatttataggtcatgagagcgaacgaggagactcctttttctatttctttaataatataatagatttggacaggcccttgttcagatttattggactagtatatattctatccaattccaaattgatgcgttgaagacgcctgctgaggtgtgatagagtaggtagacgatcgatgacatatttgcggatttgcctctcggactttattctcaacacgcgcatttctctcacgaccactcacacaaagggaatttgatttgagtgttgtggagtaggtcaatatataagatgaaaggccttgcggacaagatgcagtccgcaggaaagcaccttgatgatgatctcgtctcctacatccttgctagtatggatgttgattttaatccggtggtgacatcagttgcaaaccggactaaagctatcactgtgggtgaactctttgctcgacttgttagctttgagactcgtatggagtcgtggaggctttcgaccgcaggcaaggtggtgactgcggccgcggacgtcggcgcgacaataacattcatcccatggaaacaaatattaattgttagatttgtcattataattgcttccaaattatttctccttccattttattcatattataagatactttgattattttttcaaatttttaagtttaaccaagttaacatggaaaaaaagcaacacatataaaattaaattagtttcattaaatctaacactaaatatatttcttaataatttttttgggttaaaaatattgttatatttcttttatgaagtagtcaaacttaaaaagatgtcaaaatgtattctgatatgaaacagagggatgactatttttaaaaaatttagggtcacaattaacaaataatagtcatatactatgtttattaaagaccgtcttataatatataaacaaacctgcattttggatttgatcgattgatttagttgtgagggaaaaaaccccattaatccgtaccacctcctccaaaaaatactcaatccttgatactctgtaataaatatggccatatatattgctaaatacagtctgcggtctgcctatacttttgatttttttttcaaaccaccctgttaggggttaattaatctaaccatataatgtgtggtccaaaaccgatacacgcatcatcgcaggggagaggaaacggctcaagtgtgtactggttgccagcatgtttgacttggagcttcgattattctatgcgtgtcttgtacccaacgttgcagttgcactgccaccgagggcagcaacttgccacaaactttctttgccctaatttggtacgagcaccaagggattagactaattaaacctattgagaaaccggtcactaatcgttaactacctctacgtatactctaaaaacctcgtgaacagtcactggcatgtagaaccaattacgcctaacctgccaacaaatactataacgttagtgtgtctagctccgtaagagcaagaagaataatagtaagctataaaactgatataagctatagtaagctataaaattgatataagcttatgtgaaaaagagaagtaacaaaaaaaataaataaagaatattggctgttatgcaagagctagtttaacacgtgttgcaagacaaatatattaaatgtataagtaagagagaagaagaaaaattaaagctaatcttataactaatctatcatatatgttggttttaaaatgggctaaatgagtttacaattaaacttgctataacaaacatattctcgtaataagataaggtgagaacacatgacagccgccgaccaactaattaagccccaaacatgagacaaaaacgacctcgaattaatcatgggtggcaagtgcgagcctctgacagaataattggacctcaaatcgatcgcttagttaggatttatttctgacttgtgatctgcgagcgctgtgaaggtggggggtgatcttgatttgtttagcccagctgtggggcaagatcctaagctggctgggtttagcagttttcaaacgcttaaataatgcgtcgccgggtttggtgattagcgctgggaatctcttcgcagatgggaacaaaagtccaacacgacaccacacagggcaatcgggggcagcgtcctgccattttccgctgaaaattttgatcggtggttgacccctcttccgtgtgtgggacacgggtgaaattaaacggcattacgtccatggaaatggttctcgattgatcggtagttttcgtattttatgaattctacaaattgactttatatagatgtttaaaaatttattttacttttatagaaattatgtttgatcactcagcaatttctgtttcgtttatatttgacattctccctccgtaaaaaaacatagtattagaatgtgataacgactctataagaatgtccaaattctttgtattattatatgccacatcttagcacaaggttgtttttgttttttttttgacgaatagagtagtgcgcaggggtgcggtactctctatagtcgtcgcagctttcgattgtgtaacaacagggctcgtttgaaacacgagaggggaattactgtcaacgatcactgtgaaaaaaagcctgtaaattttctcgctgtcgcgagcactagcaacgcactcgcgactcacacatgtgtgtgtggcacgctttatggtggcacgcgtgcgtatgctagggctaggaaggtctcgcaggcaggcaggcaacgagaggcttttctcctctataaaaagtggttactgtgcagaggtcaagccacacacacacacactgatacacagatcggcagaaaggaaggagaagcagccaagcagaggccccggtcttgtcaccggaaagagagaaaaagagaagtgaaattgaggaagaggaggagaatgtgatggcgcagcagcagcggcggcggcggcgcgggggctctctcgccgtgctcctcctcctcctcctcctcgcggcgctgctgctctccctctccctcctcgctcgcgtcgacgccgccgccacggtttcgtcaggtagtactctgttgcgctatacctcgccgtcgccggccggccgtgcttctccctcttctttcggtttgcatcgtcgtcgtcgccgtcgttgcgctcatgcccgtggttctttctttctttcttgcagcgaatctcgattggaatgagggagaggtggcggtggcgactccgctaggacaggtttgcctgccttcccagttcttgaatctttgatcatctatgtgcatcctctcctcctgattacgctactctttaattaatcttgtttttgctgtgacaggaggcggtggcggcggcggaggaggagggtgaccggccgccggagagggtggagatggagtccatcaacgactacggccaagccagcgccaacaaccgccacaacccgcatccgtgacatgacctgccaaccggagctggatcttaattagctactactagttaattatctatgcaatgttctcctcattatctaaaaaaaatgtaatgtgttctcctcagtataatactctctccgtcctacaatataagagattttaattttttatttgtaacgtttgaccactcgtcttattcaattttttttgcaaatataaaaaacgaaaagttgtgcttcaagtacggtagataataaagcaagtcacaaataaaataaataataattttaaaaaattttgaataaaataagtggtcaaacgttacaaacaaaaattcaaaatcccttatattataggacagaggagagagagtacttgttagtgccaagctcacacaccactctccctgctggtcaacctgtacttgtagaggcatgcatgtaccttcacctttgcttcgttttcgtattagaaagagagatcaagagaagcatcgatttctagctttgtactttcgagttcgtattagctgaaagggacaaaatctgaagatgcaggcagtacatttgtcactcgcaggggaaaaaagtgcatcgactaaatttgacccaaaattaattcagcagcttcagtcacaactaaaaagttcagagagcttgggagctgagcagaacaaacaattcttgcaaacgtatgtaagttgagtccgccccaattcatgcaagtttctagcatctatagcttctttcataattaaaatctccccacaaacaacccagcttttcatccgatgatgaataatgctgagatcaaggccaaagcggtgactggtgatgacgccaaccggcggatggagcagccgctatcctgactctgctcggaccaggggctcttatgcaaatactcagacgctaccattggtaggctggtagcgatccaatgttttgcaaagattttgcttctctcatctcttgcttttggttaaatcttatctctcaactctaaaactgggtataacatctcctctaactttaaaaaccgatgtaaattaacacctttagtagttttgaaacggtttctgctcacgtggttggtcaactggtccacgtgtgttgatgtggcatcccgttatcaaagaaattgaaaataaaagtggggcacacaagtaagtgacaagagtaaaattttaaaaattgtgaggcccacttgttagcccactactcccttctcaatcttgacgtgtcaccgctggcggcagtggacagtgacggtgatgacatgcatcacccacaatgacaacgagcactgccgtcgcacacgctgtcccatactcgtgcttgaagagccccccgtggcggcgttgaagttgggtccggagacggcagtgtggttggcgacggcaggggtagcaagggaaagagagtagcgaagaagatttactgcttccccatgccaccggcctgtctcaccttctgagcgtcctgctgatatgagagtatcacctacctctgattggctcgccagggaagagaggaaagagaaagaggaggagaggtgaggaagaagatgaaagaggaggaagtcattggcatgtgggtcccacctgctgactcagtgagtcaaatctgccacatcagtagaaaccactccccaaacacccaaggagttgatttacgccggtattcaaagttgagggaggcgttaaaccggttttgcggttgagggttgtgattcaatcagaaccagagatgagggaggccaaatagacttactcattttgcaaaatgtcgtacactggctttaatgggctaggcccacttgtccattgggcgcccccctataccttgggcttccaaccaatccatgggccgggaaggcatcggacggccgagatcctcccatccatcgcggtgtcccgatcgcggccgtcgcaaagtcgcgcacgggacacaagccgaggagggttttgaaaccatcctgggttttccaccttttccagcggccgcgacaagtccagcgaggcgcttcctcctctcctctcctctcctctcgcgacttcgcggcggctcgctcgcctgatccatccgtgtctcgcgcggcggcgccatggcgggggaggcttcgccgcccgcgccaccggagatccccacgaggtgccaccactgcgccggccccctctccaaggacatggtacgcgtgatcccgctccccccaccccaccacagctcgtcttcacctccccgggatctctccccttggtcgtgcaggctccgctgcaggagtcgtgggtggctggtgcccctgcgtcgcgttcgagtggggtttagttttcgtttggcgtccggaattgggtcgtggttctagttggtaagttatggtgccatggtggtgttggctgttcatgtatataggttgtttctcccccttgttgatttggcctgcaccgtggtttgtttttggatcatgctgtgtggatggctacctaccctaggacaagtagtttcggctcgggagggaagagttttgtttcaggccggggtcaaactaatttgtgcgattgaactgattcgtcgtgtgtggttgcttttgaaggaaacgagcagctggacggtgcctccactggttcgagatagcttctccatggtttgtgttcctttgtcttcaactgtgctgcacacataaattactctctctttttttgtggttgcacaactttatcgaattcggcttttctttatctgtttttcttgtgttaggttgatactattgtacattcttttttctatcttgtaaattctgatcggtatgttgctaaagttgattagatttgtttcatgacatgtatgtgatttgttataattacaaacttttacataatactaaagttgtcctagaagatctttgctaataatatttgtgttatgttctgacagattggttctgctattgggggtacagctggagcattttatggtttcaaccacagtaagttgctaacccatttcattcagttactcatgcacaagttggtattttgcaggaaagtaaatcattaggtttctaacaataccttttagcaccttgtttgcacttaatttactgtggggggttctaatagttagcttactgtggggagttctaatagatagcaatatcccctttgcttgcttggctagtttactgtggggagttctaatagttagcatacttataatagtcatttgccttattggtgaacctcagtcatttcaaagctcagaaacatatgtggacaagataatctgtagttttttattgtctcggaaatgtattgttcatgttgtccactcaatgatgattgttatcttctttgtaaaaacaacaccttgcacactatagaacacctttcttgtacatcctctctgtgtccatgtctatatgcatggtaattcctcctgttttaagttattgattgcaacttttgttggcggatgcatcttgaacaaaattgattgaccatgtttgccctttcataaaagttgatatatcttctgagcagcactgattttgaacttcttttgtagctatgccttttgttcgacggtacataaaagggccaatgtggatgcattttcttgttggtgtaagtgacaattctttttcaaagtttatattatattattatcaatctattgagcatgaattaggctgtgttcgggagtgagggttgggtcctagaacgcaaaacgaagcagtgtttagcgcatgattaattaagtattagctaaaataaatttgaaaaatggattaatataattttttttaagtaactttcatatagaaattttttataaaaaacacaccgtttagcagtttgaaaagcgtgcgcgcggaaatcgagggaggtgagttgggaaagtagagataagaactcagccttagagtgttgcagtttttagatggtgtattattttttcacttcctgattatgtttcacaatctctaggtcatctcaaaactagaaacacaatttgatgccttttcttgacacctccgtttctatgtaaattattttaaaacactacagagaaagcattcaaatttcatgttctatctcttatcgccaaaacatctcttatgttcttttacttggacgggatcgtgagttcaaattcacgcgtatggtcacagactcacagttgcatccaaagggcagtctcagccaaatgctgtgcagttccttctggttcaacaaatgctgtgcagttcctgactttcgattaactaatggtgataattactatattcacaacatttaattgactgtctcatggttattacagataaaagtgttctcgctattactgataaaagtgtataaactgcgcagagatgctaccttttgaagcaaactgtggacattgataactctgatctttttttaaaaaaaaaaatcttgcaggcacctccagttattgtcttctcttctgcatgtgctgggttagcaggtcagttactactattttattttattttggttttttggccatttaactatttttttgctcatagttctgttgtctacaaactcaaattattatttgagttttgtgatatcgtggattcgtggtcattatattaggtttcaagccgatcttatttaagttttctgcagagttaatctatcttcctgtttgttttattcctgatgatgactagttgcgatgtttctatagtgccttgatacctgctcatcatagacagttacttgaaactatgagtcttatgactacacatacatattctgtttttaaggatgttctatgcactctttaaaatatgtatgtgagtacctttcttgttgtttacatgtaaacaatgccaggacgtagtgttatattgtttatgctgatagatcttatgagctcgtgaaacattgactagtcatctgccatctggttactgtgtggtccatgttatttctcattgacgaacctagcgagtcaaggttcatcctggaaatgttttattctcttcctcaaatcttatcttctattcaatggatctccatgaaattgttcgctacagatacattgattggaggccaaaaaaaaaaatcactaaagcgcagcaatgacacatgtggttttaataataatagaaagaactaatagttggaatattcagatgtagttcaaaacctcattaaaattgttgatttttgccatgtcactgtttttattcactatgcgtgatggatgatctgaaggttgatatgtttgtaggtgggacaataccagcgcttgcacagctggtatcatcatcctatcactcagccacagcgtcgtcctttgcccacacaacttctcgtgatgaaatgcataaggccagaagctcctcgacattgtgatctacagtggcagcaaattgttaactggaatcctaactatccaaaacaccatatactattataaatgtgcatgtgttaccacatatcatctgttttatgaggaatgctcttgtaaatggtaaaactttcccctgtggaatagtgcttatatatgttcccaattttgctatttatcaccatgcacaggctgttatttttgttatggtgtcgcaataagcctggagtgttgcgaattgtgatctgctttaaccttcaggatgccattttcgtttgcaatatatatgcacattaccttttgctctctacttgtctaaacatttaccatgtacgatgtctgtcgttttgactgttttacgcgcatgccattgaagtgagtttttacttatgtgatctgtactcctgcctcaatttatttgatggcatgtggcagattaaagtgtgttgtgccaccctaggaatctaatctaggatacccctgccggtgccggatcaccgtttgtgatgaccgtgcatgatagggtgtggcatggtgtccaatgtttttgcatgcattgaatcgtagccatcatacattgaattctcgcgcctcgtttcggatgccatttgatctatctcctctcgctccatccatttcatgtgccaaaaaggccactgatgatgcaaaacagtggcgatctctggctgaatcctcgcggaatggcagtgtgtggacgtgcctctctttgcagccttgtgttgtgatgtgttggagtacatgcttacatgtgtacatacgccgaggcactgtgagatgcatctagccacctgcgtcactgcgtgcgactgccaagatctctcgccgaaagttcgacgagatccagtgctctttcaagcactcactcatttggtgctttggcgatgcttcgagatgtttgggaagcttgttgaactagagtggagatagatcatgtatgcttgtgttaattttggcatgttcctttttagaaccaaagggagtaatacagctactatcttaatataattcacgccctatttgggtataactctaggctgcgttcgttcgttgtgatgagttagttagtttgtgtgttttgttttccgcgcgtacgcttccaaactactaaacggtgtattttttgtaaaaaatttttatagaaaagttgttttaaaaaatcatattaatccatttttaaaatttaaaataattaatactcaattaatcatgcgctaatggctcacctcgttttgcgtatcttcccaatcttctccatctccttcaccccagctgacaggattggaatccttgcgtccacaaatattacacatggatacttatggttggattttagttaagtcagcaaaattgtcactggactttatctcttgtagtactccctccatactcacaaaggaagtcgtttaggacattgacacggtcttcaaaacacaactttgacttcttgtttctataaaaatattcattgaaaagtgatatatgtatacttttataaaagtatttttaagacaaatccattcatataatttttatattttcaaactcaacaacttgagagttattcatgatttatattttcaatgtttgacttaaacattatcctaaacgacttactttacgagtatgaagggaatatgtgttaagcgagtgtactcgtaagcatatgtgctcgtctgaattgaaaaattaaaaatctgtcgtaggatgttttctaaactgaaaaaaaaataatatatattttaattatttgcagcagcacaacgtgataatagcaggttgtatggcgcattagccttggactgatcggtcctggccgaagtgcaacgctgtaaacgcagagcccagtgcaccgcaacggaggaaaaccgattggccgccgccggtgtcgtccgcccgcgcgggggactcacgtacatcgttgtaccgcgcccgccgcactccttcgctcgcgcgacgtcaaccacacacaatttcttttagagaaaatataaaaaagcaatccactgctccctccatcacataatataagggattttaagtttttgtttgcactgttttatccctcgtcttttattcaaaaaattttaaaattattttttttttacttactttattatccaaagtactttaagcataacttatcattttttatatttgcacaaattttttaataagacgagtggtcaaacagtacaagcaaaaactcaaaatcatttatattatgggacggagggagtacaaactagtctaagctaataaaaaaattttgagacacatgacacgtactttaagaaatgaaaaccagcggcacgtccctaatctcactaaagtctggttgaaaatccacctacatgtgcgtaatattcgtggacaccaggatttaaaccatattgggtgaagtcatgcactcacaactccaccaccacaccacgggtgcttccccaaattgaacataaattttaattagcttttaacaattcttagggtgaaatgatcttttatagcggttaacaagtaccgctaacggaaacctaccggcagtgatatgtctagcacaaagacacttgtacaatatcattatcggaaagatgggtttgtcaatgattcttcttcgattgatacgcttgtcgatgatatttttaaaatgttctcttttttaatacttcctctgttccatattatatctaaatttattaatattcatatgaatatgagcaatgtaaaaaaaagtatgataatatgaaacggaaggagtataaggaattagatcgcgcgagcgacgcggacacactcatgccgctcccgcttgcccactgacgcgaagcgtgctcgagtgctcgaccagccttcgtctccgctcgcctcgccgtcgccgtacgtcgccctccgcgacagcctgtgctcccgtggctccacccgctcgcctcctcctacaaatcctccatcccgcctcacctcacctcacctcacctctcactcactcacacgcgataaaagagtttgcaacaagtggtctccttccatggacaggtacagggtcgcgccgcgacctgtctacctctccgccgccgccgccgccggcggtgatcacggcgatgggccccgccgcctgccacgcggtgtcgccggcggcggtggcgccgagctcgacatcttctccgccgagcgctacttcaacgcagacgacgtcgt

SEQ ID NO: 13034 - DNA, 3808 bp, Oryza sativa
  unsure (1)..(3808): unsure at all n locations
gacctgttcgacctcgagagcttcgcggcgtcgtcgtcgttcccgaccacgtgccgcgggcgcagcagccggcgcaactcgcgggaggacgacgacgacgacgaagaccttccgtacggcgccgcggccgcggccgccgccgccgtcgagccggcgctgagcgagtgcatgtacgcgccgagcgaggtgagcgtggtgtggagcgtggccacggcggagggcggcgcgttcgacgcggccagcgtcgccaacttctccagcgcggcgtccgcctgctgcgtcgaggagttcagcttcgtcccgccgcctgactccgccgccaccgctggcggcggcggccacgagggcttcaccgccgccatgtcgcgcagcgccgcccgcaagaaaggcggcgggttcttgagcagctgccggtgcgagaaggctgtgagcgtcgggccaactcccgtccggatggtccggccggaggtgaacgtcaagaccaccggcggcggcgcggcacggtatcaccccggccgcgtccgcatgccggtccggacgtgaactcgccgccggtgagcaccggcgacgtacatacgttcaacgagcgggagaacgcgaaggcgtgcgctatggtttaattagttttgatgtgtaaatttgtgagtgagaaatgtgttggtgtaaggaatgcacatttgtgttgtaataaaccaagacttttaatttctctatacagatttcgtacgtacatatcccttcagacccttcacagagaggggagggggggagggggggttcgctccgcctctccctatacgcttcttcccttcctcctctccttcttctcttcctacaacatattaaaccataaaaaaattttaaaaaacaaatagttagaaaaatttatgtatagaaatactatatataaaaaatttgaattcaaattcaaattcaaattcaaattcaaatttgaattaaaatttaaatttgaattcaatttgaatttgaatcgggtatgtaaacttttgacttataaacattggatctataaactttaggtgtataaactttagatgtatatagaaaatatttgaattcaaatttaaatttgaatcggatataattcaaattcaaatttgaatcgggtatataaactttagttctataaactttaggtctataaacttaactttaggtgtataaactttagatgtatagaaataatatatatgaaaaatatttgaattcaaattcaaatttgaatcggatatttgaattcaaattcaaatttgaatcggatataattcaaattcaaatttgaatcgggtatataaacttttgatttatatactttagttctaaaatctttaggtgtataaactttagatgtatagaaatattatatataaaaaaaatatttgaattcaaatttaaatttgaatcggatatataaacttttagtctctaaactttatatgtgtaaacttgaggtgtataaactttaggtgcataaataaatttactaaaataggaaagtaatgcggtgccaaaaaggaaacaggtggagggagggaggggtgaggtggggagcgaatctgatcgctaccccttccccagggcgagcgatcgccaaacagcatttctgttcacaagttggtttctttgattatagagaagatgtaacaagcacatgcatcatccgtaaatgcattagaacgatcaggaagaaatactctctccatccctaaatatttgacgctattggtttttttaaacatgtttgattgtttatattatttaaaaaatttaagtaattgttaattctttttctaacatttgatttattgttaaatatacttttatgtctacatatagttttacatatttcacaaaagtttttaaataagacgaacggtcaaacatgttaaaaaagttaatggcatcaaatatttagagacagagggagtagcatatagcggttggctgaacaaatccgtaaattgacattgttatggattgaaattttgttgaacagtcataaacttgcaaggatttgaaatgaaaaattgttaatggatggcctttgatgtcatatatctagacaatcagataggccaaccgctagttttcaacagtatagatttctacaattagtgatttggttttatagatagaatatgtactacaatgctatatatgatagtattaggttatttgttggaccgtttattggttaacatttacacaaatgcaagttggacttttaaaagaaaattaatcatattagagatatgtcgctatttttttgtttatttaaacatgtgttaagggtgtatctatgaatgtgtgggtgtggtattgcgtgtaataatggtgtatgtccgtatcggccatatatttttttgaaaaaaaaacattgaagattctcttctctacccctctctcttcagctccataaagaaatatatatgcaatcgagaaaagttttaaaaaaatagtatgtatattcttcctttaggctgacgtcaccctacgtccgtacaattatataaagacaacgaatgtcttaatgagattgctttcctttattgtgtaccttctagataaacttatctcttttatggccttctgatgcacttgatttgtcaattcaacatggagacaattaatccaaaaacgggatcaacacgatgtgatgtgtggcaatgcccatgttgagtgtgggaggcaagtacgttgactgtttagcatctagctagacgtccgtgtgtacttaactcgtgcaaattaagccccactgtatatgagttgttgttgctttgttgggaccacatttcatacacatgactaattagtgctataaatctacatttgcattaacgttattagacggctgttttgtttttaagttgtgcttgctctctaattatctgaaaacaaaaatggaacgctctacattttatttgacaaaaaaaatccctagaactttttaaatgtcaaattgtcgaaatactctaagatccatacagtgctatggtgtttccaccttgccctttacccctgcacgaataactccggcacgacgaataaaatgtagggtttaattaactctgaaatcctaagtaaacactaactcgtcttgctgtcaccgttgctggagccaggggcggatctacagtagtaccaccagtgtcaggtgacaccgacgacttttgataaaagctatgtttaaactgtctatccataattataacactatattctaaatataattagtatgatatgacaccgataaacacgttatgacaccaatgaactaaatttctggatccaccactggctagagctgaaggagaattgagctacagtcattggagcacgaatctcgaattaaatcccaatattagaaatttttaagacttgggtacaaattttctaacgaatgacatttagcaaattttttttaaaaaatcaccaatcgtgagctaattagtcgcgagtagattgcaacatatatatgccatatcatgtccgcgtcatccgtatggggaagatcgagctagcattctggagtttggtttctcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13035 - DNA, 345 bp, Oryza sativa
ccgccgccgccgcaagcgctcaccgcggcaagaagcccggctccggccagcggtgggggctgttctctcgtgactgcccctgcgccggcaggaaggcggtcaccgtcgacgtcgcctccgagccgaggagcccggcgacgccgagaacccacgcgaggtttgaaaacagccatgtcgtcgccgacagcacgatctttaaagcgaatgcgccgccgccgccaccgccatgcgaggaggagcccgtcaagatgaagatatctccggggagcagcacgtttcctcctcccctcgcgaacagtatcttcgcggcggcgccgaacaggggcggcggcggcggtggcgcgg

SEQ ID NO: 13036 - DNA, 7321 bp, Oryza sativa
  unsure (1)..(7321): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccatccttccacgaactctgcttcttgaagcacacttgtgatcatatttgtttatttggacctgcaaaagcaaacaatattagcaactatgcaaaagttactccaatctgaattcagcaagcaaggtgtcaaattgcaaaggtaatttaaatggttagtataataccctgacactcttattaggttgggtctttgctctaattatccatgggcaaccaattgcatggcatttccctctaaacctttctttgtcagacttttcagtctctagttcaaactcatgaacaatggcatattgcttcactgccattctgaactcatccatagaagggtaaaatgtccccactgacatatctgggtcatccctgtcccaatccaacacatcaatgggtacttcatcgtccactacaatggctgcatctaacatgtcttgctgaatctcggttggaataataggaattgcagtttcttccatagctgctgcagcagctgctgctctctgatctgctgctttgaagcccatggcctcaaaaacttgatcctcatccaacaataaattaacatcacaatcttgctcaggttcaacaagtatagccaacttactccaatctacaacagcattagcctcttctgcattttgtggatggctagaggtatcacccgtcccttcttcatgaccaggagaagaaacttcagcactaatcatagcagagagaacttgagcacttgactgatcaattggatctgcagttaccacaccagagacaccttgaatagctgaatcaactggatttgcaatgccttcaataggttcatatccctttttataaataacttcaacaccaaactctaccagcttatcatccaacatagaattcatccactggccaaattcttcattggttgtcaacttacattcagtgccaatttcagtgtccaaaccccaaactctaatttcttggcttggcccccagattatcttgctagccatttcatcatgaaatttatccaaattatacccactgctaatatcaacccaccaatcatagtcttgctctgacattggtagcattccatactctagattcgcaacatacttagcaaccctaacaagaaatctaagcgcattgccaggatcaatcctgacataaacagattcataaaaaaaatggagttagaacacatctaactccatgcatgcaacacaatacaagcagggagggcaagagagaaaatgaacttaccaagaaggacaaactgagggcttcatcgccgccggaggacgatggcgacgatgccctaccaggtcacgatgtgctgttggggaagaacaaatgccgggatgatgccggagctgcggatctgacaaatgcgtcgacggcggactgcgggtggagaacgtcaggaccggcgtggggcggtgagccggcgggccgggcggcgcgtcgacggcccggggccgacgctgggcgagcaggggccgatggcgcgggacgggcgtcgatgtcgcgcgccgggccggcgtcgacggcgcggggccgacgcggggcgggcaggggtcaacggcgcgtcgcccgtcgatggtggctggcggtcgaacggaatcgggagagagaggatcccctgatttagggtttcagatgcaggggtatactagtcatttcatgtgcccattccacgctagcaagcccatgtggcggtgtacaatgcgaaaagtggcaaaaaattagaaaagcttctctctccaatggcatatagttaactgcaaacctaaaaggggtatttgaacaattggcaaacgtaaaagtggcaaatagttaaattccccatttgattctggaattgaagtttcttctttgccgggatcacatacagactgtttttgtccttagaggcagatgcagcagttattggttggcccagatttggggagtgaacccttgccagttgagccagctgaaccctggaaggctgaatattggcattttctgctaaaggcaatccatccaggtgctgaggtatattttgctgctgtactactgcactcttgcccttggcttgttctacatccttctgcatagtattgggttggatgcttttttgactaaaaaggctcgggcccacaagagcaaatctgccatcttgcaaagcactattcacctgtcctatcatattgactttggagcctccttcttgtgaagaacaagttctagcaccaggacttgcaaaatgctgccgaaatttagcaaccagagaatttttgttttccttctctatatccaccattgctgctggaggcaaataggaaagctgtgtaatccattttccatatctatcatctaactgcacttggtcatcagctttctattgtattataattctttgcttaatgggacaagtctgagaattgtgaaacatgagaccacagaaggtgcaaatgcgatgaattctctcataatgaacaaaaaccttgagaggttctctgatgtcaatatcaagattcactatagcttgaactggcttagagacatccatcttaactctaacactcatgaacctaggatctttcttgagattctcttccacaatggggttagcagcagagggttcaccaatttccttaaccactttcctagcagtatcttctgtcctaagagccattgggattccataaaatctaactgtgaccatgatggatttaaaggtgtaagcagaaagaggtttgagtttttcattagctgtagcccattccatcaagaaagtgtcactcccaaaagaccaaggttgtttattccaaacccaagaaagatcttcccaagtacgaaaatgagccataaacaaattggaatccacttgagagatgtccaaaaaacaacttccccataccttttgcagtgcttttttgagaggctgcagaggtatatccctgatctgtccaccagagtatccaaccttcagcagcatgttgtgatttgcctccatttgagcaacttcaggagaatacttgagccgaacagtggcttccttcggcggagtgagacacaattcttgtaaggacgcagcaatatggggaaggggatgatgaggacataactagctcggatataaccatgactaccttatgtattaatcaaataaaggtgcatatattctacattagatttacttgttatatatttgaacaaacgttgctacacaatgagtttcgtgtgtttttgttcgcagaggtacttgcttgggcgaaagaaaagagtccgagcgtaaggaaagcatagatgattgaagaagttgattgaggaccaaaccaagaccttctccaagttttctttcatctcaccacgtcacttttggtccatagaagacaagagataaagatctacacatttggattcggattcgggcctcctgacagcatcatcttcaaacggacctagccggtgatctagaaggaactttggggcccataagttcttgttggaaagcttatggagtctactttcagatggttttggtcccatattaaaattcctaccgatctgccgggaatctgcaaaacaagccaagtttctcaaccagtccaaatctgatttgggttttgggccttgtaattgtgtcgtgggcttagcccaagggggtgtgcgccctagggcaaccctaggatgtccctaatcacatttattcagtagccgtcatcgtttagagttgggttttgcttagattattctgtcaagaacaatttcgccactagatcggtttgtggaaccccaaattcgagtgattaatcattcatatgcaatttggttgcaatctatcttgttcttgcttgtgttctttgattcgcatgcagggattagccttctcggcgaggtcaaccgggttttggcacggttgataaccagaggagatgtggtgctgcgattgcggggctcagtagcgtgttcgttcagaagccggatcgagttgtgtcgcgactccgcccaaatcgattgtttatcaatacctatcggaagatcgagacctacatccctcatcagttggtatcagagcgccgttgcccattaggtaatttatcttcctataaccagaaaattgccacacaaaaatatttattctttacctagacaatttgagccgtttcattgttctattagattttgctttgttgaattcgagtgctggtttagttttaaatttaatttttagttttgagtattgcatctgttcatcacttaggtctagggttcatcactcaagagtgtgagttgtacgtcagttttaggtccagtttttcatctcgtcggttgttgccgggaccttgaaaaattgaattgtctcgtcgtcgggtttccctttttgtgatttggtgaaatttttatcaaacggttttggagtggttatactgagcgcgcgttactgtgtgcatgaggggagtactgtgcgcgtgaggagagactccgggtcagatcagatctatccatgactgtccgtattttcctctttatagaattgttaagtagtggatttgagatatttttataaaaatggaaccaacatgatatgagcaatccatttttgagatgatccaattttagttttgcactttgcgtttgagtccctgtaatattcatatttacatttgagtccctattcgaggtcagtggtcagtttctgttgaaaaaaaaacataagaaaaaaaagaaaagggcagaaagctgcaaagaaaaagaaagaaaaaaggcgcaccaaaaaaaagaaaaaaaaggtagaaaggtgcttagaaaaaagccgcaccaagaaaaaagaaagagaaaaaaagaaaaatcattcatcctttgagtatgttttgagagtgcagagttgtgcattgattcgtatcaagtccttagtgtggtcgggtgcttgcttgagctagagttgagtctaggctaggccagcacattgactagtactttgaactattattcaactttgcattttctgattagcacaattgcattcctttgctactatatattgtgcctcccaagttccacatatatacttctggtcagcaccgctttgatccttgtaatcgccacatcacgtctttcaaggtgtcacgaaccagccaccggttgtaccgtccttagcattgctggtaagacacttgtaagagcttggtaaggtgctccatttggccgagttgttgaggggcaccactacaccgcgtagcagattattagggataaccttcattgtttgctgttgtctttgtgtttgcaatgacaggtatgagtggcgctcaaaatcagcgataccaacaaggtgcacgtgctaacagtacttgggtgcaacaagtgctaagttctcaaatggagaaagcagagcaatggcagtatcacgaattatttgaaacaaagtttgtggttaaggatagagcatgtcgtactataatcgatagtgagagttgtaataacttggtgagttcatatttagttgagaaacttgagttgcttacacaaccgcatcctcatccatattacatcaaatggttcaactcttgtggtaagttcaagataaatagaattgtgagaataaacttttcgattggaaattaccatgatactaccaattttgatcttgtccctatgcaagcatgttctttgttgttaggtcaaccatgggtatatgataataatggatcgcataattttgttgctaatacatacacatttagacataatggtcggaaaatgaaattggtacccatgagttttactaaaattttagaagataatcttgaaaggatgaagaatggaatcgaggaaattttcaaagatagtattgaaaggacgaaaaatagaatcgatgatattttcagagataccaggaaagatactaatattgcgatgccttcaactaagtctgagttattacaaaatgaacgtattgttgtgcctattgctttggatactaatattttgcaggcatctgagaacaaccaaggtaatgaggaagagaaaaaagacgaagaggaagatgagaaacaaggtaatgataatagtgctacagctattcaaggtatgcatagttatgatgtgccaactatgtccactacttatgctacgttagagcaacccatagtggaaacaattgctgaaatacctttgtcacaaaacaatttgtttgatgtttcttgtgataaagaagagttgtgcgatgcttcacttatatccatgccacaactagtgaatgaacatgttagttctatagtagagccactatgtgttgaatttaaacatgttattcacattgctagcgagaatgaagagcttaaattgctatcttctttaaatacttggagatatattcaatttgatgatctttgtccactcaactgtttagagaagaaattatttgctagatttgaattgccatgcccttctgatgtgatttttcatattattggcaattatgatagtaaaggagaatataatgtgcatcgagtatatatttgttcgaatttgactatacctccttttcatgatgaaatgtgttgtctagaggaccgcatgcatataagttattttctatctagttcctctagttgtataaatgagttacaggttggtttgcaagaaggggagtgttgtggttttttgactacaaagattttaggatccaatcatatggccatcaagaaatgttccgcacaggatgctgtgatagacaaagataagtgcaatacgctccatgacaaggtgaaactgaggacggattccaatcaagaaggggaggatgatgaggacataactagctcggatataaccatgactaccttatgtattaatcaaataaaggtacatatattctatattagatttacttgttatatatttgaataaacgttgctacacaatgagtttcatgtgtttttgttcgcagaggtgcttgcttgggcgaaagaaaagagaccgagcgtaaggaaagcatagatgattgaagaagttgattggggaccaaaccaagaccttctccaagttttctttcatctcaccacgtcacttttggtccatagaagacaagagataaaggatctacacatttggattcggaattcagcctcctgacagcatcatctttaaacggacctagccgctgatctaaaaggaactttggggcccataagttctt

SEQ ID NO: 13037 - DNA, 3642 bp, Oryza sativa
aatctatcttgttcttgcttgtgttctttgattcgcatgcagggattagccttctcggcgaggtcaaccgggtttcggcacggttgataaccagaggagacatggtgctgcaattgcggggctcagtagcgtgttcgttcagaagccggatcgagttgtgtcgcgactccgcccaaatcgactgtttatcaatacctatcggaagatcgggacctacatccctcaccaggggatcaggtgtattactatcggaggaaggaggaacacttgagttaggggggttgctttggtcagccatggaacccaacaagaaaaggaagactgcgaagagattatttggacatagaaaatggacagggaacgagtgggagaggaacacaaggcagaaaggggtcacggatctggaaaaaggagattacatggaagagaagagtgaaaaacgaaggtggaagaagcgtgctgtggaagattgagagcttgctacagtagaacactgactagaggcatcaagccgaccgcctcgtgtccgaaatccgatcctgatcgggaaataattacttacttccttcgtttcatattataagactttctagtattgcccacattcatatatttgttaatgaatttagatatatatgtgtatttagattcattagcatctatatgaatatgggcaatgctagaaagtcttataacctgaaacggaggtagtaggtaaataagatcagtagcatgaataggatatccttgccaataatccgttgtacaccgtaagtatctaatgctttgtttatagggttttagtattactattgataatatgattattaaaaactaacttacatattgttcttaattaagtgtgaaattaaggtaagttaggttcggtgttgtgtatgctagaaatgattcatcaaaaaatgaaattagtgtggttctcgatgaaagtcgtgaatattgatgacttttggttgcgtgtttgctactcctttcatttcaaattacttacaataaatgccacagcactataatattttaaaactatcacaaaactatatatttaaattggtagtatatcacaaaactaaaaatttaacatcaaatttagcatagaactatgtatttaaggtgaagtatcataaaactaatctgcaacaaagttgttacaaacttcaggtttagtgtaaatttaatcacaaaccttggatgtttataactcaaacataacattatcattagtactagggatttaaaccgtaatttgcagtagcttcattattaaatgtttagttctgctatactacacctaaaatctattttataaatttgatattaaatcagtagtcttataatacaccatcttaaatctatagtcttgtgatagtttgattaaatatctatagttttgtgtaatttactcagaagagaaaattaatgcataaccattatacagaataaggaaaaaaaaattaatgcatgacccttataaacaccgttggacattaaacaatgtgacacgtctccagaaaaaaaaatagaaatttgctgaagacaccataaccattattttattattttcagatcaaatggagagagaaaaatgccaaaaggacgcaaatgcctcttgggccaaaggcacatacttcctccgtctaaaaattcgttgttataggatgagtcacattatatcctagattgatcctttttgggatggagggactatatatatctgggtctagtacattagacctgaaccacactctatcccgacataggcgtgtggcgtcgatgcagcctttgaagtccggtagcatcgatggcggcagggatgaattcattggagaagaagaaccggcatacaaagaaccatccatcttcactaaacctccctccattgtcgctcgtcaccgcttcatcctgagttagctacttgctagtaggatttttgagagagagggtgagtgagttgggagagtgcagatcgatggccacagggtgctacttgaatccatcgtcttccatcgccactctcgctactagtcgtggccactgttgtggacgtcatctacctccaatttgtagggttctggagggggtcccgatggaggaaatgtagcttgggtctagttcaaacaagacctagctgtgttacaagaagctcgcccgagagacaacttgtattttctaattgatgttagtgtattcaatagtttgttaagtgtcttataagcaccccacaagtaatatcttgttttgggactgttaaatgggggaaattatgcacctgattgccttttggtatttctatttgaggttgaagaggacagacatgagtaaagaaggataagaataaatatggtgagaagtggtgtggtgtggagtcatgggtgcatgacactccagggtttaaatattgaccctatgaatattacacatatatatgtgttgacggtccttatagaccaatttctgcagtcaatatatctaaaataaataaaagagaactagctatgcttgcatgcatgcatattttgtttaagaataatctatttctacttgtacttggaatattatttgatttcagagattgctgcataaatgaaagagaatcgacggaaattaactgaacaatcaatcgtcatccgtcgagtggcagacttttagaatgattggcttacaaaaccattttaacacctacgaataagcccaactacccttcttttgtaatactttagcattaataaaatattcttctttatatagcttcgttcttttacataattcatattatttgagtaccgactttagttcgtacttgtctcaatataattgtgtagctagcttaccagagatatgcaaatgattgctctatatcgatcgcgagggtgtagagtagtatttaataatgtaagtgtggtgcttaaattattagatattattctttggggttatatgccatgggtcaatagaggtgggccgctgatgatgacaactcagtacgggtatttcttcacgttcgtatataattctaagacattttcctgatatgggtactcctctgtattcatttctggtcagatggccatgacggattgtcgtaaggaactcggcaatcaggtgtggtctctcgaaacatcaggagggcatagttagagggtattggctatatgattgtatactagcaagtgtaaactatagatatttatatactagaagtataggaatgattattttcatattcattctccacttagcctagattttattttagcggagtagtccttaaatctttcttctatgtgtcaaccttatcctacctaaaaattaattaacccatgcatagactttgatgaatacaagtaatatatgaattgttagcatagtattattttattatattttccattaggatttaattaaaaccataccttagattactaccatgggataattggacggttaccagattaaatttgtggcccataaatataccaagaatatttcagtgccattgctggaaattatatttctagtaataccgttaagaaatatctacaatatgtaagctttaaataggattatagtgagatcaggaatatgtcgctagtgtcttgtctctttgaacgtgtgttagtggatgca

SEQ ID NO: 13038 - DNA, 24685 bp, Oryza sativa
  unsure (1)..(24685): unsure at all n locations
atatatatatatatatatatatatatatatatatatatatatatatatatatatatatatatatatatatatatatatatatatatgaacgtgggaaatgntagaatgacttacattgtgaaacggagggagtaccaatttaaccctactttttggagtttgcttatttgaccctccttttaaaaaacgaagctcctctctgaccctattccttttaggtgagttcatggtgttaagttagaggtaaatagtccattttgcccttgcttatttgaccctattatatcttgcttgtttgaccctactatgtcataccgtgtatatatttgaatactttgacatatttgtaataattttttcataagtttcacattgaagacaagtttgacagatttgtcataaatttggcaaatttgaatcattttgtcaaatttgatagaattttgacaaaataaattaaacaaaatttgacacagttatgacagatttggtgcgcgccttctcgggccccatcgtctccattgtcccgccgaaggcgcgtggtgggagccacctgacgcccgagccgccgtcgcccaaggtctcctgcatcggccaaatcaagaaggccaacgccaagaaggtcaaggcgtgctgcaagaacggtgcatgccgctgccgccccggccgccggccgactccaccgctgccacagcgcgcagctggcagaagagctcgctcgtcaggcggatgctcttccgccgcagcaggtcgaggaaggcgtcgtcgtcgcccccttcctgcgcttcccgccgccgccgctcccttcctccatgagccgccgccgcccctttcctccgcttcccgccgccgccgctccttcccttcatggccgggcgccggcgtggatcccgccgccaccactcccttcctctgcgagccgccgccgccgccccctttctccgcttcccaccgccaccgctccttctcttcaaggctgggtgccggcgcgggtttgccgagcgggggtcggctttacgccgccgtcgcacccgcagacgcctcgccgcttcctcagagcgccgccatcgccgctgcaccacctgccgccgccgccgcaagcccacaagcacgagagatacaaagagctgtggatagggtttggatggatagggtatacgagggtactttaggcattacgaataataatcacatttttttttaaaaaaaatcaaaccttaacggaggagtggagacagggtcagacgtgagctttattttttaggggggggcggggggtcaaataagcaaactccaaaaagtagggttaaattggtagttagagtctaaaacggggtcaaataaggaattgtccctaaatcttttggtcgtgtatattcaaaggggctattttgaaggctaactatcaatttgaccctacttttttagtttgcttatttgaccatgcttttcaaaatcgaagatgaaagtagaccatattccattaagacaagttaacattgttaactaaggggcaaataagtcccttatgcccttccttattcgactctattatgtcaaaacgtgcatatattcagacctttagacgtagttgtaacgaatttgacatatctttcacatttgacacaagtttgatagatttggcttcaatttgataaagttgaatcagtttgacatatttttgacaaaacaaaataaacaaaatttgacacaaagtagcccctcctcgctccgtgctgccaccttgccgcccccctcctctctctgcaccgacacccgcgccgctatctcctccctctaggcgccagtgctgccaccgctgccgccacctccgacctaatgtgaccatggatactatggatacaaccgttgcttatatcatggatcaacaagaagacaacaagatcaagtcctccaagtgctggaattcgattcggccacctactacattgttgacttcaaacggccgccaaatatgcatacgagctccgttttgggtccacgagtacttgatggaaagctctcggagttctctttccaaggatccaacctcattgtgaaattccatttcatttagccgcaattgaaaaaacaatgtgatgtgtcacctgtaatgggtctatgggcttgtaactttgtctgggatcccggcccaagtggggcccacgtagggtgtgccccaactttcacgcgcctacactggtgccacctcccttcattcgaggcataacgttaggcggaggctacgcccctcctccctccgtgccgccacctgcgctggcaccaccgccctcctctcttcgtgccaccaccaccccctcctccctccgcgttcggcgccgccgtcccctctctacacgtgttggtgctgctgttgccaccgcctcaccctccgtgcacctacgctgccaccccgcgagtcggcgccaccgcagctgccgcttgcaccgagagaaacaagagagagagagataagggtcatgtattgaggtcgggaaatgtataagattaaagggaggtaattttggtttgttagagaataaataatttttttcttttgcgaaaatgaaaccctaaatggtttagtgcaaatagggttcgattttgagatgtaggagttcaaattgatagctagcatttgaaacagggtcagataagcaattgttccatatttaaaaaaatacatacagatagatgaaacgaaacacaacttccatgactgcattaagatatcgataggaacaattttttttgaaaggaatatattgataaaaacatatccagtttctttttcccaaatcttaagtcatagacttcctaatcctggatagtttcaaactctaggaagcaggatcaggatacttgttctacaatgcatccgtttagtgcaacaaacagctctacgggtggcaaatcaaatgcaagtgacaagaataggattttaaaagaagaatagaaaacacgtagaatattcataggcatgcgaatgcaaaacaaataaaaaacacaggaatagtcattcaaatataccgtaggaaaaccagaaaaccataggaatcaaatgaaagatagaattgaagaaaatttttcctaagatattaataattgctaactttcctctaaaatctctacatgattatccattctaatagaattttaaaagggaaataacagaattcaatcaaattcctatagaattaaaatcctttaaatttactatattttttctacaaatcaaatgcgcccttaaattggtattcttgatgcataaaatttcagaatctccattacccaacaagattttaaacttatttgctggtcttccaccagaagactctaacgaaagatctgctggtctcatcacccaccggctcagaagaatgcacaagatcggtaaagtcggatgacctgtgcggatcatgcccccatcaacggacatcaatcttagattgtgtttagatttaggggtgtaaaagttttcatgtgtcacatggaatatatacgaacacccatttgaagtattaaataatccgtcagtaaaccacgagataaatttattaaacataattaatccgtcattaacaaatatttattgtagcaccacattgtcaaattatagaacaattaggcttaaaagattcgtctcgcaaattagtcgcaatctgtgcaataagttattttgttagcctatatttatataggtgttcaaacgttcgatgtgacatgattaaaattttggggtgggatcttaacacccccttagtggacaaacagaatatatctattctaaatgcagttccgcaaacccgaccaaaattcacaagaatgtatattagactttctcctgagaaattttaccttcagaacaattgatgataaccttcaaaggcaccgattcacacctatttggcacgctatattaaacacagatcctagttgtggcatggcaggccagtcctatttgtggtcaacacggatcctcggccgaatttgtgtgacagcaatcaagtcaatcccaccgcaaccacattacattttcttcggagctaaagttcctatgcaatcaatttatgtttggagctaaagttcctaacaatcatatttacccttttgagagggttcctaagcaattactaaatcttcacaagtcacaacatgtgttgtgaagactgaagacatacattcctgcgttggaagtcacaacatgtgtgtagcagcctagcaggagaacaggtgatcagatgccaatgcatttaaccagatgctgtttactgcagccgccagccaaacataatgctcagcaaaggcaaccaactatccctctttcatcttgtcttctacttcatcagaagattcaacttttggagcagcctgtgcctcgcccatttggacatctgaagctgaagctgaagctgaatcattcagggttttgaccggtgctgctggcaaggtagcagcaggcttgcctgttggctcttcttggtcttggttagaaaccatggttacctcatcagtgttcacatccatcattttgtgctgctttgggggtttctgctccgctgagctcttatcattgtgcgacaccaaatcaaccacagcctctttagccatacctgctgctctagcagcatgcagaatctgaagcctgtagtcagtttctggtcggcgacataccttcctcagtggaacaatttcctgtcattttaaatggaattttaatgattgtaaacgaatcagagtaaaacacaataaggttttagttttattcaacaaagtgaaataactagcaaaagcccggtaaaatacattattttaggtagttcggcaataaaaaataagaaaggcgcaagacagcaggatgcatgggctaatatcatatgaacttggaaaatctatgcatgcatacttaaattttcagagatgatgaatataaatttgcatggtgtccttaaaattccacatctagagcataaataaaaattgcttaaacttctacaggaacctataggatgatgctacaacatatggtactcacgggtataacgtgcacaagctaatatcatatgcataaggtcgttaaacttgcacagtaaagcgttgatggaattgcgtatgcaagttcaggaacttaaacaacgacgctttacttatgaagtatatcattaaagccataatgtaagagaataaattagattcttagagcatgcattactacaatagtcacacaacattcaacgggtgaatgcagtgagtaaaatacctcagagtgatcatgatcgtagcgaacaagaaatctacagcgacaccctcgtacatcatgtctacgcctttgagcatcaaggacacaagcatcgaaatacagagcctgctctttgccttcctggtcaatttaggacagatgtatttgttcatgttagacaacaatttgagtaaatgtgatacctaatcataattataaatagcatttcatcaagataatcatcgaagaacatatatttatgtttagatttctttatttaaaaagcaggaacctaaatgtgtgttcaattactggtttacagttttacaccccttggtgttttgtgcatcaagtatcaaatatgcatgactttttttggccatgttttaaggaaaatctgtgatacatttttttagaacagaacaaacagaaatcaatcttctaacttaaaattaaaattttgaattcaactacacatcaattctgaatctgtgacatgtagatacagtacataggtcaagaaaagatgtctaagatggcaagacctgaaagcaaagtatgaggtctccaggaagaacagcaacacattcagttgattcacacggaagagaacgttgccgcacacatttacggacatttatccattcatcttcctcggctccaaatccagaaaagcgaactcgtacttcctaaaatattaagaattgctcatgtgagacaaattatttataccacatgttgtaactaggaataaatgtcattgtgtatacacagttttataaaaataccggcacaacaacgcaggcatgtcatattggcatatgttggaaaaaaattattcaactgtagtgccaattttagatataagccagatttttttaaaaaatacagaatgttctgaaagtcatactagaacaccaataatgcagtagaaacttgtttttaaaaaataattaaagaaaaaggattgagtatgcaaccgcattaagataaatgatataaatcgaatcagctacaggttcaaagctagcaaagtgctttcaataaagaaagccagacatgcatttagcaacataaattatatctaataaaaaaactatgatccttactggatcaccagattcgaacaaccgatgagacaggaaggcagcaacatcatacctgcacataaaagcttagttatacacaaaaaaaaatgtaaaaacacagagattacaatttttcaagaacatagtgtagaaagtatctgaactcgttgattcatttgcatttgtagttaatgatcaggcacaatattcgttgagcacaaatatacatttgtttaggatggctaccactaccatagaagtgaacttatatgaatgacagaccataagaatgctgatatacttaatcagatgttaaaagagatcttgcgtaaccagttcccctctacattgggttgaatgaatttagttggatcttcaattcaaatccaaattgaattcgaattgtcatctcaattattttcattgtgattggttgccaaaggcatctcaaatagaaatgacctctcaataaatatccagtttaaggttggatgcaatacgcaaatgaattggcacattggaagcaaacaaacaaaccaggaggcctgatgttccttcttgggtagttgccgaagtggtggctggagcatcactggtgtgctgaccagagcaatcaatggccacagcggctactagggaagtagacagcttaacagcagattttgtcagggacgctgacaaccagagttgagaaagatgaaggatgactgctagagttaaggaagaaggaaatggccactggagtggtgaaagaagggatggcagctgtaggtctagaaaatagaccgtgaaacagtgatagtggcacaagaaattggtgaatggtcaccagtgaaagatccagtgaaagctccaatcatagtgctctgaattggtggaggaccaatttagttgtccaccgattcagtcggaaatggcctacaactccaaatcagaagagcaaccaacgacggaattgagagatccaattctaattccccttttctagcctcagttctggcatccaaatggggtcttgtattcaactttgtagatatgaacacaaacataaaaaaaaaacacagatcaataaagaaaactgaaacctaatttaacagtatctgacaattctatagcaagcaattctcttcataataaagtcagcaaaactgagatacaaacctatataacaaacaagtatgctgcttagaagttagaatggtgattaagaagcaatcgttaaacttaaactcagtatagagcatattataaagaatacagaacaaagaaaaccatccaaaacagtgaaatactaaattgcaagatatgacctgtgaatcactcagtcacagatggatcattcggccatcagtcaaaccacatgctctattttataataagaaagctatcaatttgtgatctgtgcaggcaaggttaatagaacttatatttctcacttacaatgttaaccaataacacaggtgcatctggaggtttactgttgtccatgctatttttgaattttactgaannnnnnnnnnnnnnnnnnnnnaaccccaccaggctgtaggaaaactggtcagttcagctatgatttgcaggccaatatgggaaacaatccaattagacgggctgatcaagccagaactttaggttcagtttattccagtcagaccactagtttggtccaagtctgataactatgtgtcaaacagcaagcaaaacgccatgaacctactcgtacatggaaatcaaaagacaaaagacatagaagtaacatggataccatgcgccatctctagccgactttgcttcaaattcaacctggccgctctccaaagaacccttccctgattttgaacaccaaagatcaacaatcagaggataaaaaggaatgataaacaatgatcatgatgcatagatggaaggttactaacatagaaccaatacacggatctgacatatggccgaagtatctcattacttatagggttaattggatccatgacattataaatttgcctgttttgaaaaataccattactattcgtctagtcggaacggtgccattataaaattgttgaaaccggagatataccactacctactcctaatagcaagagtaacatgagcaaatgacctgagggcgagccggagtgcgcagaggcagagggcatagccctgaagggaggcgacttgtgctcgtcggaccccgtgggcagcatcttggtctgcatcagcgtcggggggcccctggagctcctggagcggtgcgagtacctccggttctggaaccagttccacacctgcgagtgcggccggatcgagatgaggcggcgaattccccgccagggagggggaagaggaaggaggaggggggaggaaaaccctaatggtaacctgcttgggctggacggcgaccttgccggagcgggcgggggaggaggtgaacttgtcggcgagggcctggatgacggagcggtgcgggatggcgttgttgagctgctgcaggcgggcctccatctcggccacctccgcctgggtgaaccggaacgccgggccccccgtgctcggcggccgccccatcccgaccacgccggcgtctgcggctgcgaggggaggggattagttggatggatccatgattccatgggggaatcggagaggaagcgagcgagcgagaggagagatagacgttaccagtgatgcagcgatgagcgattcctcgttcaggcaggcaggcaggcaggcagccgctgagagaggggatcggtggtggtgtggtgtggtgtggtgtggtggctgcccccctattactcgtgccgaattcggctcttttttcttttttcttttcttttttaatcgttggatgtgtcacgtgggtggcctatacattggcttcaggtccatcaattgttgtaacgcgtatctatgcatctgttcttaaaaaggttaatttgattcataccattataaatgtgtctattcatataaatatcgttataattcgtttattcataaccatgtctctcgaattttataaaattagaatcataacagcactgtcactttttccatcttcttcctcatctacacgtgggaagcacctgtcagattcatcttcttcctccatcttcccctcttctcttttcttccctattctccaccacttgttagcatcctccccaccaatccatcccgaccccctcctcgctgcagagtatgcctctaccctcgccaacgcgggagtccacgtccctgacctccgttgcctactcaatcaatgcaagaactactcgatgtttggtgcacgactgtggcaacgagttcgacctacggccgggagaagcaccaatggatgcacgatgacggcacgctcgcctactcaatcgacggcgtctagtagcgaggtactcccacttgctctggcggcctgttgctgtgtgcggcaaggaaggatcaggatggatgtatgtggaagaggctgagaagcggtggataaagatgggaaaaaaaggaatatgggaggatgaaggaagaagatgaatctccaggtgggtcccacgtcaagatggaggaagatggaaaacatgaccgtgatgataatgttctaattttataaaatttgagtagcatagctacgaatagataaattgtattgatatttatctaaattgtggagattatggataccccatacccacatggcatgtatatccgactgggtatgggggtaccatgtatagatagatagaatatctttaaagggtttcgggttaaattcctaaacttgtatatcaaggaagcacccgggatttcagtcggttacaattgtattttatctataactgcctattccgttaggaatatgggctgtactttgtaatacggactccttcccctatataaggaggggtccgggtgcctcttggggcacgatttttctctcagatcatacgatcaataatatactcggcggatcaatcctcggacaggagtagggtattacttcttattaagaaggcctgaacctgtataaaattccttgtctctaaacccatccacttttctagcttgatagccacccccttttagtattgccgaaatcttgtttcgacagttggcgcgccagataggggtagcgtcaagttcttcgccgactagtgcgatgggtttcgtctccggcatcgacgacttcgtcttccctcccgagcaggtgttcctgttcggcagcctcgacttcatcaccaacgactttggcaagatttctctccttgactcggatccgaaccagtcagggagaggccaggtctccgtcccgttcggtatcccaaactcggccgagatctactccaaaatcatctcaaccgagttggcttcaaaccactcgaacgagatccaatctactccgacacgacctgatcaagatgatggggcctatccctcaatcctgatgaaactccccgacgatttggccgctgttttcaccacaaggacatcttcttcccgtaggcctagacgggatccggccttggccccgatccaatctagctccagggaagtcggcgttatactccaacctctcgggacggttttgacggaagaattagatggctaccttagcaaccccggtgtcgattctcgaccgacggagatcctcgagtacgacgacttcggctaccactacgactacagcaacctcgacgacttcgacgaaagctacgaagacaactacacgcctctcttcttcggcattttcatggctgacaacgagacggcagaacagcgtcaagcccgagaagcagaagaacagcgcgcacgacaagaagccgagcgttgccgactggaggaggagcgactagcataggagcgagaccggctgcagcgtgagcaacaggagcgtgaacgggccgcaaaggaggctgaggaccggcgacagcgcgccttggaggctgggcgacgagcacgagatcttatcggacaacaagacattgaaaggacggcggtttttcgcaccctgcagcagaacgcggtagccgcgattacccttctggacactctacttcagcaagatgcacctgaccacgtcgtcaacatcttaaaccagaccaagaccatgatcgtcgcctcggtcccagtgattttctcaagcgtccgtatgccgactgacagccgagttccacctcttcgatctaaagactatcaccaaccaagccttagcgttgccggcgcgggatctagtcgcaggagcagggatcatggtgaacgatctgttcactcacctgccgaccgacacagggagcgtccggctgaacagcctcgctctccacgttgcaggcgtcccatcgatcttcgcgatactatcaaccagcgtcgtgcggcgagaggccacattccctaccaatcactagatcgttacgacgacgatgtggatggagttgccgccttcacaagtgacttgcgtcgagtggattggccagccggcttcaagccgactggaatcgagaagtatgacggcacgacaaatcctgagtcttggctcaccgtctacggtctcgcaattcgcgcagcaggaggagatagcaaagccatggctaattatctgccagtgaccttagcggactctgcccagtcctggcttcacgggttaccccgtggcacgattggatcttgggcgaagcttcacgagcacttcatcgccaacttccagtgcacctttgaatgccctggtacctagtttgatctttacaatgtcatccagaagtccggagaatcccttcgagattacatccgacgtttttctgaacaacgtaacaagatttctgacatcaccgatgacgttatcatcgccgccttcactaagggtattcgccatgaactcttagtcggcaagtttggacgcaagcctcccaagacagtcaagcaaatgtttgaaaaggccaatgagtacgccaaagtagaagacgctgtcactacatccaagcagtcgggcagcacctggaagccaaagaaagatgcgccgactacggggggagtggaagtgccaatcacaaagatcgcaagcgtaagcccgaggaacttgtggcaactactacaccatcctcccgacagcggtcacacatcaacaccttcgacaagatcatgaatgcccaatgcccgcatcatctgaattcaaaccacgcagccaaagattgcttcgtctacaaacagttcacagagcaatatgccaagaacgcacggaagtcgattgacagagatcaaagcacgtcgaagaagaaggatgatgaagacgatgccccgactggttttcaagactctcgcaaggaactcaaccatatctttggtgggcccctagcttacaaatccaagctgaaagcaaaagctgactgaatgggagatcaatgctgttcagctcgatacgcctcaatatcttcggtggtcagagacagctatcaagtttgaccactcggatcatcctgactgagtggtccactcggggcggtaccccctggtactagaccctgtggttcgcaacgtcaagctccgacgatccctcatcgatggtggcagtgcactcaatatcctttttgccaagactctggacgacatgcagatccctcggaccgagttgaagccaagtagtgcgccctttcacggagtcattccccggctatcttctactccactcggctagatcaccttgccagtcacctttggcactcgggagaactttcgcacagagaacatttgcttcgaagttgctgactttgagacagcgtaccaagctatactcagacgcctggcgttacccaagttcatggctgtcccacactatacctacatgatgatgaagatgccaggacctcgaggagtcatatctctgcagagtgacatcaagcaagccgtcacctgcgacaaggaaagctgcgagatggcacaaacacgcgagatcacgctcgctcgagaggagattcgactggctgcatcaacagcaaccgaaggagaagtgcctgcacccaagatatcaaagagcggagaaagcgacggcaagactaagaaaattcctcttgatccctctgatcccaccaaaactgctgtaataggcgccgagttagactgtaaataggaaagcgcgctcatcacctttcttcaagctaataaagatatttttgcgtggaaaccatctgatatgcctggtattcttagggaggtgattgagcactctttacacgttaaggaagacgctaaacccattaagtaacgactccgccgttttgtgaaagataggaaagacgcgatcaaggaggaattaaccaagctgttagcagccggcttcatcaaggaagtcctacatcccgattggctggcaaacccagtcctggttcagaagaagacaggacaatggcgtatgtgtgtcgattacaccgacctcaataaatcttatcctaaggatccctttgtgttacctcgcattgactaggaagttgactcaacggccggctgtgagttactcagttttttggattgctactcgggttatcatcagatcagcttgaaagagtccgactgcttgaggacctcattcattacgccttttggggcttactgctatattactatgccttttggattgaagaacgccggagcaacttatcagtgcatgatccagaagtgtttttcaactcagattggtcgcaacgttgaagcttatgttgatgacgtagtcgtgaagaccaagcagaaggatgacttaattgcagatctagaagagacctttgctaacatccgcgccttcaggatgaagttgaatcctaaaaagtgcaccttcggagtaccgtcagggaagccgcttggctttatggtatcccgtaggggcatacaagccaatccggagaagatcaatgccatcctcaacatgaaaccgccaagttcctagaaagatgtccaaaagctgactggatgcatggcggcgctcagccggtttgtctcacgactcggcgagcggggatgccctttttcaagttgctaaagaaaaccgacaatttcgagtggggacccgaagcccagaaagcctttgaagacttcaggaaacttctcacaactccaccagtcttagcttcaccacatccgtgagagccgctgttgttatatgtgttggcaacatctcaagttgtgagcacggtcctggttgtcgagcgtgaagaagacggccatgttcaaaaagtccaacgaccaatttacttcgttagcgaggttttggccgactccaagacaagatatcctcaggtacaaaagttgttatatgatgttttaattaccgtcaggaaattatcccactattttcaaggtcactcggtcacggtggtcacattgtttccactcggagacatacttcataatcgcgaggcaaatggacggattgtgaagtgggccctagagttgatgtctttggatctatccttcaagccacgaacctcaatcaagtgccaagctttggcagatttcgtcgccgagtgaaccgagtgccaagaagacacacctacggagaagatggagtactggactatgcattttgatgggtcaaagaggcttttgggcactggagcaggggttgtcctaatttccccgactggagaaaggctaagctacgtactgtggatacatttttctgcatcccataatgtggcggaatatgaggcgcttcttcatgggttaaggatcgcagtatctttagggattcggcgtctaatagttcgtgaagattctcagttggttgttaatcaagtcatgaaagaatggtcctgcttcgatgataatatggctgcttatcgacaagagatacgcaagttggaagacaagttcgatggcctggagttaacccatgttctccggcatgataatgaagcggcccacatactggccaatttcggttcgaaacgagaaacagctccttccgatgtgtttgttgagcatctttatgaaccaaccgtaccaagaaaagaaacgaccgaggcagtggacactcaagaagtaagcatgatcgacaccgactgcagagagcccctcatcaagtttttgaccaagcaagaactccctcaggataaagacgaagccgagcggatttccaggcgcagcaagctttatgtcatacatgagaccgagctgtaaaggaagagtccatcaggaatcctgcaacgctgtgtttctttggaggagggaaggctattgctaagagatatacactcgggcatctgtgagaatcacgctgccgcatgaaccattgttggcaaggcttatcggtagggttttttcggcccactgctgtatctgacgccaataaaattgtgtgaacatgtgaaggttgtcaattttttgccagacaaactcatttaccagctcaggagttgcaaactatcccattatcctggctgttcgcggtttgggggctcgacatggttggccctttcaaaaaggctaccgatgatttcactcatctttttgtagctgttgacaagttctcccagtggattgaagccaagctagtcgtcacaatcacagcggacaaggctagagatttcttcatcaacatcgtgcaccgcttcgggttacccaatcgaattatcaccgataatggtactcaattcactagtggtgtgtttaaagatttttgtgaagactttggcatcaaaatttgctatgcctccgtagcgcaccccatgagcaatggaagttgaacgcgccaatggtatggtacttcaaggtatcaaagcgcgagtctttgaccgactgcgtccttacgccagcaaataggttgatcagctgccatctgtactttggtccctacgcactacgcctagtcgggccacggggcaatcaccgtttttcctggtttatggtgcagaagcaatgttgccgagtgatgtagaattcgaatccttgtgatttctcaactttaaggaggagcgttacggagaagactgagttgatgatctcaatcgactggaggaagctcgagaggcagccttgatctagtcggcccggtatttacaaggattgcgacactatcacaaccgcaacgttcgatcgcgggttttcttagtcggagacatggtcttgaggaagattcaatctacacgagatcggcacaagttatctccgttatgggagggaccgttcataatttctgaagttactcggccaggttcttatcgactcaagcgtgaagacggttctctcgtcgacaactcttggaatattgaacatcttcgtcgtttttatgcttaggcattacttttgtatcttttttccctcttttgactactaacatcaagttgcttcttgagttatcagtcaggggctactatagtaataatggagtgtgattcttatcaattcaatttggttacttggtttatcattgccttgtttggttttttggcttagtcaatgaggtctgagagttttttaacaacttttacgggttctaggctcaataaggtttgacaaaaacttttaagaaatcaggagctgagtttaaattatcaagcacagcataaatacatcagtactgtacaaattgtgcctccatcatcacaagtcacattacacaatgtcaatcagactcagttttttcatcatcagatacatcagccctagtcggaccaagattggtatcatggaatctctctacgacatctacaacgatcttgtccgcagttttctgggcatcattaataagatcaagggcatcttctttacttgttccgtctgcaaagccatcaatatcatcaatattgatcttcggatacaaggatttagtcatcgccaaagccatgcttgctcccatactcccagcttctttaatgttcttgaaatacacatccggagcggtcctcagcttgtcgaagatttcaacagcgttgaataaactcggaccattgttattaaaaaacatagcctggatgagtggtgtagcagtgtcggtgatatgggcccgggggtatcgtgtttagagggaggaggctgccccctaaaggtggggtggcggccactccctcccaaagactagtcggaggaggctaccccccaattccacgtggccctcccccgaggggagtaaggcccaaggtgggatggcggtcactccttcccaaagactagtcggaggaggctgccctaaaatttttacattttggtcctttttgaaaacttattttacaaatagacccctgggaaaacttaaaccggaaatggtcctttttggggcgctagagtggctggcgccgtaccccaacatggtggcgccagccatatttgcgccgtgcccgtgccaccatggcactagggctgttgtggaggtgctaactgggcagaaggggggcgctagccacactggcgccgcccctcataccacggcgccagcatggctggcacgccccttctctgtgggccgcccccttaaaccccatgggccccgccacctttctcctccccactcccattttcgcccaagcactagcccgagctgagcagcggcagctctccccctctctctccccctaacctccccacctcaaatccactccattcgaactagtttttcgtgggattttttgtggaaatcgaagagaaaggtagactcctccattcccccctcttttttttcgtttttattggttgaatttgtagatcgaagggtaaccctagaaaccctttttttgcccaaatttgtgatttttagcatttgttcttgggatttacttgttgtagtgctacatgtttgcaatgtactcattggtgtcacgatttttttaaccatatatgtggtaatgttaatttttggattgtttggttggatggatggatgaaaaattagggttgaggcatgaaagtaattttaatttgatggagttgatgctatagcctataggttaaacttttaaccattaattatatgaaggggagaaaactttgattgcattatagaaattgattatagttaattagaactaggttgggttgtatgacggagtatttgtaatatttcgatgtgtaatgcactagtaaacttgctgatagttgtaggtggattaaatattttttttggagtagtagctttgggacaaattaagttatgcattggttataatatgtcggtttggactacgtttaggaatgaagatttaatttttgttgcaaagttacatttgattttttggtgtagatggatagaattgttcgtgtttactatggtggtagagtggtggaaccttatgttggtgcacatgttgagtttgaggatatgtcattgaagaccattttgtttcccacccacccaactctagatgaactaaggtcacgagtgaaagaagttcttggatggactgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttggtacgtaccgtagaaaatttggatctaaacaaatctccttcttatcattacattgagaagaattttgtgacatattcttctcgtcgtggaggggctgcaagtaagactgagttggtacgagaagacttggagggggaaggagataagaagagacctttgcttggaaatgatttaggggaggcaggaccatcaaagaaacattgcggtagtgatgatgtggatgcagcgaaggagatgaaaagggagttagtacaagaagggcttgatctaagtgacatttgtcggagagtgtgcattggtcgttgtacagaggcaaccctgaatacccgacagaagtagcaggccaatatgtggatccagatgattactttgatgtcgaattgagtggtggccacgattctatctcagtagaagtcaatagagaggaggttgacgaggaggcaagtgctgagcaatatgatgttgaatttgctgaagactctgatgatgaccgtccattccctccactaactaacaatgacaagttagcattagaggaatgtcgtgcgtttgagaaggtgtttgggaggaagccggacattcctgagtttagggacctaacacatgcccatggtgcaatactagatggcggcatcaacctagatctgttgccagaaccattccaggtggatggtctcagaaagggtttagagttcccatccatggtcgcattgaagctatggctccaggagtacgccatcgtgcaccatcgtccataccgtgttgtcaattttgccgcaaataggaggtacactgttaaatgtgaaaacccacggtgcaaatggaaggtccatgcaactaagaggtctagtggcacgtggaggatatcacgggttggtaaggaacatagttgtgctactgccgaaggttcagggagccaccggcagctgacatctaagttcatagcaaataggttatgcaatgccataaaactgcaacctacactctctgcttctgcgttagctttatatatatttgaggttttctagtatagggtgaagtatggcaaggcttggagggcacgagaggaggctatgaagctcatttacggtgaatggggtgaagcgtacgtccgtttgcccactttgctgcaagccattaagcagagaaatcctagtatggtctaccacatcgatactcatcctgatagggttgtcaacgttgatggagtgaccaagaaaatttttatgcgtgcattctggtgctttggtccttccattgaggcttttaagcattgcaggccattactagctatagatgcaaccttcctaactgggaaatatggtggtgccttgatgactgcattatcagctgatgcggaggaccaacttgtacctttagcttttgccttggtggagaaagagaattcacgagactggcgctggtttatcgatcttgttcgacgggttgtggttgggccgcatagggagctttgtattatctcagatcgacatgctggtataatgaataccatgaggactcctgttctaggattgccaccggttcaccaccgatggtgcatgaggcacttcagtgctaatttccacaaggccggtgcggacaagcatcagacaaaagtgctcctaaggatatgtcagattgacgagaagtggatatttgagagggatgttgaggcactactgcagcgtattcccgaaggtcctcgtaaatggcttgaagatgagttgttggataaagataagtggtctcgtgcatacgatagaaatagctgctggtggggttaaatgacaaccaacatggccgaacagttcaatagcgtgctagttggtgttcgtaagcttccagtgacggccatagtatcatttacattcatgaagtgcaatgattactttgtgaacagacatgatgaagcagtgaagcgagtccagttaggggagcgttggtccaccaaggttactagtaagatgaaggtgcaaaaaagtaaggcgaacaaacacactttaaggtgttttgataagcagaaaaagacatacgaggtcacagagaggggtggtataacgcgtggtggtgttagattcggcgcaagagccttcaaagttgaagatgaggggaactcatgttcttgccaaaggccattgctctaccatatgccttgctcacatcttatccacgtttatctgattcatgcaattgatgaggaatctcccaaccgaatgccgtatcatttctcttcaagagccgttgtgaacacataggcaagtcgctttgagccatacctcgaccccacacagtggccaccgtatgatggtgaagaatttgttgctgacccaaatttgaagattaaacaagagggaaaaggagatcgaagcgattcaagaacgaaatggactcgggtcttggtggttctggaaggaaaccaccatcatgtgttcaacttgatgctgcgccggtgcaaaatagatgctcgttgtgtcaccaggagggtcacaagaaacctaagtgtcctaagcatccaaaaaagaagaagtccaaaaaaaaatagaagtgttagggaggtaaatattttgttttcctacttaagtcaatgcatgttttattcttgtctatttaatgtctatttatttattttggattctcgcattcattttcttttaatatatgtcatattggtaactaacggtgaatttattactttttcatgtaggatggccaaggagggacaaccgccgacttacccagccttggaggcgtactacgaggcccgtcatcgcggggctgcgatcgaggcggggagggtatgaatcagcattgattcacttgtacataagtatcggtagcgtgtgtttgacattatattaactaattgttttacaattgctactgcaggtacttcaaccgctccgagttagagctcatgctcccccagtgttcgacgataggtacatcccatacctaagggcggccgggttgctcggggtggccttggtcgtgagcagaggaatgccagtgttcaacgctcctgtgttgacagcacttgtggacagatggaggcctgagacacacagcttccacctccccagtggtgagatgaccatcactctacaggatgtggctatgatcttggccctcccattacgggggcatgccgtgacgggcagaacaaagaatcctggatggcgtgcacaagtggagcaactgtttggcattccactgaacattgagcagggcaagggggcaagaagaagcagaatggaatacccctgtcttggctgagtcagaacttctcacatcttgacgatgacgctgagccatggcgtgttgagtgttatgcccgtgcatacatcttgcacttgttgggaggggttctgtttcctgatgctgggggtgacattgcttcggcgatatggattcctttggtcgccaactttggtgatctgggccgtttcagttggggctcagcagtgttggcatggacatatagacaactctgtgaggcctattgtcgtcaggcaccatcatccaacatgagtggttatgtgctattgattcagctgtagatgtggttaagactaccggttggaaggcctaagtggaggcaaagcttcacttcttggtcctacaatgagcccgacatggagaagacagtggcctacctttttgagagtactgccactgcacatgctcaccgggatgtggcatacaagcattatgtcaatgagatggactgcttacagcctcaacatgtaagtacttccaatatcacttccagttagacatttacttctttaattgagatactaaccaacgacatctcttcaatttttgcagattgagtggttaccataccacacaaatgaggcttcaagcctgaccctgaactcaatgtgcaatcgagactctgactacttcatgtaccagtgcccattgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattatttcatcaccttccacttgtctaggtatgacagggtgagaacaaagaaggtgaaagactgggggctagagcataacagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgattccgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttccgtcgagagagctcctcaggagtgtgaatgaaatggggcatgccctccaagctccgaggggtggtgagaacacggagaacacactccgcaatgttttagaggtaaaatttatttagcactttgcattacttgagttatgcctaacaaacttcttttttttttgaaatgcagaaagttcgtcaaaggtgccggaaacttgcagcaagattaggttgcaggtcgattggattggacgacgtgtaccaaccgcggagattaccaccaccactacctcaatccacgcgtccaagtaccgctcgacactccatcaggatagaagagcgtgaagaagttggtggctcgtcgtcgtcacgcattccgcaagggagggcaaaggggaaggcgccggctccacctagcgacgacgatgacgacgatgacgaggaggatgaggactacgtcgcaccagacgctgaggagatagacatgtcgtagcttcccgacgcgcctcaggggacgcaacccacgcaatacaacttgcgatccactcgggcagtgaaaaagaggtaaaatgagcttaccattctcaaatgttatttgattttcctcattttgtttttaaaatgttttaaacattggattttcaaatgtaggtacactccgggtttgcaagctattcggcgccaacggaagaagtgatttgtatgaagttaatctatttgttggtagtatgacatatgtggtgcactatgtgatataaaatgtgatggactatgtgaggactatgtgatggactatgtgaggactatgtgatggacttttgacattgtttcatctgtggaatataggatggacttttggcattgtttgatgtgtcgaatatgtgatggacttttggcattgttatttgtgcaattggaacttgttttagtctgtatgaaactgtgaattgtgatttgaattgcgaactgtgaattggtacatttgtgcaatatggatcttcaatttgcagggaggcagagggcggcgccaatcaccctggcgccacggttggggagggcagcgccagccactgccacgaggcagaagggtttcggggtggggggagggcggcgccagctacactggcgccgtggtccatgagggcggcgccagccgaggcccggaggcagtagggtttcggtggggaggagggcggcgccagccaccctggcgccgtggtccatgagggcggtgccagccgcggccaggaggcagaagggtttcgggcgtggggaggagggcggcgccagccaccctggcgccgcggtcttgggggggcgccagcctttgcccggaggcagaacag

SEQ ID NO: 13039 - DNA, 31856 bp, Oryza sativa
tttcaagggtccatttggaaaataaatttgcaaaaagggaccaaatggtaattttttccagcttgccccccaattccacatggccctcccccgaggggagtgaggcccgaggggggatggtggccactccttcccaaaaactatttggaggaggctgccccccaaccccatgtggccctcccccaaagggggtccgcccaaggtagggtggcggccactctctcccaaaaattgaacggaggaggctgccccccaatgccatgtagccctcccccgacgggggaacgggcccgaggtcaggcggcgaccgccccctcctgtgactaggggtcgggctcccccgaccccctctttaagtcaccacgtacggtgggttaggtgtccgcctacaggtgcccacctactcgcatttatggcgacccgagcggtcgcgccatgccgcatttaatgtggcgtgcggtgtactcaaccggtctgtgatcggtcgaatgaccgatgggactgggtagtgcgcctgtgcgctgctcgtgtgtcaggcggcgtgcagcctgacatgtcccatcaaataatgatggtgagaggttctcatcgtcttatcccagccggagtcggtcctcccgctctggtcaaagctaggctcccgtttcccggtgtaataggagcccaggagtcttcacccattaaatggtgaatgacatgggcgccccccgtgtcaggcggcatggtgtggtaggcccgacgaccgaggcgacgtgtatgtggcttccaagttaaggaacaagacatgcatttaatgcaaagatggtaatacttctcgaggaagttaggttgttgggcctatgtggtatcccctagaactataaaaggaggaccttgcccaccgagaaaagggacgacactcagtaggcctgaactctaggagaagaagagcgagagtgctctccggagtttaggaacccttgtaacactcaaccataatcccaaacacagtagtagggtattacgcttctcagcggcccgaacctggataaaccccttttgtctcatcgtctttgcgggattgaaccctatcaagatcacacagcttcgctcaccaagccctcgaatctcacccgctgcccccggctgaactgacaaaggggggcctcacggttccccgatggaggagattattctccgacatctggcgcgacaggtaggggcgcgttcgtaatttttgaggttctttcgagtgccggcgtgacgtgcgtcgcaccgccaatgtgggggaaggcgcagcctcctcaagagagccgcgcaccccaggcaggggctagtctccctgcatcttcaccgggtaaggctggtggccaggtctttatggcgagtctttggaatgtccgatgacccccaaagtttcggcccagcctcaccgaaaggtaccacggtagtgtcaacccctccgagtccctccagatccacacgacgatcatagaggtggcgtggggtgacgaccgggtcaaggcgaatttcttccccatggccatccagggccaagcgcggggatcgcttatgaacctgccacctgcctcggtctactcctaggaggactcttgcagttgagctccgggtgccgtcgaagcccgggaccccctgtgctggctcttccgtagcggctagctttggtcccgccggctggctacggtgcctagcccggctcaactaatcgtcctttcaagcttcaagtattttaaatttttcaattcatcagcttaatacagcttgaagtctcatatttatttttcccccgttcttttctcatgaccttgcgacgctcgcgtgttacgcatttgtttgctcccttggtggtaagatcccaacctctctcccatctacatgaacgtttcctcgctaagtgtgggggctaagttttctagccctattccagccttaagttgagcgtcgggtgccgtcgaagcccgggaccccctgtgctggctcttccgtagcggctagctttggtcccgccggctggctacggtgcctagcctggctcaactaatcgtcctttcaagcttcaagtattttaaatttttcaattcatcagcttaatacagcttgaagtctcatatttatttttcccccgttcttttctcatgaccctgcgacgctcgcgtgttacgcatttgtttgctccaatggtggtaagatcccaacctctctcccatctacatgaacgtttcctcgctaagtgtgggggctaagttttctagccctattccagccttaagttgagcgtcgggtgccgtcgaagcccgggaccccctgtgctggctcttccgtagcagctagctttggtcccgccggctggctacagtgcccagcctggctcaactatggacggggatcgctggctctagagtttttcggctctcacactcgtgcgaaagtagttgtccgtgtagaagggagagatattggaaggaggccaccgaaaggaaagagcaaacagaatgtgtagcatggggacacaggctcgtggaaacctcacctcgtttgctaagtggtcgcaggcttcccaaaatggttaggtacccatggtgggaggtcctcttcgagccaaagatttgaaaggttgcgacatccaaacaaggataaacaaaggtaacaaaggaggtattacaatacccggaccaaagccgacctctctgggaaagctcagcgttggccggatgatctttttgagcatagcatttgtaatacttcctttaagtttatatccactttgtccatgcttatcagcaaaattattatggcttatatttatctctcacccatctcttactcgcggtcccacggtacccacgtgtcgcgcgctggcttgcctcccttggtaacaaaaagtttgtattcgcttcatccattcaaacgattctttgctaaaggtgtgggggctacaattccaagctctatcctagctctgcgtcgagctctggtcgccgtcgacgcccggggccccctgtgctggctcttccgtagcagctatctttggccccgccggctggctatggcgcccagcctggcttgatcgtgggtaaaggttgctggctatggaaagttcagtcctcaccctcatgtgaaaataatcgtttggatagatgaagtaaaacgcaaacagaggttaacaaaaagcaggggcaagcgaggtacgccgcacgaggtcgcgggctcgagagaatctaacaacatttgctgagtatatacaggaaataagttcacggcctaaggtacgggctaaactcccaagcctgcagcgcctcggagaccgggaggaaagtgggaagttaaggcgacgtatgaacgtgactaaactcccaccgcccaactcctagaataataggacagaagatcgggcccacatgtcaactgactagcagattggcatcaaccctgaccacctaggaaaggttttggccagggctaacgccgggggctactgtcggtgatatgggcccgggggtatcgtgtttagagggaggaggctgcccccaaaggtggggtggcggccactccctcccaataactagttggaggaggctgcccccaaattccatatggccctcccccgaggggagtgaggcccgaggtggggtggcggccactccttcccaaagactagtcggaggaggctgccccccaattccacgtggccctccccgagggtagtgaggcccgaggtagggtggtggccactccttcccaaagactagttggaggaggctgccccccaacgcaatgtggccctcccccgaggggggtcgggcccgaggtagggtggcggccattctctcccagagattggacggaggaggctgccccccaatgccatgtagccctcccccgaggggggaacgggcccgaggtcaggcggcgaccgccccctcctgtgactaggggtcgggctcccccgaccccctctctaggtcgccacgtacggtgggttaggtgtccgcctacaggtgcccacctactcgcatttatggcgacccgagcggtcgcgccatgctgcatttaatgcggcgtgcggtgtactcaaccggtctgtgaccggtcgaatgaccgatgggactgggtagtgcgcctgtgcgctgctcgtgtgtcaggcggcgtgcagcctgacatgtcccatcaaataatgatggtgagaggttctcatcgtcttatcccagccggagtcggtcctcccgctctggtcaaagctaggctcccgtttcccggtgtaataggagcccagaagtcttcatccattaaatggtgaatgacatgggcgccccccgtgtcaggcggcatggtgtggtaggccccacgaccgaggcgacgtgtatgcggcttccaagttaaggaacaagacatgcatttaatgcaaagatggtaatacttctcgaggaagttaggttgttgggcctatgtggtatccccttgaactataaaaggaggaccttgcccaccgagaaaagggacgacactcagtaggcctgaactctaggagaagaacagcgagagtgctctccggagattaggaacccttgtaacactcaagcataatcccaaacacagtagtagggtattacgcttctcagcggcccgaacttggataaaccccttttgtctcatcgtctttgcgggattgaaccccctcaagatcacacagcttcgctcaccaagccctcgaatctcacccgctgccctcggccgaactcacaaaggggggcctcacggttccctgatggaggagttctacctccgacaagcagcattggtgacttcgtccctagctccttcaagtttcttgatcttgttgaccaacacttcgaattgagcttgagatttaatcttgcgatatgcataaaagggttatatcaacacctagaagcgaaaacatgattaattttgagacttgaactgcgattaccttcaacatctttcagagctgagtccctttgtttggttagttcacccttatcttttccagaactttgattcgcttttctagctcggtgatcttggcagcttgtactgcaatacatcccagcggttggtcgaacacggatgatagcttggaataagttattcaggaataggggttacctttagatgaaccacttagctcgaaattggaatcttgaagctcggcaatccggtccctgagatcatgttcagtcttcctggcaagctccctggtttcgtggagttgggttctggttgcttccagggttccaagatgtgggaccagtttttcaagggttgcagtctttgcttcattcctaatatgaattctctgcattacaagtttattcagttcacaggactgaccaacaggatgagtcaagctataagcagaagacgtacattcacaagacgagtggcttgattaagtgtctttgtgagtagagacacttctttgtcatctttctgcttatttattacaattccttgcggctgcatttcgtcatcccaccgtatccgaagaatttcttcttcgtcgccaattattgggcctatgcatttacgaaaagagtgataaagcgattgaagagaactttttcaatataaatggattcagaggctcagttacctgttataacctttagaggagggcgagctggcccttgtactttgtcaaaagtactgacctctggaccagcattggtgttgttaaagggagggttgtttgtttgttcctctatctctgggatgtctttatgtggttcaacctccggctggtctccagtcaggggctcttggtgagcgtcaatttcagcttctgccgactgatttccagtcgggggcttgttcccagcttctacattgtcggtcaacaactaactgccggttgagcggttttcttcagtcggctcggtttccctggcagtcgcagaaccagtctccttgtcggtcgactcagggtcttttccagatggatcaatgtctgatggtatcctgaggattcgagatgtgttatattgatgatgcatgtcaagacaacacatgagaaatggcaagctgattcatacctggtcgattttctgaattttggtattggacgactagatgttctcttcttcgggatagcctatcttagctgttttccaatcacctctttgctgctagctttcccaacattgtcaccttcgtcgtcactcagaactaatttccttttccgagagcccgactggttagttagctttgagatgcttggctgagcagcagactggatttttggcccgccactggcctgaccagcttgtcggcggggcgagcggcgttgagcgattggaggatcagatttcatcaaagaaaattcctatgcatgatatttcaagttttcaaccaatagtacaaaagacaaaaggatgtcataaggaaggccgaaatatttgatacataccggtagaggagggttgaaggcattatatggcaccactagcagtaggtgtgaatagctaaccacaataccgtttgagaagattttgtacatcctctccttcataatcttgaactcaagagactttggatcttcacggttagggtcattcttgccatcgaactcgaaggcagtgcgggatctctctttaataggtgccagtcggctcttgataaagtgcagagtgatttgttcccttgtagaccttgctctttgagttttagcatgcgttccaacatgataagtggttgagaagcctcgtctcccattggaagcgaattctaggtgtcttgatatactggagaaggcaggagtacttgggaagtgctggttcaggattctgtacatagaaccagtttgcgtgccagcccttgtttgatgttttgaaaggcacggagaaatatttttggctcagggtgccccttaactaaaaactggctcccccaacaacgcacggcttgctcttgtttggctggggcttcaggaagaaaaaacggcggaataaagcaaaatgcggcctaattcccagaaaagcctcgcaggcatggataaagttggcaatatgaactatggaatttgggttcaaatgatgcaagctgattccataaaattccagaatccccctaaagaacttcgaagttggaagagaaaagccaccatagaagaagtgggagaatacaacgacctcgtgtgtcgggggtcgggaatgcttcgccgaatgctggatgccagccgaaacgtcgtgcaccaccatttccgttaagttttcttccgtgacatcggaaggagcccattgactctcaaagctttctctctcctccgccatggatgcaagatggatgatgaaatctagcgtgagggtggtagtgattggagagggaatcgatgcggtagttgtgcgggagatcttcgcaaaaacacgaggctttgggaaggtggattggtgaggatttgcaaaccctagttttcaccggcgcagttcttgtactatagcacagaatggggaaagtggcggaggtctcggcggcgaagacgaagcgacgcttgttcagtgttttttgttagggtatcgggaggtactaatgggcctaggcctgcacagtgctttcagcccaacttcactattggcgtggctggttgtgttccttagggatttaagcatatatttttgccttggtataaattgctcacaacaggatagcccaataccgttaaaatcctttttgatgcagctagataattctttggaattactacgatgcgaaataaaaaggtgcccgacagaaaagtgtaatactaattttgttgacctttttaggttgcaaagctacttgggttttgttgagatggttaatttcagatggctattctctcagcatgttatatgcttattttgatattgacataagtcgcagcttaggctattttgacttgtcatttgttattctttatacaacagttgatgaatcctttaagagttttttactcggattcttgtcatatatgttgatttatagatctttggagtgcttttcactcggatctctttatgcctttttgggcgtattatggctaaagcagtcggttggatattttatcaagtgctgcatgagcttaagtatataatccctaaagtgattcggttataagatcactcggatggatgtttaatgtaccttgactatatgtttagtttttattcaactaatcacatagttgggggctacacctaattaggtgcatctagtcgatgcacctgatttttaattttcaacccttcacagtctttgatttaagtactcgggagaccaaggcaggagaagttgaagcactcggattatcgttttgtcgttttggattacgagaaaagactatttcgtcgactgtaaaggtcttaggggctactgtggagattatggataccacatatccacacggcatttatatccgactgggtataggggtaccatgtatagatagaatatctttaaagggtttcgggttaaattccttaaacttgtatattaaggaagcacccgggatttcagtcggttatgactgtatcttatctataactgcctattccgttaggaatatgggctgtactttgtaatacggactccttcccctatataaggaagggtctgggtgcctcttggggcacgatttttctctcagatcatacgatcaataatatactcggtggatcaatccctggataggagtagggtattacttcttattaagaaggcctgaacctgtataaaattccttgtctctaaacccatccacttttccagcttgatagccaccccttttagtattgccgaaatcttgtctcgacataaataaacacatttacaatggcacagatcaaattaaccgctaaaaggtggtttagataaaatcatatcgatagatttttgacattattacagtcgatttttcagtcatttcatccttcgagatttgtgcaagatcagggcaggatgcgggctagttagaacaactcattaaattgaaaccatacgtatggttgtgcataagctcaacgagcttttgctactattggatgttactactctcactacccaatgcagtgaattaaccggatgattcataggaagcaaggaagggaaacaaacaaatcagtgtatatacaccttaattacactatatatatagtcacatcctacttacattgtgtaactacgacataactataactatagtgtaattataccgtgtaaatgagcatgtagttgtatgcagtaaatgggtaataaaaagttttaaatgttgtacaaattaatggttaatcaaggttaattaagcattactatcattcaactctattaccgtgtaaattcgacttattttactaacagatgtgttcgacaatccccaaatttgataaaatatgattgaccgaacttttataattttatcctaaatatatacgagggttatgtacggttgttaaaaaacccatggactttgacacattaccatctaaaacccataactattagataatacttggcttagcatattaaaaaggaaggcacctagtgggtatgtgtgcgccggctgcataaagtcgtgcggccacgcatcccatgcatccacacgcttttttcctctaattatagcacttagtgtgatttttttagtacgtaaaaaaagatgtagctaaaagtttttaaaatttagttgaaagtttaaatttggacttcaaagatcgaaagtttaaaactttgagttgagtattgaaaagttggtatatttttttaaaaaaaatgagttgaaatatttaaatatgagttgaaagtttcaaattttgagttgaaagtttcaaaatcttgagttgatagttttaaaatttagagttgaaagttttatatttggagttgaaagttttaaaatgagttaaatttttaaaaatttggatgatttttttcaaattatgagttcaaagttttaaattttttatggaatgattactctctttttttttctaaatctaaagatatgtatgaccgccaatatgctatacacatgaagctgcacttgtggtcatacacaaccatagcacctgtaggctttgtgagcaagtagcatagagtgcacaccacaggcgcatatgcaccgatgaacttttccaattaaaataggccaaagaataggttaaatctatgtacatgagtctacatatttggaactgttttggtaaggaaagataagagttgattctggaactttctattgactggtaggtctctaccaactaggcaagagatgttgttgctaatgtagccaaaataaaaattacattaatataattacactgtaattttttgaaagttactatgtaatttatataaaattatcatgtaaccatttagatttatgtgtaacttttattatggtttttaaattaaaatttagagtaaaatgcgtcacaggtaccacaatttgtagagtgggtgcaatttagtcacatattttgtaaatttctcaaataagtcactcaacttgttttgaggtgcaaatctagatgaaaaggtgccatgtgtattatttatgccaaggtggacgccacgtcagcatgacaggttgaccttgtatgcaaggaacaaaatgcaaagtagcccttatattgtttcaattttccgtttgagtacataggtttgtttgataccccacatcttcaatacgtgatttagggccatgactctctatatctggcgccgtcctgtcccatgtgcatgccaacaaaaacctacgatcatggcttagcacacgggcataacagatctaaataggccaattagatctgtattactttcgccaaactcatcgccaaagagtaatatagtagaagggtttttctacaaaactgcattactttcgccaactcatcgtcatgtctgccattgtatcgtccaccttggcaaaaataatatgctagcacatttttattatatttgcaccccaaacaaattgagtaacttatttgagcaatttacaagatgggtgactaaattgcactcaccttgcaagttgtggtaccagcaatgcattttactctaaaatttaattatattgtatttcataattaagctacttatctttgttttaatcatgttgatgagttttatgtgttttaatattgttctagagtaagctaaatattatagtgttacacctgtgtggagggctggaggaccgaagagaggagaaggtgccaccttcgtgtgcgtggcatggatgcggtgcaactgtaatgtgggatcgatcaatggagacagagtgaagctgtcaaaaacgatcttcagattggacagagtatctccaatagtctctccatttcaatctccaaacaaaaatttggcaaacttgcgggaaaaggagcctccgacaaacttgctaaatgctaagccaaatggcttgctgaaattctaacttgactaaccaaatgtagaatgttgaaaccacttgccaacatgtatcccaccaccccaccttctctctccacgccctcatccctctcaagccactccgctgcatcctccaccacacgagagcatgccttcaccagccatcatgcctctaccttcccaccatgtgagcccaccgtctgttgacccccatcctccgcatcctccctgcacctctatccccacctttggctccatctcactggggtgttgatgccgctatcgccgaggtgatgttgccagcaccgccgccggactcttcccctcttgttgcatgccaccgtcgtcagcttctcccctcaccactactgttgccaccggtggatagtggagagcttgaggaggaggattggaagcagtggttgggaggaaggtgaacgggagaaaaagaagagttagagactgacatatgggtcatataatcatactcttatagattcacaatgcagagtgtagatggaaagtccccgcaaaaaagaggagtgtagatggaaaggctattggagtacatatgaaatatagagagaaatctttttgtcaacttgccaaataagaaaatagagagtttgggttgagtaggttattggagatgctcttacccatgggtgacagctttttttccgaacactataaaggagtattgaaggtacagtagtgtaggttgctttaatggagtgaacagtgttatatctaatggtgcaaaatagtactccatccatctcattatatagtaacctagtactggataagacacttcccctgtccagattcagtaatacaatgtgtctcatgcggtgcatgtatcttattgacaatctgttgacgagaaatccgtgctcggctgatggtgtcaggtctgcgttggcgcgaactaagtcgacgaacacaacagcctggaagatctgcttagctctagtgtaggtccaaaggttgatgagatgcgggcatgccagtcagtttgatcctataactaataagatatacaaatagcagatcaacgagtcaatcggctgacaagccgatagagtaattccaaccaatgccgatgccgatgccaaccgatagcgatgggattttgaggtatcggttatatgtccaatatagataatgatagaaagacaatcgattgatgatgatgatgtaataaaataacaatataatccagtagaaaccaatcggctaataatgatgtgtagaataagcactgattcgaagtttaatgcgtacatcggctagaaggccgataccataaaatccacatgactagataaacagtgaagcctttgttgcgatcggctaaatccaacttgtatgcaatccttgtaagcggatacaacatccagataactcatcggctgaaaccccgatgaaactcttatcgacaattaaagacaggttagtttttatggttctaagcacgactaagatcgatgcaactcaaagtatgcaaagaaacataaagtctaaccaatcaagcctttgactgattctaagagtggtggatgccttagctaatctaatctggtaaagcaatttagccgataccggcataaaccctaaaacgaatctcagccgatacaagtaaattcaaataccaaactagattaactaagatatatgatagataggtgcttacattgaaaagattagtgtcgaagccctagccccaacgttgcacgcagccatgacaagcataaactcgtcgaaatcaagtagaaaggtaaaaggtggtgttgatgcgaaaaacacacactggcatcagagatttgctttactctagtgcaggtccaaagaattgctttcgagttctgagcgtgccagttggtttgatcctacaaccaacaagaaaccaaaaaaggaaacaaagttaaatccacaaacgacagccgatcggctagattgccgatgacgtatcgttcagtattaagccaatgtaacatgcattagatccgcaacgaaagatagattgcagaaacggttaaatgtacctgatcggctgtagatatcaataatacataatcgatacttcgaaatacgtttaaaccaaatgattgggatagatcggacagcacgccgagatagtataaaccacttggatccaaaaatacttcgaagcaaggatcatgtacattcatagaatagccgataagatagatctgacttgtatcggctagtactccgataccactttatactgagacatcgatatagatggaacatactgaacagggatcaatctaagatcgagataacctaacagactgatggcaagcttagtatatctcaaacaagtgagatcttaatataaagggcagatttagtatatcaagcaaacgtaaaaggagcaggataactaaaccaggtaagattggctgaaactccgacgctatctctattggcaatcataaggcgagctagatattatggttctaagtattacttaataggtcagacttaaccgatgcagcattaagcgcagatggaaacataagatctaaaccaactgatgatagccttttcaagatggtagatatactgtataatctaactcagccattaatgtttaaccttgttagctattttcgatgatagaggctagctgataagattaagcagcgggaccgatctagattatacaacatatatgataactcggcgattcacataagcaggactagagtatcatgaagatgtaagcactagtcccgagaatgcaaaccaccataacaagttttacctcttcgccggagatcgaaaccgatgcagctccactcaaaagcaagaactcgtcgaaaacaacgaaagtagaaaaaggttggcgatgcgctgaaagtattattgaactgatgttgtttgtttacaaggtcttgggtcatatttatacccgaaatacataatatgtcctcgccagacacgactctatctctattacaacttaaaatacgaacaagtcccttaggcggactcttaccgaaaatatctctaaagaaattaactagaaatatcctaattaatagatacagttgccttctttggactcaatccatacgtggcaatgcttgtgcagcgcctcaattgatcccatcaatgattctagaaccatcttcctgggatcggctacaacggcttctccctatccgatccagtatcagctgatgcagacaatagccgatgctgccagtagccgatgcgcactctgcttctgagaaacaaactctctcaaaatccgcttcgattttaactttgaatccgatgtatgatttaccaaatttggccgttaacaggtggtgatgcaccgaattgtattgatctgtgagatagtttacaatgaccacggaatgtacatacttatacccatgggtagatactagtctttgtaggacaagaaagaaacattcctaaagataaaaggaaaacataaagtccttatcggacactaaacacactttcctaaagataaaaggaaactaacagagtctttttaattaatagataacttaccatgctgcatcctccttgaacttggtctcttctggataagcttccttgaatagattaatttccttaaccgaatatagcaagaatctgactattggcaacttgataattcctatcggccgattccaggactctaaagccgatactgactttaggccgatgatgacttcggagcttaccaaatttcactgttaacacaatctttgcaatagctagatgcaactgtagaggatctaaaatgccatgaaaagggttaaattatcaaagggtgtaacatggtgtgcttacgtgatgtgaacatcactccttcggatacacacaacaatcctccaacggtcattcaaggaccgataacaagagctcgtgcgcgacaattgaatttagaggtgagctcgtttctatgttcttctttgtacgaattttagaatagattgctacctaatgattatattgtgattagaaacaatggaggggacaaggagacacttggagaaggacttagagtcatggaggatcatcgaggacgtccaagtcaaggtagaggtccaaaccaaatcgacttcgagtgcaactcggagttcaggaccagtctacactaaaacgggtgcccaggtcgcatacgtgctcggattggggcgatctttatatggatggaaagctaagattctaatgcttttattcccatgtccaaattcttttcgagtcaacgggaatcgaccgaataagttgacgtccagaatctgtcccggtgttgcgtcaccgtatttgggcctttgggccatgtatcgtgttggaggccattagggctgcatcaagggttggttgcatgaccctaaactctatatatcagtacccgccatcatctttagggtttgggttttgcttagattattctatctagaatagtttcgccgctagatcggtttgtaagaccccaactcttgagcttaatcattcatctgcaattttggttgtattctaccttattcttgtttgtgttctttgattcgcaaatagggattagccttgtcggcaaggtcatctgcgttttggtacgggtgataactagaagagacatggtgctgcgattgcggggctcaagagcgtgcgtgttcaagaagccggatcgatttgtgtcgtgactccacccaaatcgttgattatcagaacatttcggaagatcgggaaccctaatccacatcattacgggcttcacggcccgcttaatcacaaccgtagttatacatgtatttatagtgtattggttcttatgtgggctaacaagctgtgtactttaaaattatctactatatttttttcagctatgttttaggttgtagttagatatattctactgcacgctttattttcataatccaatatattagccctacttttatagagtagccacttaagaataggtctaatcgatatgagcttgcatactcattgtgggtcacatctgcacgttgagttgaagagcccgagtgtgacttagcaagcttttcacttttggccatgcactttgcacaacctcggctcaacaaagcctatccagctccacttctagcccacatatatgtttaagtttcgatatacagagttcttatgtagtgttcccatatacaaactttctatttatatagtttctataccacatgttgaaagttttaatgtatagtctttgagcggaatctttcaatattaagatgatagttatatgattttgagaagaaactttcaaatattcggttgaaatttcatcattttgagtggaaaaagtttcttatatctatttgaaatttcatatacacaatttctacatcgagaagttttgatctcactagagaataccaagaacacaatataatctaagcctggttggaatcaatcaatatgcaaacaccaagaacacaatataatcttcacgagaagaatgtacatgttggactttattaacattgatatcaatataaaagttgcattagactatcatataattggtgtcgcattggttgagctgatttttttatgacatgcttcatatactaagatttttttatgactattcaacatatgacatgcataatgtatttgtgagaatgattattcttgtactcctgtcccaagacaacattgatacttgctaagatgacactcaaattacagaagagaaaaaagggaaagctaataatgatgcttcttggactgaattgatacatcttcagttggagataagaagcctactaaatatgaagcttctcactaaggtgtaaatacagttttcactgaagatgtgcacactataacaatctcacaatcaccatgagatgtttaagcacaatattcactaaagatgtccatagttcccaaatacagtcaatcatcaagagataacattttttctgtgaacactagtggagatctagatcataacaacactaggggagatctatcaccgtgtgaccttcaaatgtcctcttcaaatcaagaatccaagtttcctttaaaactacaaaatatagctataaaattccatatgagtatgtaggatcgaacacaagaactaagcctatcagggaatgaatggtaggaacactaaaaattaaaatctgttttttgcaataaaaataaatctctgacctgatggagtatggtctgaccagcaattggccgctggtctgaccaccctatcactcctagtcagactgtatgctcaccactggttggactgctcgcaaattaggctacctatgtgccgttggatggatggcccacctaatgttagcataactaccgagatccagaaaaacacagatcaaagttgctcttaaaaatagatcgactttattgtatcaagatgtgtttatgaagtgcatccaatgtgctcctcttaactgacaaactagaatcgaaagctcaaagcaaaccctaacttttctcttcaaaagttgccttacattgagtctcaacacctcatctatttatacccacaaatttgattgttgataaccatgaatccaattataataaggaatcctaatcacatagaaaacacctcaaaccagagatacacagatccctttagaactccaaactccaattctcttaaacttcgactccaatccaaattcaactcatctttctatatgcgcacaattcctattatatgccatatgaaaactttaccttcatgtgcattgctcttagtatcacacatgatctccttgatcgtctggacctcaacttctctcaagtctagtcctgatccatcattggtaatactaccgaggcctcaagaaatacctacacatgaactaacaaagaaaccatatccaagcacgagttctttcccaacttgactcacattagcacggaacaatatattttacgtataaagatcagcttgaagttttaacatgaagtaatcaagattatccataaagacaattgaaacaaactccgagctggagtctaccggtgagaccatcgagccagctggtccgaccgccgtctaacctttagtttgaccgccattgcctagctagtccaaccagtctcattcggagagcaaaactactttgcccaatccgaccacctttgcctggcctgtctgatcgatcacacccaaagcaaaaaccactctgtccaataaaccaccatcgtatctaaactagtgtaatcaactcgcatgccaattgttcatcataaaaacattaatcaagacattgatttaacaagtatcaatagcgtttgtctgaaatacaccccttaacttcaaaaccggatataatacatccctcaattcttaaaaccattcaaatcacccccccccttgtcctgaaatatggtggtttcgccaatgtgtggcgctgatgtgtcaatctaagtcagcaaaatatattagaaaataattaatatcccacatgtcaaactgattcatcatcttccctcctctctcttcccaagccagaagccaccgggttggtcagctcgagcgttgatgccgatgaatgccgcagacagcgcaaagaagagagccacgcccctgcggacgccgcccctgcggatgccgcctccgcggccccgccgctgtggcccgtggtggtcgtcgtctttgccgccccgcccgctgccggcgagtgcgaacaaccacggccggaggttctcgacgagccgccggtgaagtgtggaatgcaaacgcatcggttgctctcgctggaccttctcgatgcaccaacagcgacggagtttctgtccttgcatggtgtaccggcggcggcagccgcccggagcatcaccgatcctgatccatgcaaaccgtccatagcgaaaccgttccaccgtcaagcatacatcaccggcagagacgagctgctcgcgacgcgcttcgtcatcttgctgttcgatcgatcaatcaactccagcggtatgcgattgcacagcaaaacgcatcgaaaattaaatgggagcatgcaatttcgatcgatcaattaaatgacgcgatcatcaccggcggtgacgagctgctcgccggctacgtgacagtcttattcccattgattaattgcagaaactaggatagaaaccacccaggggggtaaactgcgtggtattgaaagttcggggatgtaaaatacccggttttaaactttaagggtatattttagacgaagttaaaaattgagggggtcaaatggacttatcccatatataaattagcaatgatagtcacttcctaggactgttggttatggttacgaatcgacattgataccttagtgcctgttctgtcatcattaacttcactgttagttcttgttatggaatccctgtaggttaatagtagtgttactacaattctagaggaatccacagtaataggctgcttacaaaggacatttgtttaggttttatgtcgtcaacacattcgcaagagtaaaatggaaagaggccattgagaagggatctgaagtgcaagagagaccagtggcttactgggtcaccaaacttaagaaatcatcatgctgatggtatgtgcttagcaaaccattatggatcctaatagactgatttccctatatctttatcacttgattgaatgtcctccatgtgcaaaagggttttgaagtacataagtacaaactgccgaaaattagacccaaaaccctgaatttcctacatgtgtttttgagttcagttcagttctatatggactcacctcttgttgtcacccttatcacgtaattgcaccggtgctaagcacttcaaaacatacaaggcgttattactctggtatccgattcatcggccgcgactcagagttggagttggttgttctctgctcaaactctccggtgaactcctcggaggcgaatgcgatacgacggagttgctggatgtcagcagcgtcgctgccaccagtgaacacttggctctgccccaccttgatcccattgctaaggtccgtcatgctcccctcatctagtacccgcatcacctgcaccatccgcggccgtttgggagcggagtggcgaacacatgcggccgctgcttccaccatcgtcatcatctcattgcggttgtatgcgccctctagccgtggatcaaccagctcactgagatcacccgtctctaccgcatccgccagcactggtcgtgcctgcaaagaagagatggcgttgtatataaggcaaaaaagacaaattttaaatcgaaagtgcggtggcgggtgggggtaggaggagatacggaaaataattctaatccctcgagaggatgttctctcgtgtaccttttttccaaactaaatgcaattagttataaaaattttaaaaagaaattgacaatgtaaaatataatgacatctatcactctaccaaaaattaagttcaaatttgtcctacacattgagggaaaaacatctcaatgtgtgagttgggtttagatctaattaagatttcgtggagtggtatatatatatatattgtataaatgttgtgaaagtttttgagacttttttatatctattttaatggtagaacgtcccctcgacgatcaaaacatacccattcgacgaggctctcctctccgaggggctgcgtctggtcaaccggcttgcggccggtgatgagctccagtaggacgacaccaaaggagaagacgtcggagcggtccgtgagcttgccgctggaggcgtactctggcgctaggtacccgaaggtgcccatgatgcgcgtcgacacgtgagtgtgcgtatcattcgccagcttcgcaagcccaaagtctgccacctgcgccaccatggatggaagcatcaaacaccatggaactttgaattgaagatggcagctggctggggagatcgatgtactgtatatgcgtacctgtgcttcccacgagtagtccagtaggatattggcggtcttgatgtcccggtggataatccgcgggtggcctatcttgccaaggagagaacaaaacgccttttttccagtgttagctaggtgatgtgtaacagcatataagatagatcgatgagcgtcaatgtggatcattaaacttacagtcctcgtgtaggtatgctagccccttggctgcaccaatggcaatccgcagcctcgtcggccagtccatcactggcatgccacggcctacatagaaggacattaattagttgtaagctgcaaacatggtttctaattttgttttgcatatttacgtcaaggggcaccggaattttttattttttttgaaatttgaataaattttaaccattttttttctaaatgacaaaaaaatatatttttttcacaaaatattagtggtgaaatagtgtcatgccgcaggctgaaattcccaaaacttcgaacagagtgcaaacactggctgtaaaacaccggcacctatgtccgggagtataggtgtcggctgaaaaaccggcgccggtttccaactgaaacctattaaagtttgtgtactagtgttatgaattgattaattaattacttaccatgaaggtggtgttcgagggtgccgttgggaacgaactcgtagatgagcatgcggtggtgcgcggcgatgcagtagccgacgagggagacgaggtggcggtggtggacgcggctgatgatctccacctccgcctggaactcccgctccccctgcccgctcccggccttgagctgcttcacggccacgcacttgccgtcgcttagccaccccttgtacacgcacccaaacccgccctcgccgatcacgttgtcccgcgagaagttgctggtgatccccgtcagctcctcgtagctgaaccgcgacttggaccccgccggccctgtcccctctccgcccgagaatgtccccgaattgtagtacccgccgccgtccgctgacgccccaccggagttgagcataatcgccgacggtggtgggtggtggttgcggcttgacccgccaaactgagacgatggcacgaagtagttgttgccatctgcatccgatcatccgatcaccgttgttaatttagctgcgatatatagttcacaatttcttgtgcttttgcatatatagttgcactgcattgcatatataccgtagtggtagaccagcccatccatcttcttcttcctccggctcgacacgatgaggtagatggccactatggcacacaggaggcccgtgaccgcggcgccggcgatggcggcggctatgtggccgctgctgctggcctgggccgtcgagcttacggttgtgtgttgctgctgtgacaatgaagtgttggaggagcccgccgtgctgtttcttcctccggggaagttggtcgacgagatggcgccggagggcgtggcgtcgatcacctgcggtggcggcagcattccgggagggctgttcgacgccaccgggacgggaatgaacaccaccgactggttcgccgccgacggaggtgactgcggaggagcttgctgctgcccgccggaaggtttaggcggttggccattattgccgccacttgattgcggcggcgatggcggcggcgatgagcgaggcggagatggttccgacgatgacgctgacgagccactcgatggcggtggctggttagaggacggagacggaggaggtgatggagttgagcctccggactggtgctgctgctgctgctgcggagggggcgaccagtttggcggcggcgaggagcggccgccgccgccgccaccgccaccatttccagatgactcggatggcggagacggtgcctccggcgaagacttggaacctccaccactcgaagaagaagaagaagaagaagaagaagactggggcggcgccggcggtggagacgaatgcgactcggaagagctccccgacggcggaggcgggctaggcgaggacgagccttgtgacggcgaactcgagcctcctccggagtcggagtcggagctctgcgacgaaggaggtgtcgggctagacgacgacgacccattgctgctcgaattatcagactcttccggcggaggcgccttgttggaaccatttcctgacgacgacgacgacgacgacgagggcgagcttggcgagggggcttgatccgattccgatgacatgtttcctctcccgccagctgatcaaaatcgtatcaaacaatgcttctggtacgagaatcatcaacccacatttgctcccgatcaccatttctgctagcagcacatcccttcatccaccaccatctcccagacagctagcttttgcaatctatcaatggctcctcgatgatctggacccaaatcaatatctcaagcccaagaggtattcacctggctggcagcagagaaaactgcagagagaggtggtcaatgtcgttggatgagttgtcaggggggaggaggaagagaatgcgtgaaaaattgctgcttttggtcaggtgggcatggaaagaaacaagatttgctgtcgtggcctaagaataggggaccatagcgtcaaaaacagaagaaccgtttactaaaacatggttgcgagctcttgctatgtttagcagctcaggcatggcgattctgagcctcaagaattaggtaacagagggtgagttaatcgtttacattttggttcttctaatctttctctccttcggtatgtcaggttttatatatacctctgatccgcccgatctatctcttgctattcgaaaaactattgatagttttgtagatgcatctcttagggcttatatcgataaaaatcgtgatacaattgaagatgcttttaatactagacttgatgagttctttaagaaaactagcatggtggcccgtgcaaattgcgcggctagcatcattatattttctcatataatagcatatatattttctcattatattattcaaatatattaaaatgacaacataattttaaattttgcaataactttacaaaactactaatgtgtaaaattcatattatattttatatacgtgttagttattaattatttttaatatcaaattttagttatttgtaaattatatatattcactcgtctattaatatttctttttttgttcattccgaattttttgtaaattgtatttctatatagactctatgctcttcttccaatattatttatttttatttctgatttttcatattatattttatatacgtgttagttattaattatttttaatatcaaattttagttatttgtaaattatatatattcctatatggactctagactcgtcttttaatattttttaattccgaattttctgtaaattgtatttctatatagactctatgctcttcttccaatattttttatttttatttctgattttttattatttctaattgtatttctatgtggactctaaactcatctttcaatattctttaatttttaatttcagatttcagttacttctaaattgtattcctatatttgtattcctatactgaccttcaactcttcttcccatgtttttcttaatttataattttagttatttctaaattatatttttatacggactctaaactctacttttaattttattatgtttatttcaaattttagttagttttaaattcctatatggactccatactctacttctaatattccttattttttaattccaaatttctattttttttcttaattgcatttctatatggactctatactctacttctaatattccttatttttaattctgaatttctgttatttcctaattgtatttttatatggactctatactctacttctaatattccttatttttaattctgaatttcagttatttcctaattgtatttccttatggactctatactctactgctaatatttcttatttttaattctgaatttcagttattgcttaattatatttctatatggactctagtctcctcttctaatatttcttattttttaattctgaatttcagttatttcctaattgtatttctatatagactctagtctcctcttcaaatactccttattttttaattccgaatttcaactatttctaaattgtatttctatatggactctaatctcctctcctaatattccttattttttaattctgaatttcagctatttttaaattgtatttctatatggactttgctttttctttttctccgattaatgtgagaatttctagaccatgagagcgaacgtagaggctcatttttctattcctttaataatataatagattggctccaaaatagtcaattatcaataatctaatgctacttccagttttgctcccatacaacatgcctatagtaacatggatggatcaagggtatttacacaaccgattacacaggaataaactacacacagaacctagccaacggtcacaccgcgcatgacactggtcagactgttccctctgtgtcagccagaccgtgccctttgtcagctagactgtgcctcctgtggccggtctgaccgcttcactgactgccgatcagaccgggtccatggctagtcagactggcaccctggagctttctcaagatttttgtgccacgtctaatagtactgattttgattgttattcatctcccattaataatgttagtcatgttaattattccacatacacatgctatttgcaccaataattatgagacaatccaaaatcatagagtacatggattggcacgagacaagcattatggccagcagggggtttgctctcaagatcctgttgtgctcacacactttaggccattagatcaagatgataatgttggtgtgaaaacccaaatttagtcgttaacacataatcaattaagtcctgaagtttctcaagatacacatgaatgcaccataattagggaagcttgcataattgagccaaaaaaataaggctactcgaaggccttgtctttatttttttatatatattcccatatcctcgtgatttcaaggtgcttgaattcgtaaaatttagcggcaaggataatatgatcacatataaacacctaggcttttgcttggtttacttcattgcctgcaaattctatctacacttgggctcaactagagtgcaaatttcatgattatttttatactagtgaaaccaagctttatattatctaagttaacatcagttaaggaagaatatgatgaatctgttactgattattttaagaggtttagagatgctggaaaccaatgttctagtttgaaaccgatgttctagtttgaatataacttaaagaatattcaagctcctggttatctgaattggatccggaaaagtaagtgaactatgaaagttaaggtttttagatggttgcttctgattgacagattaaatgcccaagatatgctagatagaaagcattgtgcatctctgaacagtgatttaacttgtgttctatgttcttctggaactagagaaaccttcgtgcatcttttctttcagctctcagagttgggctcaatttggaatagtctgggatgtatctattgcttttgagcaaatgttgcttcaagcaaaacaaacttataggtcttcgcactttgttgaaaaaattctctatgtggcttggaacatttggaagcagagaaatgggcataaattatctttgatggtgtgattccatctgtttcttcttcttggagagctttctttaagattacctgtagaagatagaaattttctttcaaactggttaaacctgttgtaaatttattcttttgatcttttaataaatttatttactatgggggattcccctacagtgtttttttttccaaaaaaaatataacttaaagagatttggcccaccttgcatataatagactgcttgcattactaaaaaattatttttcctgacggccaaaataggttttcacaagcagcctacagcaccgctagagaccaaaggccagtgataatatagtactttcgctggcatttgccaactaccagcgtggatccactttcattggcggtgttcgtaaggtagccgctagcgaaaatgaatttgcaaaggcggctatgttgtataatccgccagtgataatcctaacccgcgctaaaaaaagacggagcgacgctgctccgtccgcctctgtcaaccgaaaattcacaaatccacaatttaaatccatcacatttaacgaatccattacagttaataaatccagaaatccatcacagttaacaaatccacaaatccacaaatcaacacaatttacatcacaatttacaacaataaatttatgttcacaggttttcaactggatcaatccacatctccattcaaactaatcggactaaccagattggatcgttgtcgccgtcgtcgagagacgaagatcgagcaccaccgccgcccgttaatcatatgttaatcatatgttgcatgaagctctggctcaggaaatccgagtggatgacaatagtttacgtcctagcttagatgataatgcaataacaagtatagctaaaccaagtgatgattcggattgtgttactagcttagacaataatgcaactaaaaatatagaacgaagttcggattgtattacaaatgaaaataatataatattatcacctaagaccgaaccatagatcggtcatgtgagcattggaaaagagagtctaaagcaacatcgcatacatctgaaaggccgtatcgtaaacatgtaagattcggttccatacccgtaaggattagatgtgcccaatttcacaaaattcataggtgagaatgctacaactacaatgcagtatattgaccgatttatacacaaaatagtccggaaatttagctaaatttatgggcgtgacaattggaacaacccagtaatcgctaggacaatttttccaatgtggaccactcctccagcaccagtgggatgcccctccatttggtgcacgccgctctttcttggctccatgttatcgtgatttcggccgaggatatgcggacatcacccaaaagctaggagagcttgatctctggactaatgagatgtagaacacgctggatcagcatgtccaggagacctacacatggcagtagcataccgatggcctattggcaaacatcagcgccaccatgaagcaaagtcacgctgacttgatggcctacttccactcgtagagattcaatccttatcatagactatgagcaagaagctagcttggggaagggcccaaggtaagttgtatattttatttctttgaattgcatcttaaaaaagataaaaatttgtaaaatataaaaaataccaaaaatatttgctttccatacgtggtaagactgctctagtgctcatggttgaaatgatgaatagttgccctgttttatttccctctaatgcttagttttacaacctagtcttcacctaagtttctgagtttgttggacaaaaaattttaccttgaacttgaaacttgtgggctgcatatgcatgatctaagtctaggttgttgtgtggatctgagatggtgaaatagagttgctatggtcttacttcggagtgatacttgacttctgaatgatttaagttttcaaaagaatgaaaatttataagtttctcaatgatgacaaattcctgccaaagccatatgatgattatatcgcaaaagcctttacacatataatgcttgctattgcattgagctttttcaaattattgtgacccttgtgagattctttacacatataatcatcatacgtgcacgtacccacaatatatgcatgacctcaacactagaggttagcaaaaacataccatgcacccaccatagttgctttacctccacactggaggttagcaacatctcatcgaacaaataaaatgctccattacatcagccaaaaatatctcactttatatatgcaaaagagatggctgtgataaaaacaacgagaaggcgatagagaatagaaaatattctcaagcactgtggaaaaaaaaagagtagttgcaaaagaagtgaatgctcatcaatgttcttgatctgcatgagaaaaaaatagttagaaaaaaatgtcatatctcaaagtaggaataaaatatagtcaatatatgacaaagagtaccacataccactttctaccatatagccacacactttgcacatcttgatcagattgtatgatttgttttctccttgatcctcttttcgattttgcaatatatgtgatgcaagagtattgcctaattattttccccaccttgagcttcacatataaaccttttagaggtaggatgaaaaagaggcaacacaatgtcttggtgaggaattatacacattaagcgatatgagaatgtcattggaggaactcttattttatttaggaaaaactacgaattacccccccccaactatcatggtcgaccgaattacccccctaaacccgaaaaccagacattcttcacccccaactaaaataaccccccccccccaaagcactgttttgagctgtttttgacttgagcttggacacatggcgccaacgtggcaatccagtcagcaaagaaaattaaaaaaaaactactggcgccacctatcatctctctcccctccccaatccctctgctctctctctttctcgctcgcttgggtggccgataacggaggcagagctcgggaggaagacggggtgcgacgctgcggcggggggaaggcagcggccgcagcagcagctgaggggcgagctccgcgccggtggaggaggcggaggcagagagaactcaggcagtcggcggtggaggcagggcgagctcgggtgactggcgtcgtcacggaggacattgccgtgcaggagacaagggtgggggacaagcacggcggccgttcacagtgctggcagggaaagtcgccgaggaagctcgaaacggcggcatgcttgtcgattccttcccgcgagatccgtcgtgggctgcgattcctccaccgacaaatacttgcgcggcatcggcgtttgtggctcgccggcgtcaagatggaactcatagaagatcaccgacgggaaggagaagatggagaacgacgagtggatgcgctccggcgctgacgaggccgtgcgcgtgactctgccgccgccgccactgccgcagcgcggcgagagcgactcccgcgcacgcgacaacagcacgccgacggcgcacacccccacgttgaagatgacgaaccaaactgcggtcgatcctagcattagccacaccggcagcggccaccaccgccaagtttgggcctccacgccactctcgaccagctcctcccagcgccgccgctgccgacgccgaggacgagggcaagggtgatgccgaggatgatgcgcagttgtgctgcatcgtgcaggcatccgacggaggtgcagccgaggtgccctccgccccctcgccgtccctctccatcgtcgctgccgtggcctccaccctgacggtcgcgcccagcccgctctccccgtcgccatccccactcctcgcgccaacgcctacctcaaccctcgcctcgcggccgccgccgccgtccaccgcccgcccctgcgcaccgccgttcgccgcccacccgtccgcgctgcgctgctgccatgcgcacatgcgtccgcgcgtttgagatagagagatagagattgggaagaggtagggaggagatatgacaagtgggtcccaccaactttttttaaagaatatgctaactagattgccacgcgtaagccacgtaggacaaaactgctctaggttaggttgaggagggtaattcgtccggtattgaaagttcagggtgtgcaatgtttggttttcgggttcagggggttaattcggtcgaccgcaatagttcggggggggggggtaattcgtactttttccttttatttataaaattcttgaaaacctctagaaataaagttaaacaaagagtaagtgattgtgctctatgattcgttctgtctctcaattacccaagatgaggagaagctaaaagccccaacgggagtaaggtaagaaaggtaaaagtacaattgccaatttgtttaatttctaggtagaaggatacgttgtaggcatggtactattgtggcataaaacatggtagcaactcctgatcaacaacctaaattttatctttacttgaggaggagcaaaagtttagcttgagggtgttgttaacggccgttaagtatcggttttgaccgttaactaccttagaacaaataaagggagaactaacatttcttacacgtatattagtactaaataatgtagttccacttgttcttggagaaatactatgtatgcaggggtatgctacaaattaaggagaaattgcaatggcatgcgaagaaacccactcccgacgaatcacgtgagagcacacggattaatgggca

SEQ ID NO: 13040 - DNA, 15620 bp, Oryza sativa
tcctctcatatccaccctccacgtggcgcttcatggttgcttcccgatgacgattgtgcgagttaccggccttcccgtcataagcaactataaaaggaaatcacttcttctctctcaaagcacacactcaaggagcaattctctcattccacatattgtagttaggcttaaagtaatctttggtcctcttgtcttctcggagattccggtatgtcttcagtactttactcttcttgtaagactatagttgcattaaaaaattatcttatttacttattagtgttcatagttgatatattagtttattaattttgtgttctacaaacaaattgtacttcatttaactgtttcacttgattatgctagtcgatctatgccatggtaacggtccaatactaatgggttgcactagctctaactcatgacattatttattagcataaacatggtgtttaggttagttaaattccattggatgcgggtataccccacggaaagtgagttaggcggcaggtgatgacaactctatccgtcctttgtattcctccacttctaggtatgacataagagtttgtaaaatgtcattaccatgttggcaggctagcagggagtggtctctcagttgtaccagggtgcgcagaactaagtcctagccttgtaagcatgtatttgttaagtgtaaactggatagtaatatagaagtacaaatgaaccttagatctctttagtccatcttcactgccaagtgtatcattattagagacgaatcttctgtgtcacactagcctactatttattattatcttaacccatgtttagatttttggtatattaattatagcatggttacgatttatgaatatataacccaactctgtataccgccgcattcccagcagaaaaacaaatatgtacccttgggatactcctagatgaaaggctatagcggtatctgtgcgcttgcggatttatctatgatcttaacaaataccaacactatatatataagaatagaattcaattaaggacaacaacggatgataggcttaagctagagaggattcatatggattaattaactgtacttaagttgaggtaaaactctatcgattgctttggacaccggctctcccatgatctgccaagttgagccggcctacctaattttctacgaagcacacaacaaacaaaggtaaccactaatctagacaccacgcctaagttatcaattactactctagtctcgcgtagaaacttcattctttatggagagtgctagtactagagtacttaatataatagtaagcgacaaacccacgacgatgagaatgtacctcacttacgtaagtcaattaagtacgaaaaggaaatctcgaacacttagtttattaaagaagtattcaccgaggtacaggagaggagagcacgccaataactccagcactcctccggaacctttctcactctctaccctttttctccacacaactaaaatgatgcctaatgtatgaaagtgagttgtactctattttgttgtgtgtttggaagtgaaattagctcatccttttatagcagcttaatggtcggttgtaggtcggtagttaagtcggtaaacactcacaaccaccatcgtcaaccaataggagatcgccacatgatcgaacgctgacagttaggggtgccaaccctgttttgtccgaaccaagcaaacaacctctagctaggacctctcttctatgtctgacaagtcggcccatatggcggtgcactatggattaggtcaatttcagtcgttttggactgtcatgtgggcccttccaatccttgtgctcccatatgattggtcgaaggtacatttaattcctgggtgagtgctagaactaatatgatagatgtgctcgggctcctgggaaagaggccacttgacatacttggtgtagtgccccaagggtattccctatcgctttttcataattttctctctccaaaatcggatggaaacaataaaaaagagaggcgatgttcatcggcaaatatctatttttttttgatagtgtcttcccttaaaacttgatttttgcgaagtcttccggctaaaaccatgaaattagagtgccttgtaacaaatttaatttgcctaaatacaaaaaagatcgaatggagatagcattaaacttgctccatacgaatcatattagttggaccgtaactcatagaaaaagttgcaagttggttgacctatcaaccctcttatgttgacccgtaaaccctgttatgcattaaggattaagtacccggcagatcgtcactactcacgaatgcacaaatttccggtacgtaggatgggatgagttggtcagaaacgggctcaccacgtcgcccaacctgccgcgatcgagccattggccggcgatgcacgcgctttgacacagccgcccgccgccccccggcccgcccccgctctttaataaaaaccggccgccccctgtcaaaggtgtcaaagtgtcaagtgcatcagagctaagctagcggtcacccagtcagctcaccccgagacgcaccaggggatctatcggatcatggcaggtgggagatcgggatcgcgggagttgccggagacgccgacgtgggcggtggccgtcgtctgcgccgtcctcgtgctcgtctccgtcgccatggagcacggcctccacaacctcagccatgtacccgcgcgcgcacgcggtgtgctcatctctcgagttaatttggttgttgttgttgttgtgttcttgtgacatctcaattaacatccgatcctggtcgatcgatcgccctgtggtggcgctactgcttgcattgcagtggttccgtaggcggcagaagaaggccatgggcgacgccctcgacaagatcaaagcaggtcaccctcagcctcagctcaccctcagctagctcttactccctccatccctaaatgtttgacgccgttgacttttttaaatatgtttgaccgttcgtcttattcaaaaaatttaagtaattattaattctttttctaccatttgattcattgctaaatatactattatgtatacatatagttttacatatttcaccaaagtttttaaataagacgaatggtcaaacatgtttaaaacagtcaatggcatcaaacatttagggaagaagggaatattatattgctgctcccctctagccactttgctgcctccctcgtcattttttcaagtattttacgcaagactgggtcctccaaatcaaacgtcacaaataagccgtttatagtttcctttcgctttttaaggggggactacttgtatttaatcatggaggaaactaccagtcggatgtccgattacttaaaaaaaattcgggtgactaatttttttggttgatcatcggtgaaatattaggttatatatgttaaaaaaaatcagccacaaacaatgaaatattttgtgaaacacatattagacacgttgaaacgtatcattgttacgtataaaacatctaatgttaacagattaaaacatatgtttttctttcatcagaatataatcatgcgatatattattgtaaagatataattacaacgaatacaacggtgtgatcggattatatatatatattagtagtttaagagaaaaatcattttgaagattactagatacatacacgtatagatggatgaagtggagagagattagagataagtagttatatgaattttgtgaaacacacttaagacatatgttcaaacatactgctattatgtatgaaatattgagttttaacggtttaaaacacatattcttttaattagaatgtaataatgtgatatcttgttgtaaaatttaattacatctaatataacggtgtgattagattgtatgttggataacatgcccatcggttggcttattcagggaataagccaaacggtatatttgcaaacgaaaaataatttgtaaataaaacttttatgtatgtgttcttaacgatctagcagcaaaggctgaaaaataaacttcgatgaaaaatctcaaaatcaactcttaaaattcaaattttggcttataagtatagttcctaactagtttagaagaaaaaatatttaaagcggggaagaggaaaaggaataaactaatagctaaattattgcatgcatgtagcgatttgaggacgaccgagttgttttgtctggatcagccgaccgagacagagcaatcttctttaatcataaatgaccagaaaaaccataccagttcatcacaatggaccgagtcagagtcattacatatttttcattgttgcgcacaggattcaccatgttcttatgggaaatatttttaactctcaaatggttatgattttgaactctcatttttgagagagaattaacaagcgagcgagcaatcaggccaaaaaggagaaagaaaaattatttttgttaatttgtttttttaaggtagggtggaggagtcattacatgatttttttttatattccctcgttgattatatgctgttcaaatggttatgatttttttaaaaaataacaacaatacaaattagtatgtgatagatcatttcacgagcatgtaggattaaatttaacttctgtaaattacaaaacaaacaagtttaactgttaatatacattaaatttgttttttttcaacttaggaattgaattttatgtatatatttgtaaaatgatatattaatttatttttttaaaaaaataattatttagatggcacacaaactagaaaaccaccgcagttctcatatttcttgtcctatctgcacttgcagagctgatgctgctgggcttcatatccctgcttctcaccgtggcacaggcgcccatctccaagatctgcatccccaagtcggctgccaacatcttgttgccgtgcaaggcaggccaagatgccatcgaagaagaagcagcaagtgatcgccggtccttggccggcgccggcggcggggactactgctcgaaattcgatgtgagaataacaccagctgccggcaagcacaacctcgatgcaataactaatttaactataattgatttttcttgggttttctgcagggcaaggtggcgctgatgtcggcaaagagcatgcaccagctgcacattttcatcttcgtgctcgccgtgttccatgttacctactgcgtcatcaccatgggtttagggcgcctcaaagtgagtttgtcgttctgtccctcatgcacatgttttctctagttctagcaagattgtcagtccttcaaatggattgtttcgacaagaaacccaatttattaatttgccagtaaatatataataattggtctttcttggttttagatgaagaaatggaagaagtgggagtcacagaccaactcattggagtatcagttcgcaatcggtagtgaattaagaatctccctaactatttcatttcagaacctttatgataatgtcttgaaagaggaggagcaaatcagctgaaaaatatgatcgatccatgcagatccttcacgattcaggttcacgcatcagacgtcgttcgtgaagcggcatctgggatcattctcaagcacccctgggctcagatggatcgtgagttatcaatctccgaatacatgcttgttttttattcttgcaactggcctagctgttccaattcaatccatattttttgaaaaaaaaaatattcatgccgtgtttgttgttaggtagcattcttcaggcagttctttgggtccgtcaccaaggtgactacctgaccatgcggcaaggcttcatcaatgtatatactaatcaaacctgaccaattcaacattgatgatgcaaacagagaccaggtttttttttcgagtgtgcattgagtaatggttttagcttcttctcttttgcaggcgcatttgtcgcagaatagcaagttcgacttccacaaatacatcaagaggtctttggaggacgacttcaaagttgtcgttggcatcaggtccgtcctcgctttattaattataggactcttatattcaacattttttttataaagaaacatatttagtctccagttgtgtatgtgtatgtggatcttgacacatttggctggttttgcagcctccctctgtggttcgtcggaatccttgtactcttcctcgatatccacggtaatccttgtcctatttcattctgttttttactctcaaaaccttgttctgaattggtcttataatcaccatcgattttttttcaactttttccccgcgtgtaggtcttggcacacttatttggatctcttttgttcctctcatcgtaagagcgaaatttccctgtccaaagaaacagttaacataattaattatgctttaatttatcatgaaaattaatatgatcatataactaatgaacaaacattcatgtgaatgccaccgttgtctcagatcgtcttgttagttgggaccaagctagagatggtgatcatgcagatggcccaagagatacaggacagggccactgtgatccagggagcacctgtggttgaaccaagcaacaagtacttctggttcaaccgccctgactgggtcttgttcttcatacacctgacactcttccatgtacatgtttaaaacctaaaccttgctgctcaactacaaatagtactttatctttcacaattaacacctaattaactaacatagcatccatccatttgtggctactgatcgatgggacgacggatcgatgatcaccagaacgcatttcagatggcgcatttcgtatggactatggtgtgtatgctacttgcttagttgttgccattatcagttcttaagcaaattaagtgtgatgcatgcactgactaatgagacaaaaaatgacacagcttgttcatcgatctggttgttttgtgtgtgacaggcaacacctggtctgaagaaatgcttccatgaaaatatttggctgagcatcgtggaagtcattgtggggatctctcttcaggtgctatgcagctacatcaccttcccgctctacgcgctcgtcacacaggtgaacaagccattcacaaattctattagcagtttcttaattgacgacgctgttaatttttagacacacgttttgaccatttgtcttattaaaaatatttatgtaattatcatttgagttgttttatcactaaaagtactttttaaataatttatattttgcatttgtacaattcttttaataagataatggtcaaacaagtgtccaaaagttaacagcatcatctattaagaaaaggagggggtttttttttggaattttgcaaaatttgttcaaaatcagtccaaaaccttttttttgtttcgaaatttcagtttcactaccagtccccataaaatgtcttttctttatttccacaatattgaacccatgagatgccctttgtgttggtatgtgttttggccatcacttgcagatgggatcgaacatgaagaagacaatcttcgaggagcaaacgatgaaggcgctgatgaactggaggaagaaggcgatggagaagaagaaggtccgggacgcggacgcgttcctggcgcagatgagcgtcgacttcgcgacgccggcgtcgagccggtccgcgtcgccggtgcacctgctgcaggatcacagggcgaggtcggacgacccgccgagcccaatcacggtggcctcaccaccggcaccggaggaggacatatacccggtgccggcggcggctgcgtctcgccagctgctagacgacccgccggacaggaggtggatggcatcctcgtcggccgacatcgccgattctgatttttccttcagcgcacaacggtgacgggggcgatcggtttctgtattgatgctgtaccaaacataggagtttaatatatatataattgttacggtaaaatctaattattgtgcgcgcacttatattagtcttatagcgcgactggttcgtgattagacaaggtgatgcatgctgtttagttataaaggatatcagcgcagctaaaaaaaacttactccctacgtttttaatagatgacgtcgttgatttttaacatcattcgtcttatttaaaaaaatttatgcaaatgtataaaacataaatcatgcttaaaatacttttagtgataaaacaacttacaacaaaataaattatagttacctaattttttttaataaatcgaatggacacaaaaagtcaaatatgtcatatattaaaaaggaggtagtatatcttttaaactaggtattattttttaatccaattacaccgttatatttattacaattaaatttttaaaacaagattttacacgattatatttcgatgaaaaatgtatgttgtaaatattacttttatcatatatgtaaattaattttagattaaattaaattactccaaagatatttatcaatttatgaaagtaaaccaataaagtctaaaagtaattgaagatgaagccaaagaagggtgattcaatgatgcagattaattagggaaaccgtatgtacagaaatagatgaaaatgaaagacttacctcctgattctgaggtgtggggatataaattaagagaaaagctataaaacggtataccgttaggacagtacaaattatgcacggcatcaaaccgtccaacccagcgtcgcaaatgaaccacccatctctcctcccgcatgggtcccacgagccccacggattaactctttgcgcatgcactactagtacagtactagtagtactccgtactatactactgcctgccatatactattgcatgcactagtagtataggaggagtacatgcactactagtctactattgtcacgatcaaaaaatgactactcctgccttgatgatgctatttgcatcaaatcgaagttaaagttgccaatgaccatgagcaagagaaaatgacttgattctctattgctatatgtgatcctatgtgacctgatgataaacggtcttgtttcaaggtaaaatacgtgagtatatgagtcgtatctaggtatcatgtctggtacctacatgtatcacgaggtaccagacatgatacccaggtttcatgtatgatacttataagtatcatgtctggtatctacatgtatcacgactgatacctagatatcatgtatgatacttataagtatcagacttcgtaactacatgtatcatgatcggtacctaggtatcatgtctagtacatataagtatcagatctggtatctacatctatcatgtctggtacttacatgtatcacgactgatacctgggtataatatacgatacttataagtatcagacttggtaactacatgtatcacgaccgatacctaggtattatgtctagtacatataagtatcagacccggtacctacaggtatcaacataatacatatatgtatcatgcttagtaccacaaataccagagataataggtatcatacgtgataccttggtatcagactgggtatatgttaaaactgagacccacatataccagctgatatgtgcttggtttgctacccacatgtatcatgatagatactttacgatactttcgaggtactattatagataatcatattttgacatgtaaaaaatagtatcataatataagatactgaggtaccagcccaaccactgagtatagctataataacaataacatgtcatatagctaagcacgcaattatagaggagtttgtagttatgtgtgaccaaaaggataggcattcatataatctatgggtgcatgagtgaggagcacttgtcatgtcatgcatggcagatgcgcagagtagtaattagctagtgtatttgtgtatgtgaattgcttccaaaaaaaatatacagtatccacgaccagcactagcacatgcacgcaagctggtgcgtgcccgccatgtgcattagggttgaggtgtccgactaatgattatatcgttctaacggtataccgtgggttagcaagcctctaaattaatggggcatttgtaaatttgccaccgtttttttcaattttgcaaagatgccactcgaataacagttctagtggtatttttgcaattttctagtggcagtcttgcaataacgattgaaagcagtggtaaatttacaattgcacctaaattaatttgtgcttcagtttgtcctgctgcatatgaaccatgtttgaaaaacatcctgtgcatggagatatgattgcatacatatatgaggagaaaaacactactaggttaaaaaagaactgaatgctaagaaaatactactaaggttcagttgtatcatcagactctgcatagatagtatcatcttaaccatcgatcattatgaatgaaaaaaatgagagagctcaattactgatgcatacctgcaatagggccataaggcacttagatgatcagctatgcgcagtttgcacggagatgctagttaaacttacccatatgagaagctcactcaacctagcataataaactgtctagttgggcgtctcaacatgaacaacatgagcgtaataaactgtctagtagctttttccaaagtaaaactggtagatagtgcatcaaaacttgctatgacctaaataatatgatttcataattatgacctaagtaatatgattcgataattatgacctaagtaatatgatttcataattgctctcatgtacataccacattagcttgattaataggtagcaaaatttcaaaaactgacaaaaaaaacaagacaaatatgacacaccgacaaaatacaaaacataacatttatggttcatatatcatgaaggtgcacatataatagattaacaggtgcatacatacataaagttcacctataatatatttagcgcacacaaatgacaaggtcataccatggatcaacgtgtccacatatggtttagcacacagccaacaggtccatagtcctacagatgatagttgcatacatggccccgttcgaatctttcaaactgctaaaattctggattaaagtgtcacgcttttcaaactgctaaacggtgtgtttcgtgtgaaaactttttatatgaaagttgttctaaaatatcagattaatccatttttcaagtttgtaataattaaaacttaattaatcacatgttattaccacctcattttacgtgaaacacttaatcttcatcttcatcttcgggagattcaaacaccatcatagagatacatacataggaaaaaatccatattgccccatcaatgtagcagcaagctacatgtttcattttggccacacgccagctgccctttccgtcagcatcattgccattttcatcagcgctcttagctagctcaccttgaaaggccacaatggcatcattaacgatttcctccatgctaaccaatatattaatttcacgaaatagaaattctgaatctaccaaacttctcagtgaagcatcactagttagcacaaggtattgttcggtactatcaggatatattatgctagctttctaatgggttccctattaatagtgttcttcaatctcattaataatactatggcttgaattttctctttgataagtacgattcatgtccccgaaaaaaaaagagaagtaccattcatggtaaaatacaccagttgtctctatgaatttccaaatttaaggtcatatattgtatatttcacatacttttacttaattatactcatgtaaccgaagcatactttcacttaattatacaagttcaatacttttcttttgcaatacttaagaatatattaaatattaatgctaaaagagtaaaggtagtactcgaccagtaccaaacttctcagtgaagcatcacgagttagcacaaggtattgtccggtactatcaggatatattatgctagctttctaatgggtttcctattaatagtgttcttcaatctcattaatagtactgtggcttgaattttctctttgacaagtacgattcatatccccgaaaaaaaaaagagagaagtactattcatggtaaaatacaccagttgtctctatgaattttcaaatttaaggccacatattatacatttcacatactttcacttaattatactcatgtaaccgaagcatactttcacttaattatacaagttcaatacttttcttttgcaatacttaagaatatattaaatattaatgctaaaagagtaaaggtagtactcgaccagtaaatgttgtataacaaaacggctttgctagaattgtctcgccactttttctgcctcattacagtcagttcttgttcggtcagattttttccaagattagtgctgcttcgtgtgagtagctttcgcacgtactgttgcgcaacaactacaagccattatatatttatataaatttacaccatagttacacccccacttagttatataattagtatgtaattttaggacttgcatatgtaattttaggacttgcattgtagatgcactaaaatcacatatgtaatttatggacttataatgtaaatacatgtcgactattttttttataaaaaatatgacgccgtaaatatagttactccctgtaaaaaaaatcacgacaggacatgacatgccgcaactatcaaaaacaaagcaagctttgctagcaagcgtattgaattactgaactagttctacctccacaattgcaaacaatccttttttttttttacttttgctagttatatgcccgcacattgtaatggatcagacgcatattgatataactaggaaaatactcgtgcgttgcaacgggtgaaagttattttaatattttaatcttgttattgttacacagtttagttaagttgaaattcactgtaggaattcgcttggatatatattattctaaaaaatcatgagcggtaattaggagtttgcttgctagttttttaaaaatgatttcttatacgactccttctgtattttcaaaagcgaacgaactttaaaacccgactcaaatacaaatctaccaaagtactggtaaaaatattttaatttttataatagtagatattaggggtagactaaaagctcgcatgttaataggccaagctgatataattagagagatgatggttactttttcatgcatacacattgcacgagtggagaactctgcatttaagatggtagagatatacttcttttgccatgactgattttgattgcaatacttgtatgttcgttctttgaccattatatatatgcactctgctactggtttaagacccatttgaatagtaaggatgaaaaaacagaggaatagaaaaatcacataattctaaaaggaatacaattataaaatagaggattgtgaaacacaaaaaaaaaaacacaggaataacacaggaataaccgtttgattggaccacaggaaaaacacgggaatcagatgagagagatagacccagagaaaattttccaaaaagttaaacctcttactaactttccaaatatacatatgattacccattccataggatttttaaagaattggatagaattcaatcatttgtttcaaagaccttcataggatatttttttccccataggattgaaatcctccaaaattcctacatttttccaacaaatcaagggggcccttaggaaagatgatttggtattttctagtaccaagcttttaactttggtatagattgaaatatcctgtacaaatgaaaataactataatttcaccttgctaaaataattacaaattacaaagatacaccaggcctgacttcgaacaaaatacaaataattttgctaaccaaattcaaaattggggaactgattttacagcgggggttacaagtgcattgtgcatatcattgttgtcgggtatcctctcttcgtaacctttcatcttttttgggcaatgcattgatctgctcctcgagctgtaatgtagagaatacatccaatatttagacaaaataacacggtgttcatgattccaaatctaaattgaagtttaaaaatagatttacctgagtgtttttgagctttaatctctgaacttcctcagcaagttcggtgacactggaaatatttcataaacttcagtcaagtattcataaatatgcaaaaagttactcctacaagaaatattttatacctttgctgcaagttggcgatgtacgactgcagttccttctctctgaaatgcactccagatggctgcacatatatccgcacttattatactaactctgaataaacacataggaggaaacctcatgtttgtgcaacattaaaatgaacctaaaattgaaattactaccacacggcatggttatctctgagctgcttaactatctaaagtttacacctgaagaccaaatgacagtataacccacagttcgtgatacacacctgagatgaaccagttgtacttgcatcagcagcatctgtcagaaacatgccccattaaaaccataacatcagtatactaatgaaattatctctttaaagtctaacaaaagtaattttatcatacataccagatatttcctcaattgaagaaatcagtctacttatcacttcctgtcaaaacgaagaattgtgaaaattctgaacaattcttgccaagtgaaataacaagtgtgtgaataccttttgcatagtattttgctgtatcatgaattgtagtgttggaagaattgtcgatggatggacagttgatcgtgttactccgattggtaaatttgagcacctactgctgcttgcggatgaagctacctaagacatttgtaattgtcaaactaatgtgaaaaaaatatttgcactttactaattaagcctgacaaaaatattgatatcagaatagcattggtgataaatccttttgaggattaccatgcagggactgtgagaaataaatttgaaggaacagcaataaataacatgaatcagaaaacagaatcccatttctgcatcttttcttttgcagtcagagagcaggcaaaacatgcttgtctctttgcaagtcaactagcaaactgatcaaataatatttcagcagccattgctatatagcagctgaaaatcatgaaacaaacaaaagtttcaagaaaatatttgtgtcctcttgccctccacttcaaaagtcttaaacattgccaatcactacaggtatcaattaaatgatattcgaatatgttttgacataatataaattgtagcagttaaaggcatgcttagcataaatataaataattaaaaatcaaagtcctgaactgcaacatactgtgcttaattaatactccctccgtcctataaaaaacgaacctagtaccgaatgtgacacgtatgtccatattcatagtactaggatgtgtcagattcgtagtactaggatgtcacatttggtactaggttttttatgggacggagggagtattgatcaaaatagtcaatgcatatgacgtccctccatgttagtttcatgtgactgctcaattaacaaaccagtaccttttgagcaatactatctgatgtaacctgaaaacgcccccttcgctggataacttttccttcggattgctcctcaggttcaac

SEQ ID NO: 13041 - DNA, 685 bp, Oryza sativa
atttgttagggtatcgggaggtagtaatgggcttaggcttgcacagtgctgtcagcccaacttcgctattggcgtggatggtctgtgttccctagggagttaagcatatacctttgccctgctatttatagctctccccaggatagcccaatgccggtgcaatcggcttttaagcagctatatcactatgggccattgcggccatgcatcatacaaaggtgctcgtcagaatagtgtaattctaattttagtgacctttttagatggatgagcaggctgggtttcgaggatatggttaatggtacttggctattctctcagcatgagatatgctaattataatagtgacataggtcacagcataggctaatttgacgggtcggttgttattctttatacacgagttgacagatcctataacagtttagtaggcggtttctagtcatcaatgttgacctatagtatctttggagttctatttcactcggatctctttatgccttcttgggagtattatgcagtaaagcaatgtccatgttatagttatatctaggtccgcataagtttaaggatataatccggagagtgaaagggagataagctcactcgcatgaaggtgttatgatcatcagatatatgcatagtaggtattaaacaactctcatagttgggggggacgcgttat

SEQ ID NO: 13042 - DNA, 2443 bp, Oryza sativa
ttctgccagctttttattggaccacgtggtgcagtaattttttcgatgtgggaggaacatacgtgctcttgatccgtctggatagatctgtacgtcttgatccgtctggatagatccgtacgtcacgctgctgaaaaagggaaaaaggaagaagcaatacgggttcacacacaggctggcatctagctgggccttagattgcttgggccttgctggctggtgaatggtggtcaacacgtaggagtaagggtgcaagcgggcaggcccacgaacccacttatagtataaataagcgggttatccggcgtattatggattacctgcttatttgtactataagtgggttcgtgggcatgcccgcttggtaggagtaggcagataaagaagaaaagagaagtagaaaaaataaaataaagaggtacaaatagttttctgaaattatgagtatgatatactacaggttaagctgtagattgaagcaagtacggtaactacacagacatcctgtatgtctataaaatacgcctaaaaacaaaaaatagaaaaattaaatgtcttcgatcgaacttcttaagcctcggaaatctttttcagaacttatattccactaatactacaaatttggaaggtttatttgcaaaatttttgtgtcttatgaattcgctgcagttttgagaaaacatatctttgtttctccctaatggcatataatcatttgccaaagttaaacacacatccataactcaacaaaattattcacaaatataaattactatgctactttgatccatctcaacattgcaaaaatatttaaaatacattataaggtcttgtggaaattaaactttttctatattatgtacgggctataaataaccggcacgcctaaaggtgcgctgattttctaagacattaagaattaggtcaatatttattgattatataccatcaacctttgctgtattgcatgatcagtgtgtggatgggctttgcgctttggctattgttatttatggttaagtgctaaaatatcctttgtttgaccaaataaccaagttgctaggtttatgcactctacatctactgtggatagaagtaagtgtctgaaaaagtttgatctttgtttttgtagctttatttgattagccagctttaccattttgttattatcaggatacgtttcataatgtcattctagtttctgttgcttcctatctttggttgtgataagcattcaggccccgtttggctaatgggaaagggaaatcatttcccacccactaaaagacatctttaaatcctaaccattcattctccctcttccatttaatcctaaccctttattcatttcccaatcccaatctcaccccagggttaagatatcttattttccctgcatcagatactcaaattaaagcattatttttagtgggtaaccatgtttttcagaaccactcgctctgatgacaatttgttactgctatccacgctcatttttcatatcaagttcagaaactgaaacttccgccccatatagcctgctgccttttccactctattgattatttaatgtattatacaaaacaacctaatcgttgagggatctaattagtctgatgtgttttgcaccctcttgaagtatggtgaatgactgctaatttttgtgacacaagaaatgggaaaatacatgctaagtggactagtttaggagtctgggcggctgggcctgatgaaagttctgtgcgtctcctttgcagaacttagaatctattccgcgagaacactatattttcaaacggagtattaattttggtacaagggctggctaacaatgcagggagagggagcacgtgcatcagtatacacagatgaatgtgcctctgattttagctttcttgctataagttgccctcctgttgtaaattgggcataagtaaattttttctattttgttttgcaaaactattatagtaagcttaagcaccccaatccctttcctgatgcagtgttgatggttttgcttgcaggggcgagggacattgtttggagaagaggtgcgccgcggcaatgaagctagcctattccgttctattcacctatcaatgacgagaagaaatgttggattttttcccccttccttaattgtggcatggatttactattgctggttttggggtcctctggtggtgtagagaattttctatgggggccctttttttggtgacatggacatagactggtggtgaaaaaaaagaaaggatggtggtggggatgttatacattttaagtactatatgttacttgtcatatatacatatctgggagatctgcaagctctcctctgatggttggcgttggcgagcttaacaaccagtgcacgatgagcgtcctcttttttaatagcgatcggatcgcgtacgtgctctcttagaagcatcaactt

SEQ ID NO: 13043 - DNA, 2172 bp, Oryza sativa
ttacatgtttctaattttaaagaatgaatcaatgttaaatggattataatgtgtttagtatttaatttcaaaatatgaacttgtataaagaaattaaaaatgacagtggattatttagatgatgaatgataatggatttgaatttatgtttcacttgtaagttactttgatttaactaaaaaggcaatttattttaaaagaggtagaacgtattttatttataaaagatctgtcattatctttttagctgaactaatttttcgatgtgctataatttcttttatgaacatgtaattttaacgttgctactcctttcatcccataaaaaactaatctaatactggatgtgacatatctagtactataaatctggacatacctttgtctagattcattgtactataatgtgtcacatctagttttagattcgtttttttttggacggagagagtactagctagtgattgtggggctggctggcccaagcattggggcgcacaaataaatagcgccatggtgcgagagagagaacgacaagggtatatctatactttctatatagttggtacccactaaattattagaagctaaagcttaacatgcaagcatgccacatcatcacccactagcaattactattctagcctattttaatcccatgcaagcatgatacatcatctacaatattatattatagagatcaacaagtatatgtcaaatcatcttcctcacattattttctcaacatttcaactatcatcatttctacaatatttaacatatatttatccgtgaatcccgcagcaaagcgcggggtatcacctagttatacaaaaatcaaacccgatcgagtctcgctttctcctcgcgtccgatgtttctccgtctccagtcatatatatttgaagggaaggggccgaacaactcttccttggtttttgtctttagtttttttttctccgtagatattcggaatttatttgcgaagttagggatgccacgtgctcctggcctaacgggcagctttagaaaagtattctatatatttcatattacttaaaaaactgcccatgcctggcaacgatgagagctattttaatcctattattgttactagaaaaatgcccatgcgttgcaacggacgaagtctattttaatcttattattcttatatgatttagttaagatgaaattcactgtgagagttcgcttggatatatatatatttttagaaaatcataagctgcagttaggagtccaatcgtcttaagttagcatgcgagtttttttaaagagatttcttatatgatttcttctgtattaccaaaagtgaacaatcttaaaaaccgactcaaaaacggatatgtatttccaaaagcaaacgaacttaaaaaccaactcatacacggatgacgtaccaaaataccggcaaaaacatcttcaatgtttataatactagagataagtcgttgtttttttcataatcaagtttatagggtttaatatttcaaccaaaataaatatattatcatatatatatatatatatatatatatatatatatatatatatatatatatatatatatatatatatttaatgctaggtttaataaaattaattctataaactcgagtcataatacaatttgaataattagtagcattctttaacaagacggggtgtagcacatatggtagagcgctcgcttcgcatgcgaggtgcacggggttcgattcccggcacctccatttgtttctggtttctatataattttttgttttgcttctatacaatttatgatttaaggtcatgtactcaatcacaccccccccccccccccccaaaacaaaaaaaggatgttttatttggagaaccgaaaaagaaataggagctcccggcgaggatcgaactcgcgacctttcgcttacgaagcgaacgcactaccactatgctacggaagcggttgttgccggtttgccgctaactttttactacaacttaaattttgtattaagtatattacgggaactgcctgtgctgtgcttgtgctgttgtgcacgcggttgtgccctttgcctgcaaacattaactgttcttgtgcatggattgcttttatatgaatataattaattggacttatttgtaaaatactttctctgtttcacaatg

SEQ ID NO: 13044 - DNA, 26236 bp, Oryza sativa
aatgtaagtcattttagcatttcccacatttatatttttttatttttttattcaacatcaatatatgaataaaaaaatatgaatgtgggaaatgctaaaatgacttacattgtgaaacggggggagtacttgctatactttgatctagtagaagcacggacgacacgcattcattcaatagttggctcgcaaatttaatataatgttccacgcatggaccaatcgaattccgggcgaaaccggaagacgagatatgatatgtatatgacacaaatcatcaacatagataatatatcgttgaattgttcgtctcattgctattgataattgatacacacttgcatacacacaagagaaaactgaggaacagatcatcggtacgtagtatattcgcgatggacaaatcgatatatatatatataggatagagccgtaggaggcatatttagattgagaagaaagaataattagttgacggtgaccttgccgaccatcccagctccggcgtgcggctcgcagtagaagccgtatgtgccggggacggtgagcgtgacggagaaggtctcgccgggggcgttgaggtactcctcctgcgatatcttggacacgtcgacgccgctcggaaccgcgtcctcgtcgaacaccacgttgtgagggaagccggcgttgttcttgaacgtgatggtctcgccggacttgacggtgaagtcgttcggctcgaacaccagcacgccgccattggcgccgagaagcacctcctgcgccatggcgccgcccgcgagcatggcgctggcggccacggccactgcggccgcgccggctgccttgccgagcgaggcgcgcacgaccagcgaagatctcatcctcctccgcccgggagcggagggggccatggaagggatggtgacggcggcagaggaaagagcggccatggtagctagtgtattgtatttcttcttggtctgcgtctgcgtctgcgtctgcgtagtactcctatggttcagcagcagcggcgccggtgtagtggttgctataaaccaatccaatgatctgagctcgggttgggattgagaggttgggtggccagcgtcgtcgcgcgccatcttatcgacctcgtggccgcagcccattggctcacccggattaggtgggcccacccccacactgccctagcttagcttcccccatcgattcgtgatgcccacccagctcagcagctgctttctgggccggaatgaaaacgtgggccttttcttctcgctcaaatccacccatctttcctattagaagagtaaaaaaggaaaaagtacacctaaggtccctcaacttgttatcgggatacgaaaacgtcctcgaaccgcaaaaccagatatatgggtcccttaactatacaaaaccagtcactcgaggtccttcggtgattttgactatggttttagtctacgtggcggctgagtcagcgtgggacccacgtgggccccacatgtcaggatgccacgtcagtcggcctctcccccccctcttctcttcctcggttcctcctctctctctctgccaattgagcgcgagcggcgaggcttgcaggcgagcagatggttgaggactcggcgagctcgaaccggtgcacgacgtggaaggggtccgggtgaccgacgagggcacggccaacggctacgacaccgacagcccgccggcagagaggagatcggcgaccagcgccgccgccgctcgcttcctccacaagccggccaccaccgcgccgtggacggcagccatcgtcgacctcgccgcccttatggccctccacgccgacgcacaaagggctcgccacggaggatgagcggcgtggagctccaaacgcgtcgccagcggaaggcgagtgcggcggtgcgagtcccgtccttgacggggatgcgggcgacgaggaggtcgtcggggaacgtgctaacgcggtcctcgccgtcgtagccctcggcggcggaaattgtggcgccgttgccggaggcgggatggctgggaaccaccggaggcggccttggacgttgcgaggaccacgtcgagcccctcgtgcgccggcttgtagggacctatgtgtggcgaggtcgacgttggccgccgcccacggcgcggtggtggccggcgcgtggaggaagcggggcggagcccgagccatcaggctcgcagtcgcggaggatggccagcgcgccggtcgacgggctcgagcgccggtcgacgggctcgagcaccggtctctagtggtgaggccctccagggtgggcgccggtcggtgatgacaacttccagtgcggtgtccaacagcgaagagcccctctgcctccacgctcgcccacgccgtcgcctttagcttccgattctgggtcggtgccggcctcccctcccgcgtcgcagctgccgtcgatgctgccgcctctctgtcaccgcactcgcccgccgacgccgcctcgccttgccgccgccctccccttctcccgtgtctctgccgccgcgtcaccgccgccgcatcgccggccagcctgcccagtccagagagaggagtgagagggagaagaaggaaaggagaggaagggagaggccggctgacgtggcatcatgacatgtgggcccacatgggtcccacgctgactcagccgccacgtagactaaaaccggggttaaaaccaccaaatgacctcgggtgaccggttttgtatagttaagggaccccatatatctggttttgctgttcgagaatgtttttgtatcccgatgacaagttgagggacctttggtgtactttttccgagtaaaaataacttcaatttacatagtttggctcgtatccttaaacacaataccaaatataaagcatttctcattttttaaaccaatgcaaacgaggttatggtttggatgattggttttggctgagtggtgcttacatgggtagtttgactagtcctcgtcccacatggcactagaagcaagattaaaaaaaataaaaatatgtgagctacatatgttagccaaataagaagataaaaaacagtgggacccacttcctccacctcagcctctctcatctctatctcctcgactcttccgggtcggcgtgcatccctccctttctcccctctccttcccaattgagggcaacgagcaacgggggaggagctacgcggtggcggtcgacaggaaagggcggccaacaaagagttcgacgacggttagccatggacgcgatggcgatgactccccgcttctcaatggccgacgatagtggtggcgagcctaggtcttatcctcaagcgacggtggcgcctctctttcttcccctcttttgcaggcttgggtcaccagcgatgctcctcaatgactcaattatcttgttacgtgagcagcgcgacgacggcgacgactgctcgtgatcttgcgccaatgacgagcagactggtgtgcctcgacggcgagctccctgtctctaagttgcatcgttgcctcctctcatctgactctagcaacaactacaacattgccaccgtagatatcaccgcagacctcgcccgccttcgctcgcacaactcctgcctcgccaccggcccgcccgtctgcccctgcaacgtcccatgcctcattgtatgcactgacaacccgctgctcgttgtcgccgcgctctcttggctcgacgacgacgtatgcactctctcgacgctcttcctgttcctccccgcacatgcccacctccatgctcatgaagctatgctaggacaacgaggatgcacgcaccgatgacccgccggtttacaccttcgtcagggataggaaagaagatgttcaactgatatgtggatcccacatgttttttattttttttaatgttttcttctgttgtcacatcagtgcgaactaggtccaaaactgcttcgtgatcttgttttcattggggatacgttatatctgataatgtagtttaaggacgtgattcaaacttgacgtcaaaattaagaacctaaggtgaacttatttctagtagagtagagttctccagttccccgttgcacgcagcatctttggttggcaaccttattcatgcgagcgagctcttgagaatggatggatcgacatgataaagacaatggaggaaaagatagatgcactagtgatataacaacaaccacactagcaataagcacatcatggctagctaatgaactcttgcaacttctttatatgaaccagttacctgcagtactttccaaagaacatatgtagtagtatatatgaggctcccaagcttaagctaagcgaccatttatttacattagtcaggtagtgtgattcagagatttccacacaccaaccaacaaaagcagagagccggccatcacaaagagagccggccactgccacccccaccctagtcgcacaacagagctagtccatttctgaatatgaggtgcatgctgctgttctcgtgtctccaacgaaggtacattattctcattgctatttctagactccactctcaacagcctctgctttagattagttccacggggctgattagcatgtaccaacatctcttctgcacgtgggaaattgaaggagatcagctacatcgtcagagagaaaaaaataactcagccacaacagccctgcaaacaacattggctccagtagtctgtttcacaaatgttccacacgatcccatcctctaaactataccgcataagagacgaagacctactgttcgtggacaaaatcccatactttcacattataagacgttttgggttttgaataggttcatgcataggtcgatgtatgtgttacatatatatgttcaaattcatatgaatagtagtgaatctagaagagcgatggagaggccaaaacatcctataatgtggaacggagggagtactatatattttttcaatatatagaaaactcaagttcttacacttagcattaatgacatctcaagccaatattgacctttttcaaattagctaattgtacttgagatctaggggcgaatgcatgtcatacccttgctagcttggtaaatacaccactaatatttattaacgatgactaccactttacactagcaagaaagaaaaagtccaggacccttcatgaggtatatgtaggaagatataaatttctttttgccaggtggaagatataaatttcaatgtctcaagttctaattacgaatttaacaaagattgcttaccatgaaaggagaagccttggagcttgtccataacttccactgaatgatccacttgaataggggtatcctctttgcactgaatatgcattggttctccatcctgatcaagaccattttaatcaaaactatactactatgagtaaatagacttacaataaactgtagtagtaccataatctgggaggctgcatcgtcattttcctcgctgtggttattagatgaacttccagtgttacaacatgatccagcttcatcttcactcctgacactttccttcttgttattagatgaattgcgagtgttacagcatgatccagcttcatattcactctgcaaatgtgaggatacaggttgagagactgatgccctctcaacagagcatacaaggcggatccttcttgcagcagttccttgttgtggatcaacgagatcttgagctgtcaagtgcttcattgaaggtgcctgttcctgaccttgttctttcaaggcatctgaaaatgtcatgccactcctgcccggttctacgatagtatcgaaccaatgctggggataaggggtccacaatccagcccaacagaaggctccactcttttgtgactccatgtgaggattgaatgcggagtgtagttgatcttggttgcacaagggggagccctcggctactccactgtagaccatgctgctactctgggctcttgcttcaagattagcatcacttgtttctgtttgtggtgcattgattgaagaagaacagcaagtagcatctgtgttgtctgcacgctttgtttagaacaggaaatagaagggaagaaaatgttctcatgagattagtcaaaatgtgtaagagtaaattctagaatattctaacctgaattagaagcatctgatatgaatcattcttcctccaactatccatgagtaatgtgttattgtttggattgttggacgacgcggtaggattagactctacgtttccagtggggtgcttatccattttggtgtaatttggactaaacaacaaactttgcaggtcctgctcagacaaggtactgccaaaatgcgctgaaagatcttgctcacccagattgccgacaaaagggtgatcgctgtaagggcgaattggagaggtgatattagggaatccattgtatctttgctcaggctctaggtctggaagttgagataacacgtccagaaaagcatcgtcctaagttttacacacacacaaaagaaaaaaaagaaaagaaatttattatcatataaatgccatggggaccagtaatgcaggagaattaataagaaactcacatgggctacagtttgctctttgtcatggacagatgtactagcatcttgtatttcagtcagttggctgaaaccagatgatggtaaggtctgatgatccttcattattgaggcgagggccggttggacagcaggtgtgccattttggggattgccttgagaagacgtggacaattgttggtccaaattggaggccggggtatgggtatcatcttgttcgtgcttgttaaacaggcgatacagaacgaagctaccctgacaaattaaagcaaatagacacatttgatttgctcagctatttatatttagagtatggagtagacagtatatatttggtcgtgcttacgtttttgcctgattggaagtgaggctcagtggtgcggtactcgtgcatgatccaggcggtgcggaggccccgcggagctctgccgcggtggaagacgagggtcttcttgatgccgatgagggggccggcggggcgggagcggatgaggcggtccttgccggtggccttccagtagccggcggcggtggagcggttggagcggtggccgccgggatacttgcggtcgcggggggcgaagaagaaccactcggggtcgtcggacttgataacggacatggccgggagatcccagggctcgcaggtggagaggtccacgtccgggatgaggaggaggtcagggtggctccgcccagcgatctttcccttcagatagtgcctcaccagctcctcgtccgtcggccggaaacggaaccccaccggcagaaccgccgcggcggcgaccgccggcgtcatctccactttcccttgtttcatcgccacttttcccttctccgacctctctgtctttcactttttttttgagaaccactttatattctttcaaaacaaaaaaagtgtttcacttttatcttgccatacctaacaaccaatgttttaagggcagggttaatttattcatgccattacaagtatgttatttcagataaatatcattataatttgtttattcgtaattgtgtcactgaaatttttacaaaattagaaacatatcattgccgtcacattttcatcttcttcatttataactttaactacgaatatacattaactagttacgtgttttcttttataacttgtggtaactggatttttaacttctatgtttgtggaatgatctatttgtaaagtgagtataattcaattggttaggttcttgtggtggaaccagcccacccgagtctaagtcctagactaattgtttaggctaattattatttcagtagtagacgatgtacctgtcgatagcaagacgtcgtttgtgcgtttgtactatgtttctaaaagtattaatctattatgttgatttttttttacaatcaattaaattccatgcaaataataagtagatatattttttgagtttagaatccacttccgaaaatatgtggaagcctagaaggtgtgggttgcatgcatactttcaagcctctgagataatgggccgttttggtttgataaacaaacatgccctaccaatttattggcaaatgtaatagtttttgtgttagtttggatcgtggccaaatatttggtagtgcatctttcctatttattatattttataagtttcttcaatgtactatgagaatttggttttatattggtagcaatccaaatgtttgctaaataattttactctaccaataatttggtagtgcctaagtttacctagactttggcattaccaataaattggtaggttaaagaaccaaacaagcccaacataaattttatatacttcaaaattttgaaagaaaaaaatatgtggttcttttttaacctttttcgtaaccattaagataaatacaaatcacgagaagatattatgaatttagataattatatgttcagatttatagcttaaaatatactgtactacttatatttcaatacggaggtactacttctgtaagttagagcatcttcaacagcctcagagcatctttaacagcctctccattccactcttcaagccaaattttagccattttagcctaaaaaggtgctccaacagcctctccaactggatagctaagccatcctgctggccaaaacccctcctccactagccaaatttggccagccagaaatcactggccaaccgtgggccccacatagatccccccctccttcggctcggatggcgcaggcggccaagacctcgccgccgccgccaatgcaggcgccgtgcaccgccgcaagcaccaacttctgtaacaccctgaaaattcgaccaacaaaatcagaactctaaaattacggaccctcaaaaactttttaaatgaattgcatcatgacggttttattcgcctattttatttggatttgatttcggagtttgttgatcgcgaataaagaataattaattaggtataaaccctaaaaattaaactggcaaaataaataattaaaatataatttaaaacaaagattaggtgaggttggtaataaataaaaatattatcgcgaccatattagtatcaaataaattcaagtgcgatggaataagaattaactctaattaaattcaagaaagttatatataaaaataaaatatgggttaaattagggttaaatagagctagcactgttcattgcactctaggtgctcgacgaggttccctagccccgcccctccctgccgcgtgcgccgcgtcgcccgcccgtcgcgagccgctgccgcctgtcgcgcgtcgccgtcgccatcgccgcctaccgccgcgcgccgtcgccccgcgtctcgagccccgcgccaccgcgtcgccgtcccgtcgcctcgcgccgcgcgctcgccgcctcgcgccccgtgccgcgcgccgtcgccatcactgtcgccgtcaccgtagcgtcaccgtcgccgcttcgagtcccgtgccgccgctgccgtgccgcatcaccgctcccgctgccgcgccgcgcgcgtcgccgtcgtctcgagccccgctccgccgtcgccgtcgcgtcgcccgtcccgccgtcgcatcacccgtcccgtcgccgcgcgccgtcgccgtcgcccgtctcgagccccgcgccgccgcgtcgccgtcccatcgccgcgcgccgtcaccgtcgccgatgccccgcgccgtcgtcgtcgccacgtcgagccccacgccacccgtcgcgtcgcccgtcttgagccccgccccgccgcccgtcgcgtcgccgcccgtcgcgtcgccgccccgagccccacgctgccgttgcgtcgccgcccgtgcgccgccgtcgcgtcgccattaagccgccgcccctccccctctccttctctccctcttccctataaataccccaccccctctctatttccccccactccatttccctcctcctcccctcttccctctccaccgcgccgccgctctcgtgccactgcaccgccaccctcgtgccgccgcgccgcgccgtgtgccgctccgagcgtcgcctcgccttgcgccgccgtcgccgccgccgccgtcggtaagccgccgcccctcccctcgtccgccgccgtcgccgccccgggtagcatgagccgagagagagaggaagggagaagccgggagggagaagaaagagaaaagaaagaaaaggagggaggaaaaaggaaagaaagaaagaggagagaaaagaaagaagaggaaaagaaaagaaagaaaaggagggagaaaaggaaaagaaagaaaagaggagagaaaaagaaaaggaaaaataaatagaaattagagggagattaaggaagcttagaaaatttaaaataattagaatttaattataggttgattatagtcatagaattgtaaaatttaatataattatagattattttggtaatctctataagtaactcactcgcggtagataatcggatttagttactaagaattgtattcttcgttgaatgttaatagagacacttctaaatcacaaaatgacttaggattaaatgaccttaaaattggaatagcgtggtttttgcaaactttgtagtcaatatagaaagatcgattcgcgctcgacttttatttgagtttatttggattttatttgaattctaattgagttcaaatcatttcttcgcacgtaattttagagcccgagggagttgcggatccgagcgagggtcaagacccgcaggactacgagcgaggcaagtcatcactattccttgaacatgttgatcccaattgcgaaattgttttgtttacaaataaaattgcatgcaatgataaacatcctacttgtgattatgccatgccttgattattgtttaccccttattccttcgtaaccatgtttacgtatgagtccctagtcaactatgacaattgcttagaaatgctattctagaatcatgcatactcatatttatcaaaatgctttatacttgggaaattacctttgggaaggtaattgagatgcggcatgtggagacatgagcgccacattgccatgatattgatgacatgatttgtgaaaggagaaataaaactaaacaactgttttcgactggggcggacggaggatttgggtggtatctgaaaaaggctagtaccgtccccggtcaattaaggaccgagccatgaagttaagaatgaaacgacccccgtacaaccgcacttctcgtatgggtatagacctagcggagtagatagccgagcggaggcagtatccctgcatagatggttcacccctgagtgaggcaggtgcgctacggtgggacagccgttgaggtagggtcgagaggcgtgccctacatcagtgtcgccattggtaggactgccatgagtgtgtgagagagagaacttaacttgaactataatttaatatgtgtgtgagacttctctttcccgggagcgccagaactcctctcactgctagaaacatggacacctagagtgcatgaggatttaagttcatggagcgggtactgccaatgcgaggttatcaaaaagctttgtcgtgacgcgtctcatgtgttgggacgaggctcatgtgttgggtagtcgcggagtgcgggtaaagtgtacatccactgcagtgtgagtaaagcaaatctattcgaatagccgtgctcgcggttattgagcaccgggacgtgtattacacttggctagactctaaactcttaacttgtgtgggatgggatattgcatgatgacttttatgctggtggagccacttcctgagaggagggaaggtggacgtcctcagaaaatcatgacgactcaatggcgggaagccatccttgggatcacattggatgctggacagaaccgccgttgtttaatgtgaacactggtactaaaatttgatcagtctatgctaggttttaggcttgtgaaaagaattacaaaacttgctttacgcaaatgaaccatagccacaccttgaatactctctatcatgtgcattgttgctgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcaagtggcaatggcgtgccgctgccttatctacttctgcttttggaatgtattccggaccgctcggtccgatgatctaagactatgcctgcgggcttatgatgtaataattcgcactagactctcgtgtatgtgcatttggtatttcagctaagaactcatgtgtaccagactacttgatccagggaaatggtactgtttacacgattgattcctgttataaaaacgggagtccacaacttctgtgcgccgcttgcatctccaggatggtacggcgaagctcctcgaccgcgggcactgggccgctgccgccggcgaggagggggccgtggcggggttgttggggagccggcggcggagagcacgacgacgagcatcttgaacctacgccagagcgccaccatcgttgtcgaggtcgccagccgctgtcgtcgtcgtgtgcaccgtcgccagtcgtccccgaggttgccgttgctgtcatctggatccagcggcggccgacctccgttgcctccgtccccaccagtggcgacatggattcgggcggcgcggcgtggattcgtgcggcctccgccgccttgccgtcgccgccttgccattcgccgtcgccaccatccccatccactgtggtagccatcgtcgtttccatttgtcagtgttgaggaagaggaggggggagaaaatctagaggaagaggggaaaaaagattaaggagtgataatagaggctgacatataggtcccaatgttataggttcggaatagagattttagatggagaggctgttggagtccacaatgagtttgactgaccaaatcaattggctaactagctatatgggtatttgaagagtctattttaggtagtccgttggagatgctattagatagtgacaaatgttgatggtagtatcaatgaaggagaagcagacacgcatccatttctgactcagaggacgttcattttctgtgacacctgtcaggcaattaattacacaatcgtgcggtcggtacaggcctcacaagtctcgagccaaacacacacactatcaagtgctcggtatgtactggtaaagaagagcccacacgtgacatactacatgtaaataattttaccttttatcttcatttttcttctttcaaaattttgaattacatataattggtgtaagctccaaggcttgaaagtaggcatgcaatccaggcttccacagatttcggaagtgaattctaaacttgtttgtattttgagatgatacaaacttgtttgtatttctatttcctcttctcaatttctctaaacttgttctacgtatcttttcaatcttctcttttcaactcaaccatttttacttagtctattaataaaaaaattaaacatgtaaattgatgttgctagatttatcattaaccaaactatcataatatgcaactcttttatttaaaacatcttagttttatgaatattattgatcaaaatagcattttaaaaactatatcaaagtctaaaaatacttctattttaggatgaacggagtatttggacttatactatggcactacgtagcgaaagtgacggggggccgggggtgtgaattctggccgcacattgtacctacccaaaaagtacttgctgtattgaatcaacgacgatgtcgtcgttaatgcatcatcttaattgactgtagtagtactagtacgtaatgccattgcacgggaccatcttatctctttttttttctttaattatttgacacaatgcgattgaattggggtgcaggagtatatatataatagtagtggtaggtaacatgaacggtgtagattgagagaggagacgtactggtgctaataacaagaagtactcctacataaagagagagagagctagctaagggagtaccgaccgaaaaagcagaaacagcctgcctgaccccaaaaaaatggaggaaggcgtcgtcggtgggggcggcgctgccgttcttgttgccttgctcgtgaccgtggtgttggcggtgatgaggtcagctggaagcagaagcagcaagcgcggtcggctgcccccgagtcccatggcgctgcccatcatcggccacctccacctcatccggccgccaccccaccgcgccttcgaccgcatcctcgcccgccacgggcccctcgtctacctccgcctcgggccctccacgcactgcgtcgtgatcggctcggccgacgtggcgcgcgacttcctcaagttcgaggccagcatcccagagcggccgcccacggcggtgacgcgacagctggcgtacggcaaggccgggttcgcgttcgcgccctacggggcctactggcggttcgtgaagcggctgtgcatgtctgagctgctgggcccgcgcaccgtggagctgctccgccccgtccgtgccgcggagctggcggacgtgctgcgcgcggcgcagtcggcggcggagaggggcgagggcgtcgacatgagccacgagctggtccgcatggcgaacaacagcatcatgaggatggtggcgagcgctctgcctggcgagatggcggaggcggcgagggactgcgccaagcaggtggcggagctggtgggggcgttcaacgcggaggacttcgtggcggtgtgccggggctgggacctgcaggggatcgggcggaggaccaacgaggtgcacgccaggttcgacgcgctgctggagaccatcatcgaggccaaggaggaggcgcggaggcggagcctaaggctgggccggcgggagagtagcagcaaggacctgctggacatgctcatggacgcggcggaggacgacaccgcggaggtcaagctcaccagggacaacatcaaggccttcgtcctcgtcagtacactatatatcttcaaatactcctcctatatatatatatatatatatatatatatatatatatatatatatagatattcctccagctccagtgctccagtagaaaagaatgttaattatatatatatatatataatgcaggacatcttcaccgccgggtcggacacgacggccaccaccgtggagtggatgctggcggagctggttaaccacccggagtgcatggcgaagctgcggggcgagctggacgcggtggtgggcaggtcgcgtctggtgggagagcaggacgtggccaggctgccctacctgcaggcggtgctcaaggagacgttgcgcctccgcccccccgcggtgtttgcgcagcgcgtcactgtggagcccgtccaggtgcgcggctacaccatccccaccgacacccaggtcttcttcaacatcttctccattggccgcgacgccacctactgggaccaaccgctccacttccgccccgaccgcttccttcccgacggcgccggcgccaccgtcgaccccaagggccagcacccgcagctcatgcccttcgggagcggccgccgcgcctgccccggtatgggcctcgccatgcaggccgtcccggcgttcctggccgcgcttgtgcagtgctttgactgggcgccgccgccgtcgcagccgctgccgcttgacatggaggaggcggcggggctcgtgtccgcccgcaagcacccgctcctcctcctcccaacgccgcgcatccaaccgctcccttccttctactcctgagcatcctcgatcgtcgatacgtacacctgcgagcctgcgatcctgatccatccatttgtttttgttgacttgttactagcacctgctttgttttacgtacctcacatcaaataattcttattcaactcaaaattaagctacaagtaagctatctcattttgagtcaatgagtagaacaaaatatcatgggcaggggctcgaccttgtttggtcctactcatggccaccctgctcatatctacttggcttttagcaacccttatccttggagaagaaaattaaagagaggaggtgcaatgtaaaacaatttataaataaaactagaccaaagtgaaaaggtttggttcaaattgcatctaggtaaaaagatgtgacaatacacttggaccaaagtgaaaaggtttggtccaaattattacaattacaacatactaggtaaaaaaaacgtcctagctggttatttaactgcattgagagcatgtcagtcctaatgtttctatggaggaattggcatgtgcgaaatgaaatcatgcatggtaaagcagccccaccaatagaagtctcagggcccctttgaatcgcagggttgaaaaaatggagggataggaaaaacacaggattctgataggaattgaagtgtaaaacagaggattgcaaaacacaggaaaaacatagggaatggtcgtttgattggagcgcaggaaaaactaggaatctgatgagagagatagactcaaaggaaattttccaagaggttgaagctcttactaaatttcctccaaaatccacatgcaatgtatcattccataggaatttcgtaggatttggaaagcttcaatccattgaatcaaatggccaaataggaagatttcctataagatttgaatcctatgaaattcatataaaaatcctttgattcaaaggggccctcaaagaggttcattgtaagttatgttgatgcactgttccagatccgacaaaatcctggtgcagacctgtcaaaaggaaaatgtattgcaagtgctacaaagggtactgtagtcacttcggctttcaggattattcagccaagttgggaaagacatgtactgggatggatgaaacttaacatcgatggttcctttgattgcagcattggggggggggggggggtggtatcggtgcaatcctccgggatagcacggggaaaacaatttttgcgtcatgcaaaccacttgagcgctgtaatggggcgctagaatctgaacttcgtgcatgtgtgatggggctgactgcggcgattcaaaggacgcttcttccgattcttgttgaaacgggctgtatctcggtggttcaacacctgtactgcagagagaaggaccgtttagagttggcctgcatttaggggtgaaaacggagcggataatatccgatccgctccgccccgaatccgtccgaaatgaggatatggtatgggcttttagaaatccggcggatatggatgcggatgcggattatccgataggattttttcggataatccgaaattatcaacacatgtaaccactctatctattgcatataacataagttggttcatccaatggcctaattcatcaatgaacctagattttttagtctgaggctttcaccgtcttatgtcactcttgcgtagctgtatttttacattatggacattatgtattcatgttgtttagcacttaagcctataattattacgatgggtcgtttattgattattgtattatagttccttgcattgctaactcgatgttgtattgattgcatacacacatagcatccgataaatttattccgtttccgaaccgactccgcaccatttccgacatccgaaacaatccgctccgcatccgtacactatccacacccactccgaatccgtttaaaaaatatggtttaggatatgctatgaccgctatccgtccaaatccgctccgttttcactcctatctgcattgttcaggaggctaaggaccttcttctgagagatagggaggttgttatcaggaaagttagccgtagttagaatgccgttagtcatttcttagcaaacaaggctagggtggagttttgcactggtttttggttggaaggaaattgcaatcagatatcacagctagtctgtgagaacttctccaataagcaataaattttcttccccgcaaaagaaaaaagtgattctatgtcaaatttgtatatatgtaccaaaggaaaaaaataatcgacgcctgagagattcgaactctcgcggggaaaccccatgtacttagcaggcacacgccttaaccactcggccaaagcgtcggtgatgtgtaaggatacgatagaatacattttgaaataagattttactttcagtcgagtgcaagaagaggaaagcaagacgcgtcaaatctatcaatcagcttcagccaaagccgagagcccccccaaaagagagagaagcacgcatccgatcgccggcgacgaccgaatctgtgccgggcggcaggaaggagagcggcgatggcagcgatggcatccctgtaccggcgtgtccttccttcgccgccggctgtggagttcgcgtcggaggaggggaagcggctgttctcggaggccctggagagcgggaccttgcaaggcttcttcaacctcatctccgtgttccagacgcagtcggagccggccttctgcggcctcgcctccctctccgtcgtcctcaacgccctcgccatcgacccgggccgccaatggaagggcccctggaggtggttcgacgagtccatgcttgactgctgcgagcccctcgacaaggtgaaggcggagggcatcaccttcgccaaactcgcctgcctcgcgcactgcgccggtgccaatgtccgctccttccgcgccgaccagtccaccatccacgacttccgccaccatctcgtccgctctgcctcctcccaggactgccatctcatcgcatcctaccacaggaagcctttcaaacaggttgtttttgttaatccttctcttcttcatttcaaggtcttaataaccaaccaatttatcattgcattgcatttcagactggaaccggccatttctctccaatcggcggctaccatgccggccaagacatggcgcttatcctggatgtcgcccgcttcaaataccctcctcactgggttccactcccactgctttgggaagccatgaatacaactgatgacgcaactggtctactcagggggtctcttctctacccatcttcctcctctcctatctttcatactagaatgtactgcctcccttctcaaattgcacatgtctcacgccattactgtttttaactatacatcttttaaaaattataaccatatcatttttttcatgattaatctaccaatatcagcttcgcatataaagtcctattactgtttttagtaataatttaagattttgaggtcgtcatccttttaggaacagaggtagtagcttgagaattctcagcttctacctactactccctccgttccatattataagacgttttggcatctctcgtctagattcactaacattcatttgaatttagacacatatatgaagcacatatatagattcaggcatgaacctattcaaaaccctgtacgtcttataatgtgaaatagagtaagtagttcaatttctgaataatggagctactgattctctgatgagaatctgcactgttgggagctggagattctttgagctgccccaaacagggcctttggtttgttagcaacgattactcttgatgaagcaactggggcactgttatatcttattcaatcctttgtgcaattaaactcccatttctttaagaaagcctccttactgatggtacatttatgttttctttgctgcagtaattgttgtggttcgcaagtagttgtagggcctgttacttccttttttgggcagccatctaattgcagggagcattagttatgatctcttcagtttgattgcccagtttttctttctaattggcagagattgcttaaatctgatggggtgtcctttttttgggtggtttagcgcttaggtttagatgaatatacatgttacatcacttgcatttggtattgtggaaaatagcaacttgtagcattgaacttaaacatcacactaggtgtatcttccacgtgttgctgtggagatgacagtgcttttctaataaaactgcgtggaataatataattgctataggagggttaagtagaatatactttagaagctgtggcctgtgggaagaataacaaatttgctgttgttatatgacggaaaagtctatttggtttctcaacttgtcgtgtgatttgcctttgcgtctcgactctaatacctgatattacttgtccatcatatcaaaacgatgcaaatactgtccctatgcttgttttgcaagtgtttttttagtgaggtggcttcccacatcatcactttttttgccatgatatctgcctatcaattagacactcatgttagtcatgcctcttccgttataatagaaaaacaaatattaagaaaagagatgaaaatcatatgcatacatggataatccgaatggccccatcatgttccttattttttgctgacttattttccatgtacgcagtccagtaggatgccacatatgacaaaaccaccaatatacctaccagggacatcatttgcatggttttgatagttgagggatgagttttatctggtgctggatttgaggagtggaaattaaaccacattaagaattgagggtccaaatatgtaccttttccttatttattgggatacatggaattcttgtactgcacagtgactgcactgatatagacatgcacactaaagtactcacttcaatctgcacccatccactcgaagacgcagaccatattttcatccactgcccctttgcttcggccttctggaatctgatacaagtctctccaaaccgcacatcaattgcatccgtatacatcaggtcaccccctccggataactcccaaaccgtctccaaggcaccttcctgttactctgcttctggagattttggcttcacaggaatgaaatcatcttcaactacctgcctccctcagttcatcgtctacttcgtgcctgcatagaggatgcagggctctggactcagcggcttagacagatcaaccttcctattgccgccacctggaaatccctttttttcgggtgctctgcagttactgtatattgtgtttaaaactttgtacagtgttttcccttaaaaaaaaaaactataagcagctaaatgatacagctagcccacttgctgcttgaatgatgatgtggagaggtaggcttggcaaagttgccttgtaaacacaaattaattttcactgtaattatttgaaattataagtttagaacgtatgatgtaattatttgaaaccgttgcaagttgcaacacacaggtattaagctagtcaaaagaataatatacaattttaaaatagtcagcatataaaagtaagcatggtacaaaaatatgcaaatgctgttatttgatcttatcttataagtttacttaaaagagcaacttttagttcctgtgaaatgttcctaagaaaatcaaaagggcagatacatgtttctttgctgaactcatactgtgtaaaaaaacatcgacaatcacattgatatctgatattgtttatttattgctgatagcataagtgtattctgattaagatatttatattatttatagctgtagatatcatttagatccatcacagtaataatataaggactttaagttagtttttcttgccaaactaaaggatttatatgctgtgaaataaagtaaactacaaactacatattaaaacccatctaaaagaaaaacaacataatacctttaacatctcgtgggcagcaagcattgactcatttcatcagcaaatattttatacctgatctattgcatttccacttcagtagctcatctctcctttgttttgctattactttcagaatgtcctgaccaaatacatttcatgaacacaactaaaacaacatatctgtaaaaaaacagtacagaattgaaggaaataataggaaaatgagaattgaaaagtgcgaagaaaagcaatatgcaaggaaaaacaggattgttgtgattcactggactcaccagatgaaagagcatatgccattcattggtagacagagttagagggttggagaaacaatgttaggaagttttgcttgctccagtttcctcctccgtatctatccagttattcagactcaagtgcatgttggcattttgggagatccagacagcaataaaaacttgactttatggctttattgttattgggatcaggaacttccgaacttggcaatttagcttggtcacatgactcacatctaacaccatttcttccgcatccaacctccatactgtcaactccatacctgtttatgaggagacaacaactgtgaactgtctccgcggttcttcctttgtgcagcatatttttttgttcatttgtttcatccccatacatcaaatggttgtttacatcacagtgatccaatggttggtaaattatgattactagaaaagatgcccgtgcgttgcaacgggtggatgctatttcaatcttattattattatacggtttagctagggtgaaattcactgtgggagtccgatatttatctcaagttagtatgcaagtttttttttacaaaatttcttatacgactcttttcgtattttcgaaagcaaacgaacttaaaatccgactcaaacacggatatgtattccaaaagcaaacgaacttaaaaccgactcaaacacggatggcgtaccaaaataccggcaaaaacatcttcaatttttataatagtagagatgtggataccatgatatttacctttgctgcaaaacattataggggagaaattacatttgcgttatttcctatagatacaaaattgagtatcatttcagttttacactcaattgccaaactatctgtacttgtctttgcctttttattcatgccagtttaagatactgccatcttgatatttgaaggttcatgcttatctcaaggcacactgcagctccttcattgctctacacagtggtaaacatgccaatgcttggtatatcgaattcaagtgggtacattgatataatttcctttatatcattcctttagcttttgtgcagagttgcagagatgaaagctggaaaagcatggcgaagtattgcatggaagatgtacccgatcttcttaaggatgagagtgtagacaatgttccagcacttctgtcccgcttagtgaaatcccttcctgccaatgctggaaatttgatcaaatgggttattgaagttaggagacaagaggaaggaggatcaggattaagcaaagaggaggaagaaaggcttattttgaaggtcatcttcaaccttttcttttcaatctgggattctggatcagaattttctttttgtctcttttaacacaccttacactgtgtgcacttgcaggaaatgatactacagcaagtccgtgatactgagctttttagattagtccgtgaactgcaattcactaagcagccatgttgtagttgctcatattcaagtgatgatgattcctttacccggattgcagcctctgtgtgctgtcaaggggccgcattgctaacagggaatctttcatcaaaagatgggttctgctgcagagaaacttgcttcaaatgtgtacaagtggatggtgatgggcctaagactgtcgttacaggcacagcggtttcaggagtcaatgaacaaagtgttgatatgcttctaccgatatccacattggaaacaagcgtgtgcaattcaaattcaagcaacgaggttgtcaaatatccatctagaacagatattttaactgttctattgctggctttacatcctagcacatgggtgggcattaaagacgagaggctgaaagctgaattccagagtcttatttcaacagacattcttcatgatgatcttaaacgagaggtttgttgtattaatccaaacatcccttgctccctactccctagcaagatttgttttctagataaaataggatgtaaatcatgcctagttttgtgccaaacagatctactttaaaggaaccttgtcagacgaaattatcgtttccaccttccaccacaagataaaataagatgtaaatcacgtctagttttgtgccaaaagatcagttgtatagggcctactttaaaggaacttgactagacgaaattatcgtttccaccttccaccacaagacagaatagttaacccaatgtttaggggagacgagagtagtagtcactgatgagcataataaaagagaaaaggaggaaaaggaagcatatgctttacatacattaatgaagttaagtttatgagtattccttgaagaggtcatggggctctgcgatactaaagtttttacttctgagtacctttttgaatagaataacgttaacatataaatccaacatctagcaaaatgatctgggcgccgcattttattgcacatgtgtgaattgtaccttcacatgcaaaactgaaacaaacatttttctggagatgatattgaaacctttttcttttacttcagttaaggaagtatcgaatagaatgctgtttccaatcagatttgtccatgtttccctttttttctcccttgtggatgagcattcataccatgccggagttaaattcatatttccatgaaggaagataaattgttcatccacttctcttttcatcaaattatagatgtcaaaaacatttgttgcactagtttagaataacattttgtctgttgacacagatattgcatctaagacggcaactccattatgtgaggtcctgtaaagaggaggaatatggagatcctgtgccacaatcccattaacaatgatgcaaatcgcgcagttggttaccctggagatgcaaaaaaaaggggttagaggaggaactacatactccgtattacctttgtttcgagtgaggacttctcatttttgagacacctgacctgagacggatccgtgtagacatgttcatgttcatcacctgtggtcgtttctcttgttagtgacaactgacaactagcggggaggcacacgctaattgtgcggctggtgtccttgcaaaagtttctcataataacgcaatggcagatatattttcacactttattattaaataaaaatattgaaaagggcaattaaggagtaggataaactctaagagcaagtatgatacttcttccgttcctttatatttggcaccaagcatggtttatatttagacctggatcattcatcttctcttcaaaagttttctaaatgctcaaatagatgtcagattatcaaaatgtattacatattaagtactaaactttcatttatcataatctaatcaactcaaaattattagtggttaaagttgcaatagtatgagtcaacggtgacaaataaaaaggaggaaggctctaagcgctagtcccaagataggcttagattagataaagatgtggaggagaaaatagagaagttatcctgtacacaaacaaatttgaggaaatagagacaatgcgtgtattgctcattttgactagtgttaaacttgggatcagtgataagaaacataagttcacatatacaactaatttttttgagttttcgtcaaagcggtcacctagcagcacccatcaaatgcagcccagtctacctagtaccaatctgtatgactcatctttcttactttttcttcttcacaccacagtcgacagtatgacacgacaggacacacatatgcttttgtcttccttcttcccctccaactccaatgatccactccacccctcttccaaaaccctaacggcctaacccctcgatccaccacgcaacgcaggcaacttccctcgctcggtgagcaacggcctaacccctcgatccaccacgcaacgcaggcaacttccctcgctcggtgagcaatccttgttgtgttgtttatattatggattttctgtttgatgcataatttaaatgcgggggtcctaaccctaatattagggtttagggtttagggttcgataaactgtatgtgcagagcatgcttctgaacggcgtccgacagctaactgcatatgttgtccaccagcacgtcggatgttgcattggtttctggactccgagacctttgaaccagcattaatggtgacggtgtaatcggggtcggggaactgttccctggtgcattaatggtggggaactgtttcctggtgcattaatggtgacggtgtaatcggggtcgggaactgttccctggtgacaaatca

SEQ ID NO: 13045 - DNA, 47614 bp, Oryza sativa
tgtcgtgtaagtattgactattgtttcaatctggtcttatgcgagtttgatcgaattactaggctctttatatgtttgttttgtgttaagtgagacagactatgttggtttacacgaggatcaccaatcttaatctggaaatggtttcaatgaatgacatgtcaggctcgccagtgcttaaggcaacatgagttattgagttattggtagggatgaaaacggagcggatagtttccgtccgctccgaacaaaaacggataaggatacctttcagatcggataattgttggatagttcggatacggatacgaatacgaatatggtatcagggtttccgttggatacggataataattcggatatctggcgaacagtgctattcggatatccgcaggacccatgagacataccccatttctttctaactctataaccttcaatatacctttatagattttaatagtagtttaatctcttaacactagtccatactattaatattatttaaattttaaaaaatatttataaattatacctcattttatataaaatgagctaattatatatgttgatatttgtttctattagaagttgagttggttttcgtgttccgagaaaaaattgtttccgtattcgtgtccgatcatattcgattattattcgtattcgagataatccgaatttgtttccgtattcgagctatccgtattcgttttcgtatccggtaaaaaaaatatgaaaacgaatatggtatgagcattatccatccatatacgctccattttcatccctagttattggcatgttagtcgctggtggttattggcatgttagtcgctggtgacggggcgtacactactgcagctttgtacgatacagtgcttaagacataccacgggatccatctccgccacgaaataataagactcaaatagtcaaattttcacaacgttttgccaaattcacaatttattatgatgaatcattctttctcattttctttaggatatatccagcatcaccgatgtggagatgaatgcttgtgtcaatccaatgaccatggagcaagtcattgatgcactatcttgattccctacatcatcactgaccacgacgtctttagcaaccatcgttcgtgcagagagttcgtcttctatgtgctggcggtcgcttcctgcactagtgtggtctgtcatcatttggtcacgatttcgttaggaagtgttgaaccattatttgcttatgtagtggtcaatcccaaaattagaatccgtacgtatgtgcacgtccttctttttagctctctacgcacaaatgcagacatagggtttttagccttgggcatcctgtcacacaacaagtgtgtccatccaatcttatctgcattgtgattgctgcaaaagagaatatctaggtaaaccgttttacacagtgtgccctatttgcagaagctgagatccgaataacacgagggctacgccgacaccagcaccgcgtcgtggccgatgaagttgtaggagaaaaattgtatatttgggactccaaacgttgtgttttgtagatttgccattcctaacatcgacttgtaaaaataggtctccaaacatgtgacacttgatttgcatactattctatgtatttcttctcttttctaatcgctatacatgtatttggcaaccaaaaagacgtatctggcccttctcctccgtcgtgaccgttcacttgtgacgatgagaggatgccgaagagggagttccggaagccgaccatatgccgtggagtgctgtgcctggacgacgacggcgacgagccggcgctgtcatgctgcgggataggttacgcaccatctcacgcacgatatgtttccgaaacaaactctagaaatatttttgggtgcagcaaaactaaattgtaaaagaaatccgcatctgcgcaggcacgagaaccaattttgacggaccattcacgcgcatgtcttgtgcgcgcgtcccccggcccgtgcccaggcgaggtgaggcgagcgagcccacacgtgtgttcctctacttctttcttactcaagtggctagggagtactctcctagaactagtaatatgaaggttaacatgtgtgcttctcatgaggtaagcttttgtgattctctagaaataatcttcatatagaccttagcccacgtattaattctaacaatgcctgactagattttgcagcttagtatggcagcctcatattgaccttttatttaaacacattatgcgatatgttcgcaattaatttagtatttaaaggtgagacatttgtgtcaccatctgtaatttatgtaattgacagtcttacctactaacctcctctcaatttctacacacccgctggccggcgcgctgccggccacggctctatcttgtatgatctgccaccacactacttaaaaagtactcattgtgtcatttaattgagcaggtcgttgagcctgacataacccctcctttcctaggagtatgataagtgcaacggcatcttaaaagaactaagtcaatgcctcactgtcgatggcattgcacacttgctagtttcaaatgaacaaaagtgtctagtgttagactagacatatatgctactccctccgttccaaaatataaggcacattcatcttttatggaaagaccaagaagcatttaattgtgtatttacttgatacaaaccaaccaatgcatgctatatgtatttgcttttatttagtttttgccaatgcatgatgccctttgtcttattcaaaaaaaatgtaattatgaattattttgctagcatttgattcattattaaatatactttgagcataacatataattttctatatttcacaaaatttttgtgatcagaagcgatgacgggcctcgatcgtcctcacagccgatcgaccacgtggttcaggatatggagcccagcgataaactgtacgtgcggagtatgcttctgaacggtgtccaacaactaacagcccggcgataaactgtacgttgcactgcttaggattcctagactccgggaactttgaaccatcattcttcaatagagacggtgtaatcggggtcgggaactttgagccatcattcttcaatagagacagtgtaatcggggtcgggtacattaattcagaatatttatgctttcttcgttcgattgaattatcgggctttatgttctgtatatgtttgttttgtgtgaagtgagacagactacgttggtttacacaaggacgttaatatcaccaatcttaatctaaaaatggtctcaatgaagggcatgtcaggctcactagtactcaaaggcaacaagagttattggcatgttagtcgctagtgacggggcgtacactactgcagcttcttacatacactccttcaggaagacataccaagggatccatctccgccacgaaataataagactcaaatagtcaaattttcacaaagttttgccaaattcacaatttgtttttgctaacattatgatgaattattctttctcatttcagttagccatttgacgccatttagaagcatgttttgagtggagattatattaggtggtgggtagtagggttttacactgtttttgtataccagcagaaccagacatacaaaatgctttagttttgaaattagggcatttccctgcatgctttaggtggtgttaatttaaagtaggatgactattttgttgcccctctccctaattctaagtatattatagaacaaataagaacctaaagtatacttagagcctcttgtaatttagctctacatcttgtgtgagaatgaatgatgagaggggtatttataggtggaggtgccttggaggatagagtttcttccaagcatccaatgagcatcttcatcctcctagtgcaagtgtccattttatgaagttcttccaagcatccaatgagcatcttcatcctcctagtgccaagtgtgtattttatgacggttttcattcaaaaacctaaaccctaaaccctaattgttgccttagggtgtagggtatcagggttttagggtttagggtttagggttcagggttcaggatttagggtttagggttttgtcatgattatggataaggtatacctcctatcctacgacttatgaaatatgcggatatggcataccttcacatacgcggattgttcctgtgtacgccgtaggaatctgttacaaattatggaaaatatctctacgagtctagcgatttccaaagtcctgctcggaggggatagagtttctgttatatcgtacaagatccgatgtctccgagtcttggagatcaagatgatgcacgatataaaagggacccccggggaggggtgcaaggcatcaaatatcatcgccaacacactcgccatagcttacgaagccggagtacacggagctaagtcaccgggagatctcgtcgaatacatcgactacgatctcgtcgatcctcgttccaacgtaccccaataccctaatcatccggtctacgagtatcactcgtcgacaatggcgcgccgggtagtgggacttggtgctcaaggttccgctaatatgacttcaagccatctcgacaacagtaccaacaccggcatcaatcaaggagcttctacctcgacatcgctggtgtggactcaagtcggatctattatcttccagtctacaccgttacaccaatctcgactgacccagttactatcgggaatgagaacaacatggctacgacttcgagaaacgacgtcccgccaacagttcctcccacacaagtggagaacggaacatcaacggccccaacacctggaaggaatcctcaagcggctgagttatgtccttcgcgcagaaacccagagccgacaaggatgcctatccagaatctgagatcttggtgtctcgtccataagacatccaagcatactctggaagattgcctggtgatactccatgtgaaggccgaactctacgcctgctgggagcgtgggattcaacgcacttcaccaacgggcttcacctattgcccggtccataaatcaagatctcacgatctcacaagttgcaagatcttccttaggacattcaagccgccacgtcctcacatcaaacaaccacgaattcaatctcagtgcgttgccgaggaacgagacgtagcaatgactttagatcggttcgtgggttttgtcggtgtcaaccctaacgagccattcgtgctacaccttttggaagattacgagatgtaaacgtgatcaatgtcgctgagacaagtgcgtccgcagcagccagaacgcctgcccaacaactgtggaacctcgatgcgatattgagataaagcccctttgaccttgccctaaaccctgacgttgatcagcgggcaacgtgattacgagagactgtgaccaatctcaatagcgtgttcgcggacacagcgactgagcctccaccgcaagatccaccacgaggaaacggtgaaccagctaacgggaacgcagaagcggaaaaccctattggagaacgtcctccccgtgctcaatcgccacgggcagcccgagatccaactccaccgcgtcgtgagaatcgcgaccttcgcgaacatctggacgactggcggagggaaagacgagatcggaacgacactgatcgtcatcggcgtcgttctccctctcgacgagaagagaacaccgctcaccgttgacactgccaccgtctcccctcacgccaaggagggaacaatgatcgaggaggccgccctaacaaagatcgagatcggcaggcccgtagcgaccgccgagacaacaacgataacaaccatcgtgacgatggtgacaacaatcagcgagatcagggagccaatggtcaagttcagggcgacagcatcagtggcaaggcgacgacgatggacgggaacgcaattcccgatctcccgcatctagtcgagattgaagacgcgaccactgttcgagaagccgagctcccgacccgagcgatccctcgtcctcatcttcgtcgtcttcttcatcggacagacctcctcgacgacatcacaaccgcaggccacctttcgctccaggaggtgggtgcagagcgttcacgcccacattatgagatgtacgatggcccgaaaagtttcgaccaggagcgatcgagaaatatgacggaagtacagacctagaggaattcctgcaagtctactccacaattctctacgctactggcgcagatgacaacgtgctggcaaattacttaccagccgcgttgaaaggttctgctcgttcatggctggtccacgcgtccttgacatgtggggccacgtgggttctacgctgactcacccgccacgtagaacaaaatcggatcaaaatcactgaaggatgtaaagcgaacggttttgtaagttaagggatgttatatatctggttttgcggatgagggacgattttgtaattcgatgacaagttgtgggccctttgatgtactttttccaagtagaaaataaactagtaccataaggatatttatttttattgatttatatggtgggtcccgcaatatctccttctcgttcacctccctcttgtgttgttgaggtgcggtgcgacttgcgattgcgagtgagcggcatataccctacgaatcgaatcgaattccaagcccaccgccggcgatggccatcgccggcctgctactccgacctcctccgtgcgtcgccacgtgcactcctccttccccttccctttcctcacagtggaggaggcggaggctcaccctcgcccagccctactgcgcggtcggtctatccttcgtctccggccgccatctccgccgccgccgtcgtacgggcactctcctactactacaccacaaccaacaaacgattcattgattgattgattgtatgatactaagcgagccttcctgagtttattgtttggattcatttcttcccttcattcattgcgactcatagtatctagttgccttttaattgcactccttctttgtgttattatccgtcaaaagtattcatcatatcttagatgaaaatacccgtaatagcaactcttgtcacaagctctatacagtgcacaaattgggcggcattcaacattttgtcattgttcggcaaaatgcccaccatatgctcggcaaaatgcctgggatcatgtccctcgcatcacctggctgctcgccattctacactgtttagtttcatctcaattcaactctacccacttcttctttcgtttccataactaccattcctacgtgtctcggcagttcgatttcactaacctcatctacaaattttctcttggactggaattagacgtcaacacactaccatctttgtatgaaaaacaggaaagctaaagactaggaaaggaagagatcaggatttcttacccatctaatttgtcttcgccgatataactgcccatctaccttcctgctttacatagctggatgaaggatattccctttactatatttactatgcctgtattcatatcgtgctgttccataattctttgccaaattaggcatctcactgcgtttgtgtttctttgacttcttcaatgtagagagcaaaagaacaagtcgtggaactggtgtttacgcttctttatttggagttggagctcccgaagctctggttattggagtggttgctctgttagtctttggtctcaaaggactagcagaggtaaactctttcccagcaagcctagacatcatatttttgctgttgtccggcttcctattctagctaattcttcactaaaccctcagcattagtactccaaataaactgctcctgaagttattcagggggaagtcatacccaattaatttaaagcactcgtcttgaaatccacattagaaattcatgtatgtcagtaaaaaatcacaattgcaccttgatacatttgcagtgtttggacccctgggttgttgctggttagctccacttatctatttacatttccttcagtcctagactcatatcctgcttctcattcaacgctgttaaaaactaaggtggcattcaaacaagggtcttgacattttcctagtcttgagcaagcacacatttttttcccgtgatttgagcttaagacccgtgaatgtaatgttgtcttcccttgtttttttgttccttgaaacacaaaaggctcggatgataagcctgaggctgcaccttacaccagcgaagaactcatgaaagtaattgaagaacaactagctgcatctgcagctgctgcttggaatactcaagaacctcctccatcacagcaaaaaggttgtgacattttctttgtgccagttcttcaattaggtacacatgttcagtattcataagataaattgtgcagattgtcttatgttgtatgacattttccaactgtgtaaaattctggtttgtctttgccaagttctcaggactctatgctcctgtaagcatatagtagtcctagaacaaaatggaagcaacactgccagtggcttatgtgagcatgtgttgattgctggggtagttgttaaaggtcctagtgactgcacttgtttttgctctgaatttgtgtaaatcgtaagcctgtttcaggggacactcccttgtagtatcgtttttacttacgttgtatctgaaagtaatcgcttacgaatttctggtcaagctaattaacttgattctgctgtgtcatatttcagaagcagcagctacttctgaaagtaatgacggtgctatatcaagagggagtgatggtgctggtgctgcaatgagtgagcccaatcggaacatttctgagaagacggaaaccgagagatgaagcataacgatgtactactgtattaagaccgacgcaagaacacgctgtggaggttggaaagagcggattatgatttttaatttggggagctaggtatgcctgggtttgggtagggagtgatttgagaagtctgatcaggtgtgatgcatatgtgttgctttgctgtgtactagtactagatcgattgtagaatggacggacagactgacaggtgatcgtccctcccttcctccgacctctagttttgctatggatgatgttagaccctgtttatatgtgagtaaaagttttaagttactgtcacatcggatatttggactataaatattaaacgtagactattaataaaattcatccataatcttgaattaattcgcgagacgaatttattgagcctaattaatacatgattaggctatgtgatgctacagtaaacatgcgttaattatagattaactaggctttaaaaatttgtcacacgaattagcactcatttatataattagttttataagtagtctatgtttaatactccaaattcatccgatatgatagaatactccaaattcattcgatatgatagaggctaaagtttagtcactggatctaaacaccaccttaatttgtaggagtagctgtctgtctatgcccattgactatccctagtactactatgtgtttgatcagttgtcatctgcaatcacttgatgagcttgatttgtaaggtgaagaggatataagttaatgccaaaggagacgatgcaagtaatgaattgatggatgatgtgtctgattattggcactgcaggcatgtccagtataggtgttattatattttattattatcactatgatcacttttaacttaaactatcatcgtctcaaaatataagtattttttgacttcaacatagcctcgaagatactactttgagcaacaatatctatgaaagtaatagatagtaatatgttttaaatataaatagttacatactacgatagtttgtttaatgattaatctagtaacattaattttacattattgatcttttttattttttattaatagttaaaattaaaaatgtttgacttagactattctaaaaatgtttatattttgggacagagggtgtatgtatgtagacattcataataataataataataaaactttttatattctggtaaagagataatagtagattttattactgtatttgtttggaaatgtagctataaatttggacgtatgaattgaaaaggtagaaaggtacgctcccatccttggatgcaaaatgaaatgggagtgggagagggccaccgagcagctgagactcggtttggttgacctgaccaccggtcgtcgtcttgggttggcttggcttgctgtccgcccgcgttcacaaggagaggagaggaggttgaggttgatcttgagtgtgaggagaggcgagatcggaaaaaggggaaatcggcgttgcgatgccgaagcgggtggccgacgagatcgcggcgctcccggagccgcgtgggcccctgcgccgcccctgcgccgacctctcccgccgcgtccgcctcctcgccccgctgctcgaccacctccccgcctcctcctcctcctcctcgagtactcccctcgccgacgccctcggggccgcgcgagacctcctccgcaagacccgcgacggcagtaagatcgaccaggtctcttgtcaattctcctcctgctcttcctgctgctgatttcaattctcaaccatcaatctatatactatatactatatgatggatggatgcaggccatgcgaggggatgcgttcctggacgaatttgcaggcgtcaacaggcagattcacctcgccttggatgccttgccctacaacaccttccacatgccccaagaggtccaagagcaggtactcactatattatgcagcccccaactccttcctggacttggacttggaatggaatgtttgaatgtatgttttctcctcatcaggtcgcgctcgtccactcccagttccaacgagcctccacaaggacggatcccccggatacacagctttccatggatcttgcttgggctcttaccgacaacccttccgaccccgcccttctcaccaggatctctcacaagctgcagctgcacaccatggctgacatgaagaacgagtccatcgcccttcataacatggtcatttccactgccggagaacctgatggctgtgtcgaccaaatgtcttccctgctcaagaagctcaaagactgcgtcgtcactgaagatcatgccaacgatgccctcaccactaggtctgcctccattaagcataggtctcctatcatcccagacgagtttaggtgccccatatccctcgagctcatgcaggaccctgtcattgtgtccagcggccaggtacatgtttcttgtagtatattctttccaccacatacattttttcagtccaaaaaatttaaaaagcaattgtgtcttctttttttcagacatatgagcgatcctgcatccaaaagtggcttgattctggccacaagacctgccctaagacgcagcagccactctcgcatacttctctcaccccaaactttgtcctcaaaagcctcatctcacaatggtgcgaagctaatggtattgagcttcccaagaacaaacagaattcccgtgataagaaggcggcaaaaagttccgactatgaccatgctggtctagtctcgctgatgaacaggctcaggagtgggaaccaagatgagcagcgggcagctgcaggtgagatacgactgcttgccaagagaaatgtcaacaaccggatatgcatcgctgaggcaggagccatccccttgctggtcaatctgctctcctcttcagatccacgaacacaggaacatgcagtgacagcactcctgaacctctccattcatgagaacaacaaggcaagcatcgtggactctcatgctatccctaagatagtggaagtgctgaaaactgggagcatggaaaccagagagaatgcagcagccacactattcagcttatcagttgttgatgagaacaaggtaactattggcgccgctggtgcaatccctccactcatcaaccttctgtgcgatgggagcccaagaggcaagaaagatgctgcgacggcaatttttaacctgtgcatatatcagggaaacaaggtccgggcagtgaaagctggaatcgtcatccatctgatgaacttcttggtggatcctacagggggaatgattgacgaggcacttagtcttctgtcaattcttgcaggcaacccagaaggcaagattgtaattgcgcggtcagaaccaattcctccacttgttgaggttatcaaaacagggtctcctcgcaatagggagaacgctgcagccattctatggttgctctgttctgctgatactgagcagacattggctgcaaaggcagctggagtggaggatgcactcaaggagctgtcagaaactggaacagatcgtgcaaagaggaaagcttctagcatcctcgaactcatgcaccaagcaaatgaggcatgaagcagacaacattcatttgtttaaatctgatttgtggtcgtcttatagctgtagcccattgtacacatagacatataaacactaaattgtttctcaattatgttgaagtttgatatatatatgtaggcagattttttaaaagggaatatgccgtaaacgtataaagtgttgtataatttatattgtaacttgctaccatgtacttgataaaactggtaaaaaaatccatgtgtttcagtttgctggctattattgtttcagatctgacgcattcacatgcattttcatttgttggcatttgactgcttgttgagcaggattctttgaagggaaatggacactgaaagttgcttcttcctggggaagctctgtgctttgggcaatgcatttggtggcttcattctgaagtaagttcgatttcagaaaattgttaccacatttagttgttttttttcacagattagtactgcatgttagtatattggtttcttgaacccacaaaatgtgtctattatcaaattgtctgatttaagcaatgagcagcatttctttttcctttttatttaccaaaagcaacatttcttcacttgatgaaaacctaagacatagaagattaccattgcatctacttcactttgtgtttcttaagccttttgctaatgacatccttaacttgtgattattatttaatgaaatcaaacaaaatgaatggtgtcattgccatgtaactaaatctgttttgcaaccaaaagattcataacatgcttgggcacatgtaagttgtaacatactaaaactgctatgttggggcaacaagaagtggcccagttgtctatgattccaatttccaaaccacttctaaaaaatataaatttttggtgcaaaataaatactgacaaagaaacaaagaagacaagaaattgctgaaaattgttgcccgggtgcagcacgtggatcagcatggtgcataatttagttgtagctaatttcaagagatagtgctttgcggattaattacaaaaaaacacgttattggtatgttagtatgaccgtttacactcttactaggatgcagggaaaagaagtcataggaataaagagacagtaaaaggaaagatacatatgcctccatgaggaggacatataattatatatcatcactgcacttgtggtatgtgagaatacacagcacgttgagaccataactaggtgtcgagaaatgctattcattcgcatgatctggtcttttctcggactctatcaatgcagtcttactattcttatttaatctcttttgagaacatgagaggatctggtcgtttatcttgtggcacaaagagctgagtggctgggacagagtagagtgttgggcttcatgcattccacccatgtggggacaattgttgtcgtgctggttgctctgtaattcctgtcagttctagccgaacccatttacagtctaaaatggaagggggcacaatatagtagtagcagataaatgtaacagcacactacacagtataatgagctgggcttgctatggcatgacgtctggttaatggcactagtaaaaatgaactgcctgtgtcctctcaacttttgaatcgtgatgcatagaaaaagttcatcaggtcccattgcctcctattaacaaatagctccagctctctcctcaccacggtatgtcatgtcagtagtagtgcacaaacatgcagccgcaaccacatggccaacctaagcaacgagggcatgcgcatatcatttgcttgcttaatctttcttaactcatctgtcagattgtcacagccctcttgttggagtaataatcaatactacttgtggtgtgatgacacagctacgatctaatccttgtacttaaaacatataagcaagttgggttgaggaagatctaaacaccgggcagcctgcagattcagttgtgttcaactttgtcctttgaccacaactactagctagtgcgtgtacctaatcaagattcttgttacaagcagctagctagcaaaacatgtattgtgatattattctatatatgttcacatgtgatgtcccctgttggcttggtgcatttggtaaaacaaaactactctatattatgatagactatggatactccaataatccacaatctgttgctagggggggtgtcaacttgcattaacttgttaacaaaatacagattaaggtgggagcccggttggagaatcagtggccaagacgcatgcatgtgcatggcgcttaattagttgagttgtagcttgttgcttatggagcaggagtagtatacatggaggtactccagtataaaggaaggtgatgtgattaatttgcatcgatctgctgcaggggtgagccgcgagccagagccatcaggtatttgtcagcagcagccaaagaagctactcgatcagtagctatcttggggagctaagggaggtcatgggtcacattggcgaggctggcggcggcgctgttgtcatgggctgcaaggtgctgccgatgtggagggagagcggcggcatggtggatggcgcgaggaagacgatggtgcatggcaagaaagctgtcgctcgggtgaaggagctcctcaggcgggctgctcagcccaggtcccctcaccctcaccctcaggccactggcgccagcaggtggaaggtaaattcattcaccttttttaattccttcttaaatcttcctacttgtaaagaagaagaaggaagatgataagtatgtgttgcatggatggcagaaggttatgagcttccaggcgagggatagcagcaacagcaaagcaggcaacgacagcacgagcaagctgagtttcaagtgggacgcgggtagctgctcgtctgcatcatcgtcggctatgtattccccgctgtcagccgtgtccgcgccggcgaaggcgccgtcgagccagcagcagctgcggccttggtccactgtccctgatgatggcgagcagcggatggcgcagtggatcaccaccgattcagactgtatgtatatactcctatcatagcatctttcttctactagtgtaccatatatacacacaatatacatatgtgaagaaggatcgaagcaaaagtaacgatgattttggttcatctgcagttgtggtgctggagctgtgacctcaactaatcccgttccttgggatgatggagtggaggccaggcaagcaattaagctgcagatactcatggatggctctcactaatttactgactgactacattcacaagtttagaccgatggaggaggggaagacggaagcagcgaagacagtagtattatttatgaatctcaacggccaagagcagaggctgcagctaggttgctgctgatcaatccatatcatgaggaaacttgaatggattattaaaagtaataataacagaccggtttattactagcacaagaggagagtcatcgatgaaatactagtgcgatgtatagtatacgtttgtgtttcttttttctttgacacgtaggatgtgtttgtgttggttgtcctattggagtgagtgaatttagagtagcatacatgccatgccatgaatcgtttgatcctctctgtttatgttccacgtggatggaggtttgggcagggtactacacgattcattttaagcccgcccttctctgatctccgctcgaaatagtccaatttatttcccaagtgaaaaaaatagatatttcatctttagaaacccgcacttagttgagtactactccctcgtttcaaaataaaaaaaacatttccaaagtttaaattatatattaaaatataactactttatcatttactcccttaccttatcaatcaaaaatcacctcttgtctaatctcttcacatgctttctcattttaattaatgataactcatgaaaaactttagaaatgattatattattaaaacagagggagtactatgcaatcccaaccccacaattctatgtatcttcaagacccatactccaagggtatatggccgatgaaaatgaatgataggaggtggtgatctactctagctagttgtgataaacatgataagaaaaatttctaactttcttatctatgagtgtcgatgctataaattcaagtcaagatgtcgaaaatatcatcgtacagatatttttgtcccgctctttgtcatcactatcagctatgtgttatttggcacctattaggctcttaaagaaaccggtttttaccctagattccacttgtaccatcgcgagtcccctgaagccctaaaattccaatgttgtcgctacaaatcgtgtgcgcctacatgcgcattgtcaccaatgtcgctcagatacccctcctcccacccaagcggattaaccataacatagttgccttccgctagagccgtgttggataggctccttttcaaactaaaagcaaaaaaaaacgtaaagcataagttgtcggacattccaatattgggtcaaacactctgatatagctattgacttttacacactaaatcgcactctaatatagctatatcgaccactcaaacaacaacgcatatacatcaactaactataagcgttgcaactagcaatgcgtcaagaaagtaaagatggaaataaatcatcgagatttgtgcgatgatgtatttcccagagttcaaatacttgagggaattctattgatgcagcaatgggacttcatgatctttcaatgagagtagtataacttcgatttggggtgagaagtcgacattgacggttcgactacaaataccatgggggtgctgcgacttagcaactaatgccgtgccaggaacaaccttgaacctgaagcaatcgaagaacaagtaagaacatgttggcaggtaaacagttcacaacacttgccaaatgaaactgatacacaaagctagggtaagtatctgggcggtctagttgatatgcgagtacaatgaaatagttgaaactaaacttgcatctaaacaaaacccaagttgcaatggtggctgcaaagggtttatataggtggaggaatgataaggagagaaggtgggagaaaaccctagtctttatggacctctaatggctctattgaatataagccagaaacccaagtttctggtgcgaacactattttggttattctgagcagcttcgggtgaatatgatggtgagacaatacatatatgaaagtatacgacaagatcatttaacaagtactcatttgcccccattgtcctctggagtgaagagccatgacctcatattccttgacttcatacaaccatgcccctaatgctcctagtcttgttcgtgaatctggttgctctcccatattcgtaagaacaagtagaccataacaactagttagtagcatccaatttaaagaacttatatgaatagttaggaacaactttacttgatagttaatttcttaagattgagctctagccattcgtccttgctgtgcagtagacatgattgtttcgttgaaagggatgtcctcatcatttactctccgttgagtagctcataaagagtcagtttttttttcaacactagtagacacatctctccactaatataaatagtatgatagaaaaaatcaaaccacattccagccaagctagaaaaaacatatcttgtaccacaccccaaccatttttatttacttttcattttagcattgtcgatctcctgtcgcattcccagatttttttagagatgtctttcctttgctacttttaatcaatgcaaccatagtagtacaaggaattttaatgcttttcttttgggatctccctccatttgacatttttttttcaaaaatcaaacatccttagatttaaatatgtttataaaaaattgacatagcaatacgtaaacatcaaattagttcactaaatctaatatcggatatgtttttatactttgtttgtttcatggttagattttataaatttaattaaagtttgaaagattaattatattaaatcaaaacatgttataatataaaacgaataatcaggttacaacttaaccacatatattggattcggataatcaaattgcaactatactactgagtactacactagccaccgaaccttttttaggaggcatttaactatttgccactcgcagttatgtcatgtggcttctcatgtgtctatgatatataacgagattgctaattggcgcgcgcatgccctccacccgccacgtgtctatttttttagtgatttttttcatgcgtttttccttttttttcacgatttttttcttttatttttgctctttttctgattatttttttaattttcggcacacgtgttttcaaatattttgtgttaaaagtttttaaatcatgacttgaaaattttttaatttggatttgaatattttcaagtctcgagttgaaagttttcaaatatgtgttgaaagtttttgaaatttgagatgaaaagttgaaagttttcaaatttgaatttaaattttgaaaatttgacttcatatatatatatatatatatatatatatatatatttcaatttcttagttaaaaaaatctagtggaaaaaaaaatcttagctactactgttattatgtctaagataagactaatagattagtctaatctaactacctaaaaaagttgggatggctagaaggagctagccatccaatggaattaagataggaggagccacatatttccaacccttcatttaattcaggtgtcatttaatccaggtggaaggtgagtagttcaggaattgaaccttggctgcaacgttcacactgaacgcttgtaccaactgcgctagaagcgcatctctaatctaactatctatagtccaaaaaaaatatgtgccggtagcgcgtacgcgtccactagcaacccccaatacacaagatgtaatgtatctatgataagtgggtccagcgataaatttataattgccacttataatagtgtatgaaatagttaaatatctcccttacggatctcaataaaagtaaagaaaatagagttgagggaaaaaaaagaaaaagaaaaaaagagggcgacccaccgaaccgaacaagaaacaaaactagagaggaactctcccgtcgtcgtctccccctccggctccgtccgaccaatccgccccgcataaacccccgcgactgccggcgccgcatcccctccgctccggccggcccgaccagagagcactgcccactggccactggagtggactcgcgggaacatctgggcgccgccactgatcgatctcctctccgtccgtcctctacctggtaagccctagtttgtttgtttgtttgtttgtgttttcaaccctggcctcaattgacattggcgtcggcaggggcagggcagctaggtgatcgatgccaaggaagaaggccagctcgccctcgccgacctccaccgccagggagactagaagctcctccgctcgtggtcatgcatcaccaaccccaaccccaaccctcaggaggtccacccgagaaaccacatccagattttcttcttcttcttcgtcttccgcaaacaagcacgaaggctcccccgccaagcaaagtgccaacaacaacaccgcaaaacggaagatgaataatgctgccgcagatacctccaccaggccaatcaagaagaacaaaaagctaaacgcaaagtcctatttagcactcttctccacaccccaacaaaccgccaaatcccctcctgcccctggtaggaatttcatctctttctcttctttattaatcgaggaggaaattcccggctgtattctaactttggcaatgtagcccctcctctcctagtccaagtggatgacgacaatgcttccacggtgcctatgcaagacagtggcactcttctggagcatgaagaagctgacacacaagagcaaggttaccagtctggcttgcacaaagttcctgaggtggtactggaggagactgatgtctccaagaacaaagctgatgaacatgcttccacttctgaggtctcatccttcctaggccttaaacccctgagtaacatcataactagatatctgcttatttcagtattacgtgttctgtttgtttatacctgcaaaatctatacgacctctggagggagctactttggtttataataatatgaccaaacacagtatctgccagatgaggatacttactacacatgctcttttctgtttaccacctcagtccctttaattactatgtttcatggctcttagcagcaccctggttctttgaatattgtgttatgttagttccgtttgttttgagagatataagatttgcaactccattgtggtgcactctaggatttgccttatccgccattttgttggagtgacaaattcttgattgcccccatcctagtcattaatgatctttcaagttccatgtgtacaagggaattaaaagcgtaacatgtatttttctacagccacttattcctgttgatctgtgttcaaacgataatgcttctgaaagcagccatgggatggaagtcaaagagcaaaccgtgggatgttcaaagtaatccacttatcactgtgtgaatgctgattttcctatagagttgttaccacttaccatgatgacgctgagcatcaccctttcattttgcagcccatgttttgtaacagatttgccaaataggccttgctccattgttcatcatgaagaggtgatactaaaacaagtctttcagcatctttttctgtcactagcattgtatttcttctgtcttcgttttggtggaacaggaccaacatttttagttaatgttcttttgatgcttctctaggccaagaagacaattgaagcaggtgatcccagagagatcaaaggggcttctacttcaaatcaggctttagtaacccattctgatggaacagattacaacgagtacctgtgtgctgtttgcagaagtagggaaaccccaggaattctcaagtaagtcaatttacttcattcttgctgctccttgcggtgctgttcctttctgttacttctgcagatcctgtccattcttgctgtggatcctgtattggctttccacatgttaaactgttcatgccccagtgtagaaaatatgtggtgattgttactcccattgacagctggcattctgtacagtgagttaataccagtgacaaaacactctcaaactgccaaatgtatggagggcactgtgaccacctgcccttcgtgaggatggagggatttgggactatctgcgactgtggaggttgatccaggccatgtagcctccctcgttggttggttggtaggggctacttctgcctcttttgtaggtttaaaatgaggcagctcaggagatgccaccatgaaaggctgtgggagaggtcattcaagaagaatttgtatgacagaatggggcacaccggcagtgtgatgggatcatgggagtagtaggtggtagggtacgagaaggtggcagtggagcatgagaggagagagggtacgaagatagtccgttggacttgagtgaatagtgtgccctttatccttcatatcttcttctcttatttttttcacattcatgctgtggatataatagttggctttgttagattgtgttttcggcatatacttaatttgtaaggatctcaataattttaaatcatcgtttcttttttcaatctggtaacaggtcttgtgatggaaaagattgcaaaaatcggtaccatgattcttgtctggatcctcccctgcaatatgtgtcgctaggtatctggttgtgcaccttatgtactaaaaagaggctccagtttggtttatttgcagtcagtgagggcattgaatctttgtgggatgttaaggaaggtaagtactaaataaagcgacaaaacatatagatagatatcttgaagtgtaaccattcatttattagttctattactttgtcaccctaggagtgcagaacaacaagcagtattttgtgaagtacaaaaatttagctcatgtacataatcaatggcttccagaaagcgatataattcgcaccccaggaggtcaagatctaatcaacaaattttgtaagaggattcaaaaagaaaaggtggtctctgtgaattttttgttttgtcatattagaagagactattaggttctgcaagcctactgatgtttgtccttttcaaatgtggtttcttagacaataaggtggaagcaggaatgggctgagccacaccggctattgaagaaaagacctcttatgtctgaaaaggaagctgaagaattttttaattcacttggtgataaatttgcttactgtaatgtcgaatggttagtgaaatggaaagatctgggctatgagtatgcaacatgggagcttgagacttcatcatttttatgtacccctgaggctaaggatctgaaaaggaactatgagagccgccatgaagatgcaagaagaggttttgatcctgcaaaaataaataaggtatacctctgagaacagttatccacattaactgattcaccattgcttaattggataaggatcacacatatcacctgtacatgctgatctgctgcatgcatgcatttttgtggttgtccacctcataaaaataatgatgtttgtaaatttttaataaactattgacttcttttcatagtcatgtcttatcttcatgtcattttattgtacaaattcgaccagttatggccggttgattatcagaaattgaagctttataattggttctcaatcaactttgaatctataccaatgatcttctgtgctgtttgttaaccttgtctttctcctttcatgctacattttgcacttctaattcttcagtgatttaattcttattctacatgaaacagcaggtgtatttctgactgagttcttgttagattcttcgtgtcatttaccttatataaacccatagtctcctagaatcattttgaattgctaaaatttggtcggacaacttttttgtacttactccctccaaccaaaaatataaggcctagtagctttttacattgtctccaacattatactttgaccattaatttcttttataatatatcaacaactatgaaattaacattatgtgaaagcaatttcaaatgctattcgaatgatatcacattcaatatgcatgaaattaaacatgtgttttgttagttcaattattagtcaaaattttcagatgttgattttcctaaaaataaggatgccctatatttttggatggagggaataacattttgctcatgtaacttcactggtatcattcggttactggcattttcttagtttgtttcatgctttccaagttagttcattatgggcctgtttggcatagctccagctccaactccacctctcatggagttggagctcagccaaacagtttcagctccacctaaaatgggagtagagctgggtggagtctctcacaaaatgaactagagaggtggagctgggtttaggcagctccacaactccactccagacccaactcctagagctaaatttaggaattggagctctaccaaacaggccctatgtttaaatccatatattcattaggactgtttgaaatgtgggaacccgcagggagatacactctttcctatatgactatatttgaaacatgtcttagactggtatatctttctatgattatgcaggtttctctttaaataactcaatgggggtgttttttcttaaatattaacagtttatagtgtctttggtgtttacagggtaagcaatgtctgtttcagaaacttcagaagctaccggatgggttcccccctggtttagacaaagatcatttgagttcacttaaccggctccgcgagttctggcacaattctgatggtgctatttgtctcgatgatcaggtagtactctctgaatgttttagctgctatgcacaagaactgatatagcgtttactccaacttgggttggcttccttttttttcacccacccacttttgtcagttcttacttcttagttataagtatatagtggactgcatggctaaatgctgtagtgcccttgacattttattgtggattctttccagttatgttccacatctgaaggtttaactatgtaacttatctattgactttatacaggagagagtaatcaaaaccattcttttttctatgtccatattgcctgatgtctgccaaccacttctcattgtctctacttctgcttctctctcattgtgggaagctaagttcaatcgcttggcaccatcgatcaatgttgttgtgtataatggggagaaagacgtacgcaaacagattcaagatttggagttttatgagaacggtttggtgacgtttcaagttctcttgtcccatcctgatgccatcctagaggtacttgtttctcatttccatcagcatcaaaacacatcaatgactactcttgttctcatttccatcagcattatccaatcatgaaagtcagctatcaagattactcacatcctatttctttccttttttccactgtaatacaggacattcagaccatggaatcaattgtttgggaggcagttatggttgacgattgtcaaagcttgagagtttcaaaatgccttgaacaacttaagcatctttctaccaattttaggatggttcttttgagtttcccactcaaggtgctgttagcaaccgtaacctgtagaattattttcactctttttccacaaacaggcaatgttaattccttttgttttgcaggagagtattcctgagtacatcaacctgctgtctttcctcaaccctgaaggaagtgtcatttcgagtagttcaaatggtgattttactgatacaggtgatatcttagcaacgctgaaagaaaaatttgctcgtcatgttgcatttgagcggaaagcagattcttcaaaatttttggagtactgggttcctgctcgtctttcacgagtgcagctagaaatgtactgttataccttactttcaaactccccagcactccgatcacactcaagaactgatagtgttggtgctcttcgtgacattcttgtatccctccggaaggtttgctcttcaattttctgagcacaatatattgttttaattcatggcagggaattagatagtctagatgatggaatctgtatgcaacagtttcttctgacatagctgctgacacaatatatccttgtttcttctggcacagtgctgtgaccacccttacctggttgatcaatcactgcaaagctcacttactaagggccattctctgactgatattctagatattggagtgtgtgcaagtggcaagctactgctgcttgataaaatgctccaaggatcagaaaccaaggccggagagttctcattgtttcccaggcaagatactagataacattcatccataatgtttttacatgctatacttaaatccaaagttgtgaagagtgattgcttagtacataagtccaaagtttactttcctcaaacatatttgggtgttttcttatcatttccaaagatagtcattgctatgcgcaattattatcatctgagaaaaatattgtgagctgtctttaatatgcacgttttagtgtcagggcttaaccactcaaattagggcagtatctgacttgcctcaaatgcaacatcaagggctgcataaaaaccttacacgatttaatacagtcatgcagaacatgtagggctggtgtctctctctataaaaattcttagggctgtagctggggtagaatgcagttgtttgcttgagccctcctgttcatattttatactagaaacaaaggctcaaaccatgttattctagcttgcacactccatattctgcaggaatccaggtgttggagctgcaccatatgaaccctaccaaaaagaattaaataagttactgaaatgtacaaagtacaaactcttttaggagtatatacttctttatttctaattgaactcattatttcgatatgctttggttcatcacttatagaacttaagtgtttggcattcttatatttttcttccaaagtatgtcagtccaatctggttctcctttttcttatatggcagtctggtggcggggctggcaaccctatgggtgacattttggatgattttgtccgtcagagatttggttttgagtcatatgagcgtgtagaacgcggattgctagtgccgaagaaacaaacagcactgaatatgttcaatgacaaaactaaggggcgttttattttcttgattgatagtcgtgcttgtgttccaagcattaaattatcatctgtcgatgccatcatcatatattgtagtgattggaatccaaccaatgacttgagagttctccagaggatcagtatagagtctcaatctgaatgtgtgcctatttttcgcttgtattcgtcttgtacggtggaggaaaagactcttatactgcgaagcatgatcatattcttgacagcaacgtccagaatgtaatgcctatcgtgagccattccctgcttagttggggtgcatcgtttctcttcaatagacttgaggagttccaaaagcatgactactccagtaaagattctgaggatgatggtctcttcatgaataatgtatttttggagtttgcagcgaaactatccaccaacgttgaagccagcactaaaatggaaaatgcagtcatatctcgagctcagcagagtggatcgttttattctagagatattgctgttataagcgagagggagggaatatctgcagttgatggtgatttgccaaagttctggaccttctggtcaaatttactaggtgggaggtctcctcattggcaatatatatctgagccagtgcaaaggaaccgtaggaagatacaaaatatggaagaccaaatgagaatacctgcagaagaaactgatgaagcaataatgaaacgtagaaaaatcggagaaatcatggattcatctccgaagatcctacctgtcaaagacaatgatgctgtgctgcctgaaaatagtacagcatccagttctcatgaaacatcagttgatgacacttggcaagagctaggtattccaactgtaacagtaattaacagctcttatgctttatgtgcatatgctacatttttttataatacactccattttgtaggggcagaaagccttcagggcacacagaaaggtcttcacacccaactcaagccagagctgtcaaagttgtatgaattgttggaattgccggtactgccaagtatattaaaataaatgcttgctttatgttattaatttgagaaaaatattttagttcactgcaagtacaggacataatctgctcttttagcattcaatttaatagctaatattttttagttttcaacagcagagttccacaccttgtgaagagttatttatcaagttggatcttgataacttttgctcttcataacggaaacattttctttgactcttagtgtgtcattttgatccatatatgttacttcctccgtttcacaatgtaagactttctagcattgcccacattcatttagatgttaatgaatccagacatatgtatgtgtttagattcattaacatatatatgtatgtgggcaatactagaaagtcttacattgtgaaatggagggagtattagttgctactatatcctgcttttagctcaggttatgagctttgatatcacctactccctccgccccatagaaaaccaacctagtactggatgcctgtctagattcgtagtactaggatgtgtcacatccggtactaggttggttttctatgggacggagggagtgcatgtttctacatgcttccaatatgaatttatgcaggacagctgtgtcctgcagtcctgctgttaaaaagttgcctcctcttctgtagaatttatgcagcatgctgttaccctaagtttcagtttaagcgaacttttcctgaagtcacttgattctctagttaaataatataagctgattggatgcttggatgcttgataaaaccttttgcaggagactgtcaaatgtttatgtgaggaattacttgattacattttgaagaatcatcaagtcagtcaggagccaaagggcatattgcatgcattcaacattgccctgggtagattataaaaatattttataggttttttagctaaatttgcatggctaaatgctattattttttccatgtgcttttcagtgttggcgtgctgcttctctcttaaagcataagatcaatcgaagagagtcacttgccctttctgtgagaaacttgaactatgagtgcgatgaagtgctcgctgaatatgtttatgagaagctaaggatcctcaagaaaaagttttcgcgtagagcaagtgaaacaagcaagcagagccaatctactccagtaaataacacatcatcttacaaacaacagacctcaccgaaattgagaagtgacggatcaatttgtcatcaggtaacgacaattgatggtgatttggaaaatgtttcacatgaagaggctccacatgatatcttgaccgaggagatgatattagaacagaaggaattgatatctgttctagaaactcatagagaagaacatgttttaagggatgaacttcttgaaagaatcacagagaaaagaattaatttaattaacatggttttctccttaagagaaaagaatattcaggataaacaaggaaacgagaccacactgttagacatgcacaagcaaaaggaagtggcaaagctgcaagaaacatgcaatttggtcgtggaacatcttcgtaaaggtcacattgattcagaggacagggatgccacggtgaagctaataattgaatggtttactttgcttctgtatgcatttttgaatcacatgagatgccagcataacaagttgaagatgcagcaatcaacttcatggaacaaggagttacaattgaaggaaattttccttcagcaagcaaaatctggccacttagatcgtagctttgatcaacaaattcctttaccagattcatgctttactttggaagaattcagccacttcaaggaaatagttggtaatttccctgtcggtgcagctacttcagcaaattgccagcattctttggcatcaaccatggaaattgcattggtccggagtgtcagtccatctgaagttgggaattcagaagcagcgataaatggggctgttgaagttcctgtccacaccgaaaaaagaccaacatcagaagttgggttgtcgcagaacaggatggacaatgattctgatggcattgactcacaaggagggccacctctggctgttcaacattcattaagttctaatcctgcaattgacaattccaataatttggtatgttgtattttgttcatatgccttctttttctgcgtgataacgtatcgtattctgacttgacaacttattacatgcacagctagtcgacatttattcatttaagtagttgccctattttatataaaaagattaaattgcctggacactatatattagtaggaagatctagttagttgctctgttaatctgtccagcatggattgaacatcatgctaaccgtatatagtatgtggcctttgatgcatagcattctcttgggcattattcatttgctctatccattttacttgaatgcattctttagttgtggacatcttcagttgatgcagctggtacactttgtctttgcatgggaatagtggttagaatatttcattcttttttaaaaaattaatggcacctcactacttttgtgaaattttgtgctgtaaatatcattgtacactatatttattttgtttgttgttatttatttcataaaatatataatgccagaaacagcacgttgtaaaatgttgtccatattatatcaggaatcttcagttgccagccatagaagcgaacatcttggggatattgcagtggaagttaatgccgacaattgtggcactactcttgcagattcacctcacttagaggcaccaactgtggctgccctgcccagccagagtgccttgccaatggctatggaagttgacattcagacagatcatgtagttcagtctgcccagcagaacatagtgacaggacgagttccacaagaagaagagcgagaaggttcgaccactgtaacatcagctcagcctttgcaacctgaaatgcgaccatcaagtccagtatccggtattttgcgtgaaagaacaaatcctgatcagaggagggaaagtcgtcagccagaggctgcacctagttcggtggatccaacacaactctttcccgtggcatcactgatgtttaatcacccaccacttggcaatgaaccattgaaaaatgagctgcacagattacaagtacacatggattctcttaataaaatctacgaactgaaggtttgcatatttctccctcttgctaatataccaactgctcacactattcccagattcatcatagtttcatcaattctgcttttacctctggacagaaatcacaacttcaaacggagtgcagccaagaaatcgagaagataaaacagaagtatgatttgttaattaaagaacaagactccgctcatcatcagcacaggaagacactggatgacttgtatgggaaagttctcctaaaccaatcactagctgatgattttcgggtcaaatttgtatcaacatctgcagctcaaggtatacttgatatcttgcaaaaaaaatgttttctgatattgttagtgtggatatgaaacaatctgggccaaatttctgctacaacattatattttgataatttgaatttttcacaaaaaacgaaatagatctcctacaagccattgtttgtttttgaatttaggagatcatatcgcttactgtgccttgatgatccattctcttgcttatccaaaggagggcctaattcgatcctaaggtcaagtagtagtaagtaacctatttgttaagtcggacccaagagctaaaagataacctcttccttattatgattggaaggaaacatcaaaactacgttaaaactgagcgaatgcattccgttctacccctcctgttaatgtaggcctttccctgggagaaaggggcatggttgttctggatttctggtcctatagtggaagaataatttttcacaatgagataatgccgcataggaattgagcgccaggaaatgccaagttcatttgcagtgcttgacagacctagtgttttgcacaatgaataagattgtgcttaaaaaagatttgtaaagaaaattattgtcctggaccgagttgttttctgtagaagtattgtttgttactaatgttcactctatttggactgcagccagagccgtttctcctccactttgccagacaactcgccagacagctggggtatctcagcaggtaccaactaggccttcggtggctggatcgattgcattgccagtcggttcatcatcagctagtcgaccatcgctgcagaggcattgtgctcaaccatcgcatgtggatcggtcatcatcatcgggggggagtcattcatcatcgccatcttcacaagttgtacgacctcccccagcaatactaggcagcgttgtcagggcaacatcaactccttttagtcacacacctgcagcccgtggaaactatggagttgggagtgaagtagcacgggcaccagctccccatctccagttcaggctgccacgagcacatcccacggcccctgtaaatcagcagcagcggcagctcccagttaggctagagagcacatgttcaaggacacagttgactcctgtgagcaccccagtaaacgcaaggcagttgagttcacaatcagtttccccggtgagcaattcatcatcatcgtcaagctcacatccaggtccagcactctcaaatccagccttggcagcaaattcaagttcaaatccagttttgagtgcaggcacagtggcattgccgccaagtccacacccacccgagtcgatagcagcaccaaggggacagcaaaagggggcaccgtcaggcttgaatacagtgcctgttgtaggctcgggtttgccgccaagtaggtccatgtcagattcggtgtcgctggatgcatggcttacatccaatcttggtctgaaggacggtgaaaccagcacacctcgcactcgcatggatagtcatcgtacagtagatgtggtgtgcttgtccgatgacgaaccagaagagcactagagctagagctagactgacctgacttttgtagtacagcagtattttcttggaatgccattttttgcctgcctggcacaaggagctgaatttggccggactggtggcttgcatgtatatgttgttactactagtttgttattagtagtaccattccattctagcttagcttgtaagctgggtgggttggggttcccttccctccaggccttgtgcagcatgcctagtaaggtctgctagggtaacttaggttgttgtaaatagtactaagtaattagtactgtacaagtaataacttgctaaccagccaaccaggaagtgaattaagcatggtggtaatggcctccttggttgcttgattggttgtagtcgacgaccttttggtttactaatatacttgtgtccttgaatcttttttttgttttatttttgaaagggtgtactttagagaaagactacacaacggtataccgttgaacggtatactgcttatcccccatgccacggccccgcgtgccggcttcttccgagtatgtcgcctgctgctaggattatcatcatgcacgtttgctgtgtgtatcagtgtatagtcttgttcctgacagctagctagtacccagcatgcttgtcctgcctttgataaatattttatgtatatgataaaagtaacttacatatgtaataaaagtaatatacaaatataaatattttttcatcgtaatataatcatgtaagattttgttctgaagatttaattgcaacgagtacaatgatataatcggattatagatcggataagtaacttgagagaaaacttcataagaagataaaaaagacatgtataacctaatagcaaaaaaatagttgcatatatgtgaggtgcaatagtacttctcgcacgtattgcgctgtcgcctagcaggagatgtctctcgaaatagattttgcgcaatttaatatatatttttttagacggagagggtaatagtcgagaagggttgagagtgaaaaaaaaaaggtggaaatggaaaatgaggtgggttgcgagtgccagctgtgcggtgggcggcgtggcgtggtgttctgcggcgcccacggcgggcgcctctgcctccaatgcgaccgagccctgcaccaagcccacggcggggccggcgatcacccccgcgcgccgctctgcgactcgtgcaacgccgccgccgccgagctgcgcctcaacgacggggccacgctgtgcgggccgtgcgcctacccctacgcctacgcctacccctacacatacacctacgtctacaccggctgccccaccccgctggagatgatgcgcctcctccatgccgccccgccgccgccggtattcagtcaccctcatctcttctctcatctgaatttggctctatagtttcctgcagtcggcaggtccaggaaacccgatgctggtacaataatgcatcatatgcagccagctacctgcagtttacaacaacgaggagaaggagaagagctacttccaactctcttatctgcgactgcgactcctaatactgctactgctgcgccaatggcaatgccacccccaccactacaacaccacaccaccacctccctcatcatgatgataaggaacattcacaagcgggaggagaggaacagagccaagctcaggtacaatgataagaagaagacgaggaagtacgtatatatatactctacttattactacttgcaagtgcaacaacccccaaatgatctcatcttaacataagctaattaaattaaattgatgcaggttcagcaagcagatcaagtatgcctgccgcaaggccggagccgacgcacgaaagcgggtcaaaggccgattcgcaaaggcctcttcctcctcctcctcctcctcctcctcttcttcttccatcgatcatcgattatgataacccacgctctcaactctcaaccacatttcctattcaattccacatcccctatctagcgatcattctttcatcttctggaccttgtgttccgtcatgaccagcaataatgacctagcaacttctcagtgcgcacactgtaaataaaatcttcccacacctgagtcatcccatccctgatttttttttttttgagaatttccttgattgttttatgtcccctatatacttctgcctgtcctttttctttctcttctttagaaaaaaacaatggaccaattatattcttgctccattcaaatgatgtaataatccttgtattcagtttaattagctcattgatactcctatcctatgttaagtcccagcaggttctgaaattcaaaatctgcaaaatcatctgccctcagatcgatacgtgatgagcttcctcatttcggcatcatcaagaaactgcagcctgacgatgctgatcactactacttgattctggacagttaacttgttttgtaagcagcagcgcagttttggttaacggactatcttgtctctaatcttgtgcatcagacgtacttgagttaaatatatgccatcctgtcaagtcaaagttagtatctgaaatctattagttacttgatcgggttgagcacatgcagcttcctttgattttcctcttcctccttttctgttagtacatttttacattaggaattcgtctacgcaacaactagtagcctttttttttaggccggaccggaacaagtagaaagaaggggtgtgctgctattgcagaatgcaggtagtctccaggcacattccctagttcgttcctaaacagtgaaactggcaccattcatcagattcaaactttggctgtttgtcttttttagaatatttaagaagcttgaaaacataagatattatattatttaagtatgtaatgtcataaataacttttattcgttataatataattattcagaaataatttgtgatcgaagtaagatgagtagatgatgataataattaacagtcaggttattcgagaatggaagaaatactctttcctcgactcatccgcttttgtacgtgtatatcaataaatatactttctctgttttacaatgtaaaatgtaagtcattctagcatttcacatatttaattcattaacattaatatatgtctagattcattaacatcaataaaaatgtagaaaatgctaaaatgacttatattatgaaacgcaggggtagtatataagtgctaacacgattattatgaatggtcttcttgctttcaaaatagaatacccagtgatgctgatgctaatggtactaagtcgacggttattctagaattagttggatcacatggagtactatttagcagccggaggcataggcaggctcatgtcagacgtgacgactgacgacttgtactagtaaactgtagaacctgagcttccatttgaaaattcagtcaatcaacgtgtcaaaacctgagcttcagcctcaagtccactagtattccctccatgtaaaaaaagcttaaccttgtgtactagggctgcgttggagagagtgagtttgtttgtttagtttttcacgcgcacgtttcttaaactactaaacggtgtattttttataaaaaaaaattatatagaaaagttgttttaaaaaatcatattaatctatttttgaaatttaaaatagttaatactcaattaatcatgagctaatagctcaacttgttttgcgtatcttaccaatctcctcaatccccttctcctcaaacacaccctagatgctgatacatagtagttaggggcaaatcacaaaccctaagaagtaggagtaaaatcacaattgaactagaaagtaagggcaggaacacaattgcccctagtagttactactcctacgtactaatattatgaatttgaaccgctgtacagatttatagtactaagatatattaatatttagtatgaggttaaattttttttgaaacggagaaaatagacaagttaagaatcaacatggaaaatgcatatgcacgcaccgtgcagtaacagtagtaagtagagggaaatgtacttatatgtgtagtgtagtaatatgctctacagttttataatgggtgaatagctaatttagtcccttaagtttcaccgaaggcttaatttggtccttcatgttttattttgtccacatagctcctccaaatatttgttttgacttgaaatcatccttggacccacttaatatgttatatggctatttctagtcaatatttctattaaaaaaatgtcttttttgcccttaatttgcatagaactatatactagaaaaaagaaagtcaacatgaataaacaacattacagatgtacttcccattatttcaacatgtgcacatgaaacttaagcaattactatcgtatacacttgctagtacataatttattttcattttacatcatatactatgtattatctataaaaaattcaagcatgcaatttttctcttatatatgtgaatgatgaggggtataagtgtcatttatgaatagagttgttggtttaaggataagtttgaactaaaaagaaaactcgaaggactaatatggatagattgaaacatcaaggactaaactgagtctcagatgaaacttggaggaccaatttgaccattcacccttttataatactgaaattgacttgggaaaccatttcttcaacgactataaaattggtaacaataaatccttgcagtatttgacattaattcctttttctttcttgtttgtgagtaaaatattgttgggccaccaacccacagcttacattgccttgtagactagtactagtataaatgaatgggatatacacgtagtaataatccaatccaatccagtaatatcgcaaattaagcagcaggtgcaggaggatgtcgtcggcggcggcggtggtgcgcgtggtgtcgaggcgcaccgtgaagccggcagcgcctcggccgcgggagagcatccccctcacctcctgggacctctccatgctctccgccgattacatccagaaaggcctcgtcttccccccgccgccgccttgcctcctagtcgtcgaccacctcgccgccgccctctccaccacgctcaacacctactaccccgtcgccggccgcttcgtcacccacaaccacccggaacctgaaggcggctgctccgtctccatcgactgcgacggccaggcgtccagatcgtccacgccgtcgccgatgccgtcactgtcgccgacctcctccctcccgacgcccacgtcccgcccctcctccactccttcttcccgctcggggacgccgtcaactacgacggccaccatctccccctcttcgtcgtccaggtcacccacctcgttgacggcgtcttcctctccttcgtctacaaccacgcgctctccgatggaaccgcattctgggacttcctcaatgcgtgggtcgagattgcgcgcgccagctgcctcgccgcgcccacctcgcccccacccttgttcaaccgttggtctccctctcccggagacggagccccggtcgtgctgccgtacgccgacctgtcggagctgatcgagaggctgcagccgccgctgctgtgcgagcggatgctacacttctcatcggagtcgctggtggcgctcaaggagcgggctcgccaagagctcctggcggccggggacacggcgggcgcggccgcgctgacgaggttccaggcgctgagctcgctgctgtggaggtgcatcacccgcgccaggcggctgccggcggagcaacagaccatgtgccgcgcggccatcaacaaccgcgggcgcctccagccggcgctgcccagggagtacttcggcaacagcatctacgccatcagcacggagaaggtgcaggcgtcggagctggtggagcgcgggcacgggtgggcggcggcggcggtggggcgggcggtggcggcgcacacggacgcggacatcagggcccgggtggcggcgtggaaggtgaacccgataatatacacggcgaggtacttcgacccgtcgggggtgatgatggggagctcgccgcggttcgacatgtacggctgcgactttgggtggggaaaggcgctggcggcgcggaacggcaaggccaacaagatggacggcaaggcgtcgctgtacccggggcgggagggcggaggaagcatagatgcggaggtggtgctcactccacaccacatggcggcgctggacgacgaccacgagctgtgggccgccgtcacgccgctactgctcaacaacaacaaaccttgaagcttttcttcctcctccttcctgccttaattagtgcctgccttttcttccaaaattaaataataaaataagaagctttaagcttttccttccgatgatattgtttcccgtctctgtctcaggttttggtttccttagtgtttgtttgcttgcttgattgataatccagcatcaacaaacaaagtaaagatatatctattcatgtcatgacatcattccagtgaggatgcaatgcacaacaccttcttcttctttttttcttttgacgtaacagaggttgcaaacttatgggttcgtgtctaattcattatctacaaaaactgaggttgcaagcaaactacatagatactgtattatcttacaagtaccaaatcacttgagccatccagcattatcttcagttgctacacaagaaagattggtttggtttccttatacaccaacaccacaagtatgcacatatgagaaaattgatgttctggactggaggaaaccctccatgcgttcagtttgagaccaagaatttgacaggttccgctctaaacaccaaaccaattattatatcataggtccaaaaccaaaaccaaaatagatcaattttatctatctcaactccccacatcaatctgtatctcaacagaggggaacatgttaacagtcccaagttgcgaatgtaacatcttctttccggcggcatgttaatggtacctcacacggtgtccatccatccattcattcattcatggtgttacaaacacgcctgtactaatctgcctacagtgtaggcaacctcttattgaaattgacattcttgcttctgataatgctatacccacgattgtacagtacaggctgctgagcattattgtctttacttacacggatctggtgaatggttcagttacagcctcacaaaatatacacaagcacagcatcataagctactaaaactgatcaaagctactttctgcatggttcttcgctggttgcccctccattgtcatgtgagaagtgggatttcaatccaatccagcactggtagtaatcgagatcccgggatggggaatcgagggcccattggcaaaccctggggatgagtgcagactcgaacatgaatgcaagcgtgccgcttagccttgatggctcattggcatcaggacggctgattgttgcctgcaaattgatgcaacacaccatgttacaaacacatcagcagccataccacctacaaggaaggaattcctccctaccatcggcatgactaacctcgtatgtcttggtgtctgggccatgaggtgtcatgcaactgtgaaggctagcacctccaggaagaaaaccatcagctttggcctgcataagttcagaaagatgagttctgatcatgactagcttagtcaatacacaccagagagaaagagcagatgctagcgaatgatcaggtctgacctcgtatattccatagatcaatcccataaattcactcatgcaattgcgatgatagtatggagggcgaaatgtgttctcagcgaccaaccatctaggcgggaatatcacaaaatcaagcaatgcgacaccaggcttatcagttggtgcagtcagcactgaaagttgaagaaatatatcatgtaaaatccccctcactgaattgaatgaactatacacattgtgttttaagataatgtaatacaactattatcattgtgttggtcgtgaaaagcaatcacctgtatttactgatggatcagcatgatcgaatagaacagtgttaaatggacagaatttactcaggtcgtactgaaagaaagaaagaaaagaaaatcagatcatatgcctctacctgcaaatttctgcatagaaagaaaggaattaacatggctagataaaaaggtttaccttgtaagggacataatttccatgccacgctaccacattaaatggagaaaagtcctgagtggcagtgaatagctcaccaccatatttctgcacaattgtgtatcctgggcggtggacttgctcaaaccatgctgttggggaaaggaaatcccttgccgaagccaagccatttgcacctgcacaccaaccggacatcttctagcaacataaaccttgtatgcttacactgtaaatatttttctttttttttaaaaaaaaaagaaacaaatgcagaaaggttgaaggcactggtattaccaatcgggccaagatcagggagctgaaagtgggtaccgaaaatctcagaaacatagccacgtgaaggaccatcgggcaaatcaacagcaaagcgaaaaccctggggaatgacaacaatttcaccaggtgggactagcagcttcccacattcagttgtgatcaacagctctgggcttgatagaaaaaggaggaactacggttagcatacatattcctgtagaaggtaggcataactgaatggaaattgcattaagcattatactacttttgaagcatggtgcttgttttcctttttttttttaaaaaaaaagaagaaggtacgttaacaaccacagacacagagtggcacaagtggagcactggaaatgatgaagattgaataattcaggggagaagagaaataatgtcattgttcatatggtggtaagcaaggcaagtggcaatcatgttgtggtgtggaacaattgataactggaggggaaaagtgtcatgaggttaattaatagtacagtagtgggttaatttgcagagatgaagaaggaagggcagggcaggatagaagtgaagaagggaatggaagatactacaacatacttccttgctgggggacaatgaggaaatcgccgtcagcgttgcaaaaggcgcatccgtccatggacttgttagcagcgtacctggagcaagcaggatataatggattgaaagaaagtagaatcagcatggatatacatacatacatacatacatacatacatacatacatacatacatacatgtggatggcgtatccgtggcgcaggaaggagctgccagcgccgcagacggtgtagaggccatcgatgaaatcgaggggaggatggtgggggggcacgtcggcggggcgccagcgcagctgggtgggcgtggcgacggtgtcggtggtggtgcggtcgaaatccccaattaagcgggggtgggcggggcgacgggggtggaagggctcgtgggtcaccgaaggcttgatccggtacagccatctgcatctttctttcatttgatctgatagaattgaggaaagattgaagaatctgatagaattgcttacgttcggaggttgcgggcgcgcggggcggtgaagggcgtgccggagagctgctcggcgtagagtcccagcgggcagaccagcgggctgttctgcccgcgcgggagcgtccccgccaccgcctccgacgacaagctgttgcccagccccgacagatatacgtactccaacccccccttctcctgctgctcattctgcgccgcgggggttgccgttgccatggccatggccgctggccggaggagagggagaaggacaacacaactgcttgtctcctttcagtttcaggaggcttctcctctcctgtatctcactcttcttctcaccgtctgtatatatcctccaatcaactactcctcctaaataaaaataataataattactctctcatattactactacatactagtagtaatctaatactgattactaacacatattctatgtattagcatctcttctttatcaatatacttttaccctcttctaaagaaaatttgttctgtattagcctctcctattagggggaggagtattgttgcaagacgtttgcttattacaacacaacaattttcgcaactccgaatgtgcgtagtgtacaacaagaagaagaagaagaggaggagcagtttgtcttgccttcacttactcagacagcgatggattggatgccatctccacgtactaagtatctcttatcttcttcatctaacactgaccgttctaaactataagatctatattttgtttataataacatattttgattattaatttatttcatatttatattattaataaatgcataatacttagcatttactattgttatcattattattattattattaccgagttgaattttttaaaaaagtataccctataattttggactactactgaccagtcatcctaatcttctcaggaaactggagtagtttgctgcctctgcctacttaaaagaaaaggaaaaaaaacaagtcaacttaacccaagctatgatgcacagatgcacccctatcttgtttcttggtggaggagatgcatttgctgaagctttagttgtagtatctcgcggttcaaacagacatgcagttcagcaaataaaacttgggagtaccacctttgtggtaactggtaagagtcaaacaaacgacttgctcttcaactatcgatcgcctgcaggcaagcaggcctcacggacacggaggctgctgcggatcagggcaaggagtgatacaagttggcaggtagacacgcagaggacggaccacctcttctgctgggacgttgtccatccaactttagtatcaccgatgcccatgaccacttcgattgcgcaattctagctatggctcaacaggatcatcgcttgttcaattaatgatgatccattatatatgttcaatcctgatgcatgcatgttacagtcaggctgctcaagcagattgtttgtttgcagcagtatctatgcaatttgcgtattttagtgagttgagtattgcctcttaagtggtctccttctcctcttgtaaaggtggcttgagctgagcaacaacaactcatcaacatcatgaatgtctgcttcagggtcccccctcctagccatccaaacagaatagataaataccggtcaatccccctgggcaacacaaaacaacccatttgatgttcctcaacagcttctgtacaaatcaagagatcaatcaatcaagcagcatctcaccaacacaacaaacatatgcctggtgaacaaacacatataacacagctttgttaaacatgcacgcaaacattgcagctcacaacaaggtgtagtaagacatcccagaaatattcttcatcgtatatgtagaaccatcagcgacacaagatccaactccataccattaaattgacagaaacaagtccactaggcttgccaacatttagatttaggtaccaccggcaacatcaacacatttcataaaccaaacctaatgatagaacaggtcttgcacaaaagcatcagttgaaccttcccctgtacataagtaataaccagctccaaatcttttcaatagctttccaggataagatgaacctactgctaccgctgcatcaaaaatctatgtccacagcccgagagccaatcaaagtctaagtagtcaatcctcgtcgacgacatccaccagctcatactcgaccagcgacacgttgttgtcttccttaacttgaaagctggcagggtccgtcacctcgatccggccccatttgtcaactgccagcctcatggtccccttgaacatgtcaatcttggcattgcggaagatgaccgtggtgcctggcttcaccaagtcaactgttgacacgaaaaaaggatagggcttacttagatggatgagacacacaccacagcttttgaacaaaaaagcgaagtgattataatgatagtaagtgactagcacatatccatcatcgaccaagatcaattaacgggcataatatagaaaagtaaacatacaccattattatgtaatgaagtgaataggaacgtgaggcagtgtttcagatcagaaagcaataagaaacacatatcactttgcatcaatgtggtatagaaataataagatgagacaccagaaatatttgtctccttcattgcctagggacacacgcggtatatgtgttgcatcaagcgcaatttaagttacattagaaaaaaactgtgatccttgagcagtggcggagcatgggtctccacaatggtggttcagacttagtatatggcaaaccaataaagccaaaggcacattgaaacaagtcaatgaatggaatgattcaattggcatacaaaagttaaatggttttttttttctggcataagcttcttgtttcagtatataagggtatataatgggtgttgtgccgccaatttgcttgagcaaaggatacatgagaggttgcagttgaatactgtaatgaataaggaagtaggaggggagaggagaggaccttgttggttgcgggcggtgaaaaggacggtgccggtgttgtccccgacgaggcactcagcgagacgagcgcggggaggagggttgtcgaggatgatgcgggcggaaaggacgcgggcggtgagggtgtggccgtggctctggggccgcagccgctccacggtggtgaacaccggtttacgcagttgctgcggcggccgtgcgggagcgggagcggatggcgaggggttgggtgcgcgggggcgcggcacgtaggagggagcggcgccgccgcgacggccgtaggggcgaccggtggaagacatggccggcaatctctccgaatcttcttcttgttggattggaatcggaaagccgcagccgccgccgccgccgccgccgcctaaaccctagcagcacagcacagcagagcagagcagctagtattcccagagtatgatttatgaagaagaggatcggatcggatcggcgacgcaacgcaacgcaaccgaagaggcctacgatggtgggcctgggcctttcgttcctcatggcatgggatgggccttactcctactactggaccggacagagttttgatgggcctaaatataatccacatgtacggtactagagagaccgttcgaatttgagagcctttctttgtctaaaaaatttaaaaagaaaacagaaaagataaggaataaactccaatttaactccctcaactattggctggcatagcctccaaccataacatgggatatattaacccccaactcctaaaaccgatgtaaaagactcactgaacggttttcgctgacgtgtcttctactctttatctagtccaatttgaagatcatatgttagcgcctctttctcttttctactttctttgtgctaaaatattacaacatccatcctagtacaacgaatgatagtctagattcgttgtcttagaataagtcaaatcctattataaattataatattttgggacggatgaagtaccccatgaacacgtacgtactgcgccaataatgcagaacctgagcggcgtgtaggtgggtgcatgtcagtgttatccgctagctactactccacaacatagtaaaaaaaccggatcgggggttgacctgctctggctgcggttcaccgatcgaaccatcggttatttatttatttattattatattatatttctactatttttaatatagaaccatcacaaatcggtgaaaatatgtactccgaccacatcctttctcttctttcaaagtggactactactactcctttctccgtcctaaaatataaagcatttctaaggttgacacgagtatactaagaaagtatgtgaggatgattaaataaagcgtgtaattggttgagaagagaaactaggtgaaagagaatgcttgtgattggttaagagaaggatgtaggtagagaaataacctcattttaaaacaaggtattgtactgttatattttgggacggaggtagtacctgagtttatccgacttcactggactggacaggggtatggacagtgcaacctatttgattgagattgatgtggtcgtgttgcgttgttcacaaatcacacaaatcattgagattgattggacggagcaacgagctaaacgtgccttcttcgttagtggtcaactatttgattcgattccatatattcggattcattcaacaatcgtcatggatgcatgcctttcttatataaaaaggtcactggtttggacaagtggagggagcatatcaggccctgtaatatcaaaaccagcggcgctaggagctgttcccacccacgaatccacgatctttccgactgcagtctactcctctccataaaaaaaaaaactgggattccgtgtttaacggttgactgctcatcttatataaaattttcttataattagtatttttattattgttagatgataaaacatgattaatattttacgcgtgtcttgtctttttaacttttttcataattttttcaaataagacaaactgtcaaacgttagacacggaaatccaggtttttttttgacagagggagtgcttcacaagttgatatgaagtggagttgtggagttggctccaccctttaattcattatgtgataacactctaaccaattttataccgttcatatgtagagttgaaacttactccaacttcaagaaaggtcaagctgcagctaaaactatgccaaacggccccctaagcatatcgactccaccattttctcttcagcttaagctaaaattttaatttcaaaacttaattttatatcctttttaaaaaaacatagtataaacttatacggtcttataaatatacacaccacactttacctatatcaacatctttgaaaga

SEQ ID NO: 13046 - DNA, 22073 bp, Oryza sativa
  unsure (1)..(22073): unsure at all n locations
tagttttagagtgggctttgatattttattcatgctaatttatcttttaatattggatttaaatcactaaaaaattatataaaatttttatccataaattatcttctagttactaataagcattataactttcaatcatatgtatacgaaataatatgactgatacgacaagggaacgggtaatataagtactactccctcgtctctagagttctccaggaagactaaggctatgttcggcaccccttattcccaacctctctccctggttttccacacgcacgctttttaaactactaaacggtgtgtttttgtatatatatatatatatatatatatatatatatatatatatatatatatatatatatataggaaagttacataaaaaatcgtattaatccatttttcaagttaattttagctaatacttaattaattatgcgataataagctgttccgttttctatgtcgatgggatagactcccaactggcacaaacgagcgcaacctaaggagagatgcgagttaagttagaaataattattatttgttaagatgaaaagctaaggggagaagttaaatgagacataattatgatgaaaaaaaccatagattgagatttgacactacatagaaaaaaccaatctaaatgaagatttgatatcacatagataatagaggtatattttatgacggagaaagcgactgctcgtatttgctacgcacagataaatccgtaagcgcatggataccgttgtatagcactttcccttagagcattccaagggtattaaatgcaagaaatgagtgtgtatatctacaaacaggattctacaaactacaacaatttgatgataagattggctagagataatttctatagattcaactagttatcttaagttaaaggtaaaattctatcgaatgcttcgagcattggccctctcttagtttgtcaaggtgaatcttgccttgagctctataatgcacctgaacatggagggatgcaaaggatgaacaaggttgtcaccacctaccgcctatctcactttcagttaagcgcacaacaaataaggtaactgctaacctacacaccacttattgactactaccctagtctcgcgtaggaacttccttttttatcgagagtcttagcactactatatcactttattataagctaagcgacaaacccgcaccgatgagaatatatctcactcaagtaaactaattaaacaatataagaaatctcgaacacttatttataaagcaagcatccgctgaggtacaagcaaaaagaaggctgacagctctggcgcttcttcggaactccaatggaagaatgctgacaaacctgacactcctccggaagttctcggagagaactctcatactttagggcactccttctggaactcccctcattcactcaataatccaacatactaagcaaaacctaaaagtgagttgtactctactttgtgtgttgagctcatcattttatagcttccgtatgatggttggaatgttcgttgttggcggttcacccgaaccaagagttcggttgatccctgggcctcacccctctccaccaactttcttcagcggcttacaggtgggcccttatggcagttgaggattgtttggtcccactttaggtctttttgactgtcaggtgcatcatccaatccgtgtacttgcgtatgattggccggaggtttcttttgtcgcatgacaggtgtattttcatccataaataacctgcatacatatatttaccaaatttagtggaaatggttagttgttagcccctatcactaagttttgatataactttttatattctttttgcaggagttgatagttaaagtttgcacttaatgaccatcaacaacaactattgtagatctattggagacaaaaggaaaaaaaagtattactccctccaattccataattcttgatgttttagatgagattgatatcaaacttttataattttaactatcaatagtttaaaaaatatttaatttaaagacactagaacaacttatatagacttgtcttacaaagtatcataacaaaaggaaaaatatatgtatttattagatatattataattaaaaaatatagtaaaaatatattttgaagtcaatgccattattcaaagggtaaattggaaccatgccattataattttgcaaagtttgagatatgacatcgatatctcaataacatatatggcccacatgagtcaatggcatgtaggtcaggatgacatatctcaaattttacaaaacgagtagtagattttgtagtatgttgaatgatgtatacgggcgccgtccagttagttgcacttaattgtcaattaagctggggttgggagggatgtataccttaatcattggacttaattgtgaatgttgcctttgatggtaggccgaaccatcgatagctacgagtttggtcgctggtaatgtaggagtagtttgtttgttcggctcgatcgatcggcgcgctgtttactcatactctctcttctttgtttcgaaatgtttgactttattaactttttagcacatatttaaccgtttgtcttatttaaaaaatttaagtaattattaattctttttctatcatttgattcattgttaaatatatttttatgtaggcatataattttacatatttcataaaagtttttaataagacgaacggtcaaatatgtgctaaaaagtcaatggtgttaaacatttcgaaacgaagggaatatatcataataacgaataaagcccttgtgttcaagtatataatctaaatatatgcagccaggtgatgaagcaatcagcaggaataaattaaggatattctcgatggagccaaagatggaaaagatagaaaatatactccgatatatctagatcgaaagtaatcaatcaatatatacagtcaatggagtcgagtggtagctgtgtattgttaattgcctgcctgccttggttttaacgatattacctcccataataggtgatgttttgactttttatttacaacgtttgaccattcgttttatttgaaaaattaatataaatttaaaaaaaagtcatatgtaaagtacttttgattataaagcaaatgaccaaataaataaataataattccaaattttttgaataagacgaatgatcaaacatcgacaaacaaaaactcaaaaaaacaagtaatatgagacggaggtagaactaaatagagtattatatatctgcgccgtgcgggtggtttattcttctataagactgtgtgtttgatggtggggttggaaacccatctcttatacacgaaaaacggaacggtttagtagtacataattaattaattattaattatttttttaaaaagatcattatgattttttaaacaactttcgtatatattttttttaaaagaaaacggacagtttatcagttttaaacatactatatacgcacgcagtatgtacgcacttgtgaatactgtagtaatatatcatggtatttgtcgacggtggacagccgtaaaccggatataaaggtattggggtacgttggtaccaagatctacgtagtacgacttcaaggaaacatgaaacaaagattatactggttcaggccccttaataggtaatagttctaatccagttggtatgggattatatggtgagaaccacaaattacaaaggaaataatagaactcgatgataccgacgagatcgtagtcgagttggttcgactagatcacccggcgacttggctcttgtagactctggcttcgtaggctgtagttattgtcttggctatgagattctatgccttaggtcctcacgggggtcccttttatatcacaggtcaggtggtcttcaagtaggactcggagatatcggaccctgcacgatacaatgacaacctagtcctatacgggtaggaactcttccactggtgaacttcgtgatgaatttccttagcgtatacagagaacgtccgtacacgcgcagatgtaccatatgtaccatatgtcgtacagcgtacatccaagggtagagggtataccttatccgtaaccctaacagtattgataatcagtagccctgataattaagataagataggactggactaattaatcactactgctagctgggtaggtactgtatttgcaagagcaaaataatacagcatgcagttattttgtgtacagtaataaaaagaagagaaataattgagtagagcagtagtatgcaggtagtaggttggtaggtggcgtggatgaaccgtatactcctagaaataattgagcacgtttgtctacacaaacgcaacgcaagagactagggaagcaaagtacttgatgcatacgatctcaactcgactagtatgtatcatgtatgtacgtacgtatgtactgtattcattagggtgggactgtatactatagttattattactagtattgttgacaaaaacaattcctaagttttgttctaagaagaagagcaacaaacgtaagtctataggagtactagatctttgcatatagtacccaataaatagagggagagagagtgcgggccaaactcccaactcccaagttgcaatcgagaataaataaaaatcccaatcccctccttctcttcttcttcctccctgttcccttttcgattcgattggattggattgttttgctggctcgctctctctctctctctcgtggtgtggtgtggacaagaaaggaaggaaagatggagggcggcgtagggggggaggtggaccacctcgccggcgagagggccaccgcgcagttcgacgttgaacacatgaaggttgcctgggctggctcccgccacgccgtcgatgtcgccgaccgcatggcgcgcctcgtcgcttccgaccccgtaacaataactttctccctctttctttctttctttgcacagatagatagatagattatcaacttcggctccccggatctctgattaaattacctgtatgatgctcttcttctcttcccccaatccttctttccttgttcttcaacaaccacaccacgccggcccgattttaccccacgataataatttcatatattatttttagtttactagcagcagccagcaggagtatttagttgatactgtttcgctgacttgtttgctaccctaattattattattaaggagtattttttttgctagatgcgatgcgatgcgatgcttattccactgctcctgctctttcttccacacatatctcctcttttactattattagtattgtcactagtaatattatttatattctgctatagtgattttctcctcagatcagatctaccaaaaccttgtacccacacaaatatcttctactctcttttttttctgatactaaacattataatatagctagctgcgctacaagatcgatagaaatttctcagcaccatacattatgaatcatctccatatatgatgtatcagtaataacagtaacaatgtaccaattgctacgtgtttttctgtagcctcctctttgctaacaaatgctaaaatgctataaacaaaacaatccattacgctcacaatggtttccttacatttttgactcctttccaatctaggtgttccgcaaggataacaggactatgctccccaggaaggagctgttcaaggacacactcagaaaggcagcccatgcgtggaagcgtatcgtcgagctccgtcttacaggtcaggtcccaatcccgtgatgcttcttcttcttttattaacaactgatcttcctactcttaactcatgtaatggtgttgttgtccattaacagaagaggaggcaaatttgctaaggctatacgtggaccagcctggttatgttgatctgcactgggtactaatatcgaccatattatcttcactatctactccaatatacagcactgaagctgctcaattttatccacaagctcgattaattaatagggaacaatactttgtgcaaaattttattttgcagggcatgtttgttcctgctataaaaggccaagggactgaagagcagcagaagaagtggctacctctggcctacaggttccaaataattggatgctatgctcagactgaacttggtcatggttccaatgttcagggccttgaaacaaccgccacatttgacccaaagactgatgagtttgttatacacagcccgacactgacctctagcaaggtaatactcctatctactcttcctctcttatctattaagatgctacatttcttctttaatttggaatttcttcaatatcttgttgcatggttcatgattttatccccatgtgcagtggtggcctggtggcttgggaaaagcttccactcatgcagttgtgtatgctcgtctgataactgaaggaaaggactacggcatacatggtagagtctcttgtattttgaaggtgacttttaagcagtatctttctttttgcgactcatgactatctatatatcaggtttcattgtgcaactacgaagcctagaggaccactctccccttcccggtgttactcttggtgatatcggcggaaaatttggtagtggtgcatacaacagtatggataatggagttctgcgatttgaccatgtgcgcatcccaagggatcaaatgttgatgaggtttgtccattgggttatcatgttttgttcgggcacttgtcaaatacattctgataccttgatgtaaccattctcaagcacacccatgctactcgtgtaggctttcacaagttacgaaagagggaaaatatgtgcactcagatgtcccaaaacagctgctttatgggacaatggtttttgttcgtcaaacaattgttgcagatgcttctaaggctttatcacgtgctacttgcattgctgtaagatacagcgctattcgaaagcagtttggccctcaaactggtggccctgagactcaggtactatgtcagatttgaatttttttttgtattaccacttattaatttgtttttatgctcttgaaacatttcctgtgacatgtattccttttgcttttactggaaaaaccattgtctgagttaatatttgtactttgttcatctaaaagaattaaattgataaacgagtttaactttttgctaccaatgacaagtggctaatggtctataatggttacaggtcctcaattacaagactcagcaaagcagactctttcctttgctggcttcagcttatgcatttaggtttgtgggtgagtggctgaagtggctgtacacggatgtcacacataaactggaagccaaggatttctcaacacttcaagaggcccatgcctgtactgctgggttgaaggctgtgacaacatctgcgacagctgtgtgtacaattatttaattcagtaccacttttaatggttatacttgctgactggtcatactaagcctgcaaattcatacttttgctttatcagtacacatccttaaaatgaataatggtcagatcgcatcaatgagtttacacgcatagctggtccaacagtctagccagtttatataacgagtgaattacacaattttcattgttctcaaacctgtttttttttaatgcaggatggaattgaagaatgccgaaaactctgtggtggacatggttacctgaacagcagcgggcttcctgaattgtttgctatctatgttcctgcttgcacttatgaaggagacaatgttgttttgctattgcaggttagtatgctattgttgttttgttctgtggatactaataactctcctacctgcttgtggttgtgtggatggcctagcttgttgggccgaatcataggtccagtccttcaagtttcctcagttttggtcaatttacagtcataacctttggtgctctctgcaggttgcaaggtttctaatgaagactgtatcccagttagcttctggaaaacagcctgttggtacaacggcttacatgggcaacatacagtacttgatgcaatgcaaatgtggtgtaaatacaggtatatagttgtatcttctggcaggctcctgttttagacagctgtatgccagtcatcactgtacgttatgtatatatatgcccattgctgggaagccattgatgttgagatgaatgccatagtgattcatttttccatgattatcgacagctgaagattggctaaatcctgctgccatacgagaggtatttgaagctcgggctctcaggatggcggtgaattgtgcccagaacataaacaaggcgccaagccaagaagaaggttggtattgcgccatatgattattaatcgagaataaaatatagaacagaaaccatagtgcatttgcatgtagtttcgtattaatttccgtggtctattataagaaattgcatagatgatgatggtgtgcgttgctgaatatgcagggttttatgagctatcccctgatctgcttgaggtggcggtggcccatatccagttgataattgtaaccaagtgagtattgcctaggatgaaagaaatctgaagtatggcttcatttatattttattggcatttatttatttcggtgtgttatggtacgtataatggttaggttcatagagaaattagagcaggacatccctggtgagggagtgaaggagcaactgtgcatcctttgcaatgtgtacgcgctgtatcttgttcacaagcatctgggtgacttcctgtcgacggggagcatcacagcaaggcagggagcgctggcaaacgagcagctgggaaagctgtatgcgcaggtatggtgtcctccgtcgatgtcaatgtcaaaagtggatgagaaactgagaaatgagacaaatgcaaatgcaggtgcggccgaacgcggtggcgctggtggacgcgttcaactacaccgaccactacctggggtcggtgctggggcgctacgacggcaatgtttacccggcgctgtacgaggaggcgtggaaggaccccctcaacgacacggatgtgccggacggttaccaggagcacctccgccctctgctcaagcagcagctcaagctctccaggctatgatcatccatccatcatcctccctttcttgctctatcaatcatatcatactgcatacgatttgagtagtagtaaaataacaccagcatatgcaaggtgctggctggctgctagtattttctttttctttataatttatttatttggggagagctggtattgtcttatttatttgggaagagctggtattgtatgtctggtgatttggtatagctgtaactgtgaacttcaccacatctcccccttctcaagggcatatgcattctactcctatggctgtgtttagttccttccaaagttgaaaatttgggttgaaattggtacgatgtgactgaaaagttatgtgtgtatgataggttgatgcgatggaaaaagttggaagtttggatctaaacacagcttatatgtatattgtgagattgtccgtgcggcgcttctagtgtgaaatatcctcccttgtcgagcatattaacattgcatgtactgagatacctcagtgtccctgaatgctgacacaacttgaacccaacgttcgtgctgcgatgattcagaaaaaaacacaaaagcacatactcctaaggttgtacagaacttatatagaatccaatgtcaggttcatcctacattcatataggcaagttatattactagtacattcagtcaaaaaaatattactagtacatgatgaacaattccaaccgattatttgtttattgacgtctttgattattttggtatttcaacttctgtatatgtttgtgcaaattcacacaattaatacacttatgattgttctgaaattttaatcactgcaacgcggtgaattagactgtagggcaactgttcttttcggcgacttggtcagattattacgtggaatactttccacttgctctacgcctttgaaaatacgttcgttctctcaaaacacctttttttttctaccacgatgtttagactaacccatttcacattgatctacatatatatgtttcgtggactatgtgcctataaattcatatggatgttagtgaatctaaatgaacaatggagatgtctagcaacgtgaaacggatagagtattttgttaagtttattttttaaagtagtagtacttaatttatccctatacaatcgagtagataaatccgtgttttcaaatgggaagacaaaaaaaatgttttcggcaccattttcaaggcatgtattccatgtttttttagaaaggggaaaactcaaattattagggcaatataaaaacttaaaatacataaaagatactagcgtttttcattctctattgaaaccttggggcaaaatagaattttgttattaaaaccttggagcaaaatactaagatagtccaataagaaaagctttaaaataaataaatgaatgaatataatcatcatcatcatcttcccgcttatcctgtcgtggattggagtccgtccaggtccaggtccagtgtagtcgtagccatggcgggtttggctccccctcccctcctcctcctccccctctcctcctcactctctcctgccgccgcctcccaccacccaacctcccccccttctcgcacacgccgacgacgccgcctgctatccgccgtggcgtctgccgacggtgatgctccctccccagtctctgtctccgcctccgccgccaccaaggggccttcctcctcctccgtgctcaccttccagcaggccatccagcgcctccaggactactgggcctcagtggggtgtgccgtcatgcagtgcagcaatacagaggttggagcagggaccatgaatcccttgacattcctcagggttttaggccccgagccatggaacgttgcgtaagtagaagacttcccttccttgtattctggactactcctccatttctcactgtattattcttctagttatgtggagccaagtataagacccgacgacagccgctatggggacaatcctaataggcttcagcgtcatactcaatttcaggtaaatgtttctaccataccatatccatcctatatatttagctcattgctgctgccttcctccgttatttaatctttcttttccgataggtaattttgaagcctgaccctggaaattcacaagacctctttctgcacagcctttcagcactaggtatttcactactgctttctcttttttttcatcataaaatgcacgccgatattcttctgtttctaccttctcatttatttatttcctttcctaatacattgttgtgaatacaaaatgttgtatataaatgtttgcatcacaggtatcaatgtccgtgaacatgacatccgttttgttgaagacaactgggagagtccagtgaagttcctcctcttttactctttccttcttaaaatatcaaccaatgcaatcattgaaccaaagtgtatctggttacaaaaagccggatcgttatttcaatataatgatctttcctttaaaaaagtctatctggttaagtcatcataattgcaactgaatatctctaattcattaccttgttcatgtttcttcccattgatggacaggttcttggtgcgtggggattaggctgggaggtttggatggatggcatggaaataacacagttcacatattttcagcaggtacaggcgttagctaaaacaattcacatatttttagtgcattatgttgactgctttggcatcacagtatttttttgacacttgatgtgtgtattatccccttctaatccttggaaaattttaagacagtttttcttaatgctaattactgtagtcaggaagccttccattgctgcctgtttctgttgagataacatatggacttgaacgcatcctcatgtctcttcaggtgagcctagtagtgttgttatctaccttagtagttttttatgagttagaagatgagcaaacgattaacaaactacctattgattttgttgattgtgtatattgcaccctttatgttcagagtctcgtataaatcttagtggactttcttttgcgaatattttctaccctactggatcatataccctttgaaagagctgaccttactttgatttagatgttttgacagggtgtagatcatttcaagaatatacaatacactaaaggaattacatatggagaactattccttgagaatgagtatgtatcttcttgaaagttctaggagctttgtgtaccttttcttcttctttagcatcttgcctgcaatgtgccatttctttcccatcctctttttactacattaagtagaacaatttcgtgatatatttctgttgtcttttattgattataaataattatatgcttaggctcaatactatatatctggtttgttgattcaggaaagagatgagtgcatattatttggagcatgcaaatgttgataacattcaaaagcattttgatgattttgaagaagaggctcgctctttattatcactttggcttcctattcctgcgtatgtttgattgatgcactcatttcttggctttcatgttttatttgttaagaattgacaagctgaccttcgattggcaatggattaggtacgatcatgttctgaaggcctctcatgcttttaatattttagattctagaggctttgttggtgtaaccgagcgtgcaagatattttggtcgcatgcggaggtgtggacctacataccttgatttttttccctatgccttttctcatcatggaatcctggttttgttgacttgatttatttatttaccagttattagctttacttttttcagttgttcttgtttctagcttctacgtaaagttaagatgtaattctcatactgtcgatgctcttgagcagtcttgctcgccagtgtgctcagctttgggtgaaaacaagagagaacctcggttatcctttgggcacttatcaagagtctaatcttatctatcctcatgtctctgaaaagcctagtagaaaggtatttcatttacatgaccatgtactattacttgtgttattttaatatttgaacccaatgggtgtggatggcttatgtcataacttctgcaaaagcacacccatttttacttatctttggtgctttttgtttagggagttgtcggacagccacgagcatttgttcttgaaataggaacagaagagttgccacctcatgatgtgatagaagcaaccaaacaggtaaaccaaacttcctccttcacccttataagatgagaagaattttgaacctaacattggcaaaatgatgtcaccttttggtcatatttgtttttttatggaatttatacttcaattctaggtggaatgacttttgcttttttcacctttgaatctttgacatcctccagctggagaaatctttaattcaaatattggagaaacgaagactgagccatgggaaagtacgctcttatgggacaccaaggagattagcggtatcagtttaacctttgttgtctcacatgagttttttttttcctagcgaagtctcacatttgtttctatactatcgcaagcttcctcatatattcttgccagttatgcatctcttgtgtctaggtgtgtgtttggaaaagctggccagtcctaacattccggaggcctggtgcagaacaacaaactgtaataatagtctaccaagtgcaaaacacatgatggagagatatctaatattaatcagtaggttccctataggtttgttagtaggaatggtagataaaactgtctgaaaatacaaaaaagaaatcacataatgatgcaccatatttaattgaagatatatcttggtaatgcgtcttttatgcttggtaactgacaattcttttaacatgctttactctggtctgaatctataagaagaccttctttgatttgtaggttgttgttgaaaatcttaatatgaagcaaatggaggaagagattgaactacgtggtccacctgttgcaaaggcatttgaccaagaaggaagacccactaaggttagctatccaaaaaggagctggactttcctctgctcttctgctattgcttatttttagggctttccatatcacttatgaagaaaatggtaaggtacttcaagtatgcagaaagtcatgctgaaagtaacatctattccattaaattacaaaaactgcacactgtttattatttttctccgttcttattaatgctgttgaagggcttttgtttctttgattttcttccttctattctcatgacaggctcttgatatttttttgtggaataattttctactcttattcaggctgctgaaggattttgtcgaaagaataatgtcctgatagatagtctatatagaagaactgatggtacgcgacatggttccctagaatttgtattgcccacttccatctcaatgtgttttgtcatcactgctacagtgcgtgttggttactcaatggtgatctgataccatctccatttcttgttacaatttgttgttcgaatcattatgtggagtcccatgtagaaacgaatccacccttataattaatgatatgaaggtctcccattgttctacagtcccatgtagattggccttccttgggtcaatctcctttgcttgctgcaccagtcgtgtgcagcttgttcctgtcacatgtgcatatgctgcactggcctctcttgcatatcttattctggtatttgatttaattagctagatatggaagatatactcatatgcatgggtgatggcctatatatgtaggcggtatgttcaatcgatactggcatgattaaaaacatgtgttaagaaacgacctatggtgggcgggccctcgtgtacgggttaggggcctcaaagcacgggttaaggcccgaacgatggggggcaggtctgcgtgtcaaggggccagggtttgtggcatttcttgaccggcttttgctgaggtttcttcttagcgcaatgccgtgggggtggtctttcccccgtcagtcgagttctttcttttttttaattatttatgctgtcaataagattcaattctcaattgcttatgctgcataaaccaactgacagctaaatactgggttttattttggttatattaatccgaaccaccgctacagaacataggccaaatgaaatcatgttagttgttagcctgttacagccaatttatcatttactagatgtctaacatatgttcttattgtttcataaagaggtctaaattgtgaatacacattttcaggtaaaacagaatatatctacgctcgggtcaaagagtctgcacgttttgctgatgaggttttttttcctttcctttatgtactcttgaaagccattgcatcagacaattgctggaagcaggacctttgctattgcttgatgacttcatgaactgcattttcaaaatacaaaaggtgtcccttttaagttactggggttcagggaatagactttttgctcgacaaatcaacccagtcgcattatgtttagtactagctctttgagccagatggacagtcatcaagattaagcatacttactccataacatactattcaattcaagctccacaactcataataggcatgcttctaatgcttgaaaggacgatatcttctaattggatactgataggtgatgattaggcaccatttagatagatcttgcactcaacaccccaagacatccagtacctagcaagtatcaactaaatgcattctgcataactgcatagttatatattcgtagtttctttactgctaaaattgtgcaagtttcttatgttatttaggcctcactttcattttttctagacttgttcaatagttgtagcatgtgaattgcaggtactaactgaagatctaccgactattatatctggtatttcatttcccaagtctatgcgctggaactccaatgtaagtgttatttaactcatcttctttacagatggtaattcaaatgtttactttgcagctgcttgaactccatgttatcattattgtgctttgagggatcatagccatctataaatgctctaatgccatagcagacagttaaaccggttgattacttgattatgtgttagtgtctctatttctgcaaatagaagcaaaatccgatcatctgtttgctgtttttagcatcattttatcactggagatgtctgttttattccaactgagggtgaatcacttgcagattgtgtttagcaggccaatacgctggatctttgcccttcatggggatctcattgtgccattttgctttgctggcatatcaaggtaatattttactacataataggtaatgcacttcagtttctgtttacataatgatacgcaaaacttcccggaggaagaaaaattctagattgcactcgagccaatttctgggcttctcttttaagatcttgggaaactagaataattgacttatcacaactacagtgatactatccattgccataatgtgtacaatattttgtagaaatgaaaacattacttgctataacaattttttttagcttaacatgtccacttatttatagtcatttccttgagaaatattgtttctcacagttataattattaacatgagttgcaatggcacagtgggaatcagtcgtgtggccttcgtaactcctccttggctaactttaggtaccaaatgtgttgtggtagctagctggttctgcgcaaccacaacaaaatggactttcttgcattattgttttcattatcttcatgttcttcgggccagattgatatccactatataaaaaaatcttcaatttcttcattctgattttcttatctaagagtattgctgcataaattgaaaaattgaaagtattttgcatcaagcagttcggaaaggcctttgatccagattaactcaaacatccagtaggaagatgctaggacatatttgtttctatctattcttatatcctgtctnatctagggaatagtctgaacattctccaaattcaggtgaaagctgcagaattatatttacacaccctggagaaagctgggatcctgattgatatgcaggtgagatgggcacacataatcttttcatgtgctatgtcatgttttgacttttcataggcttcgtagctgtaagctccatttcatgtactatttattccacacaagaatattggtgccaactcttatagcctgcatgaaacagggaaaatgctgcatgagtccattaatggtttttagttgctcagtattccaggtcctactgtaccttatgatgtatatgataccccactgcaggagcgcaaacaacgaatcttgcatgactctagtatattggctgagggtgttggcggtgatatcattgcacctgatagcttggtgcaggaggttgatgctcttctgctcctcagttaacttttcttgtacatacgtttttcttgatgaaattcaacttatttcaagatatattttaaaccatacgatgcaggttatcaatcttgtggaggcgccgatgcccattattggtcgatacgatgtttccttcttagcacttccaaaggatgtattaataacggtatatgcacagcttttgattggtgatgtgtagaagccatactaaattctgttaatttttttgattcagacaccaaaatgacaagtccattaacatagttcatttgttggaagttaaatttattaactgagagaacatctcatattatgtatgtttatgcaggttatgcagaaacaccagaaatatttccctgtaacctccaagaccatgggcaatctgctaccatgtttcataactgtgagatgatttttcccgttgtgtatttgtcttcttcgtcttcttgttcctttttaatttagtgtttgctgttaggttgccaatggtgccattaaggaagaagtagtccgcaaagggaatgaagctgtactcaggttatgaatgttttagcaatgctactgtgtaaaatttatagctggagctttgactggaagacataattctagataatggatagaagtagccatagtttgattaccagcattatgtttgcatcgtcttttcttccctctgcctttttttttattccgcaagagagctgtagtcaactgtagattttttttttgcgaggaaccgtagattctgaattggtatataaatacagggcacggtatgaggatgctaaattcttttataagatggatacgcagaagaaactttctgaattccgagatcagctcagcagcattctctttcatgtaagtacggtgtaccaaaattctcttagtttcttgtatatgtttacgtacataacatctgcatcatgttgaacaggaaagacttggtaccatgcttgacaaaatgaaacgtgttgagaacactgttgcagaagtggccctccttctcggaattaatgagaaaatgatcccagcaatcaaagatgcagctgcattggctatgtcagatcttgccactaatattgttactgaatttacttcacttgctggaattatggcacggcattatgctttgagagatggcctttcagaacaggtttctgactttgttttgtggtgaaaattttgttgttaaacttcagtgtgaaagttgtggccatttgtgcacatttggttgagtagttttcatgtcagattgcagaagccctatttgagataacacttccaaggttctctggtgatgtgttcccaaaaacagatcctggcatagtccttgcagtcactgacaggtatttcttgcatacgtagctttcatgttcaatttataatagtctgcaccttaaaatacaggctgggaattcaaagagccatatttttaggattctgtgccactgtattatttctgtacagttggtatagaggagagctgctccgatttctgttctcttggactggggattacagtgggtgggcagaacagtagggactatgcagctatttagttagttcacatagttgaaagtacaacttcttaccagctttatttaccagcaatgccaggataaaacaaacaaaatggtattgcaatgcaaacacattgtggaaactgagagcttcccagatttatgattgcttttgttttttccatgtgaaccacacaaattgtagatgctttaatatttttcttatttgtaattcagattggatagtctagtgggtctgtttggagctggatgccaaccaagttctacaaatgatccatttgggctaaggagaatttcctatggattggtaagtgaagttgagaatctacaaacaccatcatattatgaaatattcttataatatttttcatctaggttcaaatattggttgagaacaagaagaactttgacctcacgaaggccttgaccttagtggcagaggagcagccaataacaatagatagtggtgttatagatgaggtgagcacaaatatcaaataatcctgatgttaatctttgttgattatatggtttgtgtcaactctaattaatttctcaggtagtacaatttgtcacgcggagattggagcaacttttggtacgtatttccttgaacagtaataatagtctgagttacatataatgcttttattccccaagactccatccttttggaatctaccaaggattagagtagaagcttacctacactggaagagcaagtatcttttcccgtacagactggttttagtgacgttttctccctcgtacacaagaaattccgaagataaatatgcatactatcattgcttcatgtttatccatgtagcttattcagcatagtaccgagcatggattttgttgccatctctgcttctgttttcacttctgatcctttttttttatcaaatacaagtcaacaattgtcagtgaaatccatttcctgtaactgatggtttttcgtcaatttatcaggtggatgaaggaattaattgcgagatagtccgttcagtgcttatagagcgtgcaaactgcccttatctagcatcacaaacagcaattgaagtaagattcttcaattcttctgaatcctctgtatgttggatatggttttcaaatattacgtatttataatcaggaacgatatactatggttgtacagtgttaaattatatctgcttggtactttgctgaatgaatggaagtatgatttgtttttttttaatggtcttgatgtgtggaccttgcagatggaagcattttcaagaactgaagatttcccaaaaattgtcgaagcgtactcaaggcccgcgagaataatacgtggaaaagaaattgggtctgctttagaggtaacggctgctttgtacaaagaataaacaagtaccatgatgatatatctttcagattctgattacagctttgaattatgaactaagcttttggacagtagtatgtaccgctaaccagtaaccaagcctattgcaagcagagtttgattgttccttgccgcaatgttaatctttcctcgctgtgaatttatatgcaggttgatgcaagtgtatttgagaaagacgaagaaagagctttgtggagtgcctacttggaggttgcggataagattcatcctggtacacaatcttatccaaagtgaaaaataatccgagatccactgtttcttctgttgatccttttttctctcgtgtgaaatatatgtgctttgcatcgtctattctttcgggcgtgctgtatattctgtttacttgtatccacattccaccctgtaggtgttgacataaaagcctttgcggacgcttctctggaactgctgcaacccctagaagatttctttacaaatgtttttgtcatggcggtgagcttaattttcgagtactaagcatctacttagccatttattactaaatgatttagactttggtaatggtgtatgctttgctatgtggttggtgatacaggaagacgagagagttcgtaacaatcggcttgcactgctaacgaaggttgcgagtctgccaaagggaattgccgacctgtcagttttaccagggttttagccattttttgttgctcttctagttttatctgtaccatgcttgtacattcataccgactacagttttgcagccaagaaaagagcgtgatccctatatatataatgtataggtagctagcataaattgtcctcaactttgttgtccattgctatgttaaacatatgtttttgttttcaaaccattttggaaatcaaatgccataacttgtatcagactatataccaactcaagcggtatcttgcataaattccattctattccctttccctttgttgtttcatccagatcgtttccaggcttttcagttcttccaatttctgaagtacccacgaccaaagagaattaaacaatgagataatttggttctgatgaactggcgattagagttgttcgaagcacaatcatccttataaattacttctactacaatgtacatcaggagaagaattgattaacagctatatgccgctctagaaaaaaaagaaaagaaaagaagacgaagcaagtagctaccatcagatcagtaaatacactcaattttgtcgagatacaacacaagtctccgaaaactgccaatcaattacctccacttaagaggtgtatgcaatacatctgtgcattgtaacatactgatataaaaacaagatatcctatatcttctcttctcttctcttctcttctcaccctagagagatccactacacctcaacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13047 - DNA, 563 bp, Oryza sativa
tcagcgtcctcccccgcgagcggcgacgggggctctcccaccactggcagcgcggctgcgtcctccctcaccaccggcagcgcggctgcgtccttccccaccaccggcgcgcggcggcgtcctcccctaccaccggtggcagggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactattaaaacgaatagaaatcgaattttttgccgcgcttttttccgccctttttattttttttttgttcgttttttactttttactaaccttttttttttgccacggaatcgaacagacctctgtagatgtgaattttttaagtagggacaggagtagagatac

SEQ ID NO: 13048 - DNA, 800 bp, Oryza sativa
cagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgactgcgatgtagccagccgtgaagaagatagcatcagtcggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgttcaggcggaaacaccagtcggcggcggtcgaggcggccggtcggtgaagacgtagatgcccaacaacggcggcataaaggccagccgttcaggcggaaacaccagtcggcggcggcgaaggcaagccggtcggtgaagacgtagacgcccaacaacggcggcataaaagccagccgtgcaggcggaaacaccagtcggcggcggcgaaagcaagccggtcggtgaagacgtagacgcccaacaacggcggcataataggccaaccgtgcaggcggaaac

SEQ ID NO: 13049 - DNA, 37412 bp, Oryza sativa
  unsure (1)..(37412): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttatatttttcatagaggttttagttactccttttcattacttgtctatgttactagttgaatttcagatatgtttcaattttgtcttgcttatttgcttggactactttgtttttgttttgcacattcaaattcgtgctgaaggcagatcaactattaacaacagaataggccaagcgatgattgggccattcgtcgtgtcactgaaatcagtatatcagaagttgaaacttcaggtgataaattggtgcatttttatgcatggtttactgatggaatgaatacagtaaacagactggttactctgaatgatatttctgagcacttggctgaagccatttgctcggggtttcctttatggacaaactaagcacattgaagtggattcatgatgtagtaattcactggaacaaaatgattcagataaataaggtccttcaattatcagtcctttctgatgaggaagtcatattactactaggtggaggctcatttctgaaaatatattcaagttctctaggtttgccatactgctaagggccatgttctgcacgtatcactaaccgttgcgtatttgaaatctgatctagatttaaacagtgggcagcttttttcctcatattgtgttttgtcatgcaacagaaaggtgtcttaggggaggaggcaatatgtaaggattgaggtatagagagttgagtatagagatggtatgcatgcttaattattcaggtcaaatcttggccacttctggcatatcattattgctgtttcatggaaaatgttatcagcaacagtgctccatggaatgatactattgctggagatcggaggcatagatcttacttggttaacatactgaagtttgactccggttcttgctgtgatattgatggcctttacctggaatgacagtgcctcatgacttgggaaaggaggctcaaatttctgccttgataacaccccccccccctctcttataagtaattatatgaagcatttgcatgtcaagtttcataatgcttatgcttggattccttttgctgctattatatagtatagtaattcgttgcaatccttaagtcaattaaatacatgtaagcaaagtgagtacatttaggcttaggaaatattcatgattcctgcagaatattgaactgttctctatgaaattatgtaaattcctgcgttccacacagaatatataaagttgttttccaaatatatatgcttgataactccaaatacctcagatggttttaattccatgataactccatgagagcctgagaaacatattattcatagcttgtataatggctacgagagtacaatcgattactaacagacagcatgatgcattttcttttctttctgaaagttccatcgcccaccatggcactcactggccaagctggtcctttatggacttgaagtgatgctgatgaatttgaacagattcctttcttggagattcatactcaaacaaaaaaaaaagcagtgtttactgctggattttcttttaaatgtttccatcaaacatgcgttggaaggggaaaggatatatttcctggcactaaacgttttgtctgctaacaatgtaatttgaaaatccattgttctcttgatgattttttttacgataaagtatgctatttgaagctaccgtttgcaacagtttcggatgcatttttttacatataagacaaaatacccataaaactgttgctaccttttctttcacagaaaattagggtaagcctgctgcatggattgaagttttgagcagtttgtggatgacatccaattgctagcttaatcaatgctgcatctcaaagaatactgatgtgaagattcttgcaagagtcttggagcacccatgctcttgtacatctcttaatgcaaatactcatgtggtaaactcttttagatggtttattatttggtcagtgacccagtgttgttcttttcccatgtattatgtttttagctaagagtggatttataagctgtaagaagcatgtgataaaaaaaattacatgtgaaattcaattaccaaaactcattcagaaactgtcttctgttttgccaaaacataatgaactttctatctataccctaactgtataaatcgtctatgctgttatatttcgtttaaagaaccctttgagaaatgcaaaggcaatcctgttaagtttgtttgcttctagtacattatattagtgtagtccgtatttgatcaccttgtgccaggttctctgataagtgatgactagtttttttttgcaccttctattgattagcctggctaaaatatgcgtgtccctgaagtagaactgatggagatatggaagggagtgaggcgatctggatctgctatggtccaaatgctgttgaaaacttaaaatctccttgttttcgttttgcatatatgacgtgagcacagctttggaattactggtaaggatttcagttcttttctgaaatcattaagtatgaaatatctgttttgaggtctgaagtttataagactgcatggcaagagatacaggaaatgtagtgacatgacaaaaagggaaatagaaagcatgaattatgttgatgaaaatgaaatttctgttacaacaggatcttacgatacagaatatctagtaaatctaagagaaagagcatcacttccttttgcattcaagtgaaagttcaaagccctgagacaagcaccatgatctgatctgtggtccagtaatgattttactttagatctttgcaagaagtgaaacttctatggcctgcccatcaattaaaggggccactagagcagataagcttcaggggctatttagtgattggcaaccaacaagttaatattgcctaactttattgaaaaaaaaatctaagttgttagatatttttccgttgctacgtacgtacagtggttatttccttttaactgaacaaccttgtattttaaattattagaaactgctcacaaaaatgtttagggcatctcattaaggattacctccaagttcacatggaggacattttaaaattttaattatccagcatttcttcctctctttttttattgttaagttttaagtggctttcttttaagttctttaggctttacttcctcagtccaaaaaaaaaaagtactctaacttctggggataaatctgaagggcgtagatctattctactgtttcaatttcacatggaggattaaaattactgtgcgtcaactatctcgccgtaagatactgttgagagaaacaggtattgtttcacctgcatttatatcacaagcaattgtctttcttttcacaagtgtttttctctcctttcaagctggtggcatgtgcccattattgagccatccatctccgctctcctctcttgcatgtgcagcacctccggttttttaacttgtgcataaaataatttcgatggatggtccctcttccatctcccttagcacaaacatcagtgcatgtgagatgtgacacctccatgtttacaatttttacaggcacgctcggtattatctgttcctgccaaagaaataaatctggagaaaactgattaccgagatgcagnccggagaagaagaagagcacccatacgcatccactgtagattcaaaggcaggggggcacaggtacgtattgtaatggtcgcagttggggagggtggtccgtcccctacggggttgatggctacctgctgcttgaatgcgcctgttggttttgaacgcctcttgatgctgcgttggagtcacgaccagtgtgtgtgtccctgtacaggagaagcgacgctgatgctctcggtcaatttggtccgtcccgtggcgataacgatgcccacagccgcagccgcaggggcagaggcagagggcatctcgtctcgtctcacccatgacgtcgtcccgtcgcagagccatcagttcagttgttgctgggttcccatccttcctgccgctcatcgagagatgcaggatgctgacgccgctgctgtgctgatcctgttcacttgcctctgcagctttgcactgatccacatcgatgataatactactcctatttggtcatttggtgtgcaagtgcagcaacaacttggcgtttcacaaaaaggtatgtcacgttcacgaacctgcatgttcttggagaatgtatatttttgtactggtagtagttgttgtgtactgatcaagcaaggtgtgaggccgtacgctggcacgtagtagagtggatgaggagagtattctgatcgtagtggggggggggggggggggggtaaactactcacggcctcctgccgggaaactacacctacccggtggtccaataatcccccgtaatatgttacgtgatggtcggtattagagctcatttgtttactgcatgcgcatcgaccagctctgcccccactggctgtgtcaagtgtcagctacgccaaaaacgtgagctctttttttttgctccaagtgcggggttagctatacctacttagtctgatctaagcacacttttctaccaaatctagccaatggatacttgggccttcccttcattttggaaaaagtaaagtaagtggccaacctttttatattgaaaggttttgatgaggcgaatttggatgacatgaatccaaaagcataatctaggaaaaaaaacagaatgaaccattagagcgccacgacttgttgaacaggattacaaaatcgtgtgaattgtaacaaaagaagggtttggagttcgtattagggagtgaggacttttatacatactgtcagtacaaacaaagacacttcaaaaatttgccacaaaattgaaaaggccaagtggcagcgcggcatgctcgtggtggctagcagccgtggcacgcctagcgttgtttcattgtatgttatgaattcatccgagttaggaagacaattttatctcttttaattttatacaatctaatttaagtggaataccaaatcactctaaatctttggaccgtttatattagtattatatactgccgataaattgtactgataaaagtatttttatttgttgctctaaatctttcgactgtatttgctggctgcactagtggtgcaccggtgctgagcgctgacacggtttttctgttctctttgctttgagctgtgaagttccccttttcctcccataatgatatgctttgcctgtattgggagcagcaaatctttgtggtccgacgtgagaaagaagggagacggaatctcgaatctctgcaaccagcctctctacctctagtcccggctcaattatacgcccatttgcagagtagcccccaggaatctcaacacttgctactcgtgcaacgcaaaggcttttaccgacgcctacacctgttgatgccctccccccaaaaagcgccgtgatgtcgatgcgttgcggcctgttccagttttcccccaatggcagctcggcaacgccgagatcactcaacagcactagcggtatccaagccacagctttcagtctttcacgcggtgcgtggaggagttgatcatctgcactctgcagcacaacaggtgttgcacagttgcagtagctggatatcacccgatcaggtgcgcaattgaactcccatcccctaacgccataatttcaatccctaacaaagtttatgttacaatgttctactccaatatataaagttgctaccgtttgtcaattcctaaggaggaagaaaaataaactaagatagaggatagagcgaggctagcaaatattccatacatcctagaatgtaaaaaacttttaacatttaaaatttatctcaaagtataacaatttatctttctacttcactctttaaataaattacaaccatctaatatttatttatgtaacatttacttcctcattttaaccaattataaccatcatttatttaattttatctatttttaaataaccatgctacccactaaacttcttatattttaggaaaagggaataattgttttgttttctactaagtagaagaaaaaaaaaggaaaagcacaggatgtcgcccactttgcttgtgttggattgcatgcatctttcgctcctgcccgcctgcttgtcctagggggcccacttgcagccccacagctgcaagttgccgtattatggtccttggcctgcactatgctggaaccaataataccaaatgtatactaataatatactagtacactcctgctgccctacgtagtaacgtttagcaatagtagcatagtacgcccccccccccccctccccattgacaggcaacaatacagggagggtagactaaaatatgatcaaaacggtttgcagcgaaagggacaccaactagcacacaagatttcatcagagcctgtctatcctcgtgttcttgtgaattgtggtgaagaggccttagcactgagtaagggtttgccttaccgccgctaaccgcgaggtacggtaatataaataccgcagtaacctctttaaattcaaataaattttaaaaataatttaaatttttgataacccataacgtcatcgtttcacccatgtcgggtatagggtacggtcattggtgcttagtgaagttgccctgcgctcatgccattcggcattccagcttagcttgacacaagtgatccctgaaagagtgatgaaagggttccaattcgtaccgctaagttcctgccttttcactcgaaaaaaatattcggataggagtatactatttcttcttaataccattgatacttccactaccgttctcatctaaaatattccctccggtcctaaatatttgacgccattgattttttttaaataggtttgaccgttcatctcatttaaaaaatttaagtaattattaattctttttctatcatttgattctttgttaaatatacctttacgtatacatgtaattttacatatttcacaaaagtttttgaataagtcgaacggtcaaacatatataaaaaaaattaatggcgtcaaatatttagggacagagagagtacatcctcaacttgaaaatacaaccgattaattttcacatgaatagaaaatatatcatgatgagttctttatatatatatatatatatatatatatatatttatcaagagattacggggtaactcatgcttcattaagtttacaaattcaaactgattggaatgtggctccatcgaatcacccaaaactacttgaaatcaactgtttccgctcgaattttgctgagctttaccaaattctaccgatttgagctagcttgcataggttgacaaacttgtagtggtgttttgaatgcattcgtgaacctgcttcatagaattaattattagagcatcacgagtagatgcgcaatatacttttcacttctaaaattttaagcttatcgatggaaagtttgctccaacagttttcctaattagtatcctaaaattttaaatcccctttcccttctggctctcaactagtgggagagagcatcggctccgagtccgcagcgatcagatcgtgcaggaggaagtgaaatcgacaacttcagttgatagtttgaattatctcttatagagaagtatcttttaattcttaaatcctcatttacgcgcgttttgtgcttcacatattaagacgctttggatttaaatagattcatatatgtatttcatatatatgtttaagtttatacttatgttaacataggccgtgtttagttgtaaaatttttcttcaaactttcaacgtttccatcacatcaaaacttttctacacacacaaactttcaacttttccatcacatcgttccaatttcaaccaaattttcaattttggtgtgaactaaacgagaaaattgcttatctaccatcgcataagatgggattcgctcaaataccatcactaaaatgggcttcactataataccattctcaaccaagatgtctttgctcaaataccatcccggacaaaaatgcccctagttcatcttcttcctctctccctcccaccctccagtggaggaataggtcgtcggcgaccaccaccggctccactacctcgtcgccgtcgcttgtgtcgtctcgagcactgcagccccgccccggctcgtcggctgccgtcgcgcaccgcctcactcgcgtggtctcggctggccgccatagtgcgccaccgccccaccacgacgcgccgcccttgccagtcgccgtcgccgccgccgccgccgccgccgccgccgcgcctcgctcgcgtggtctcgattggccaccgtcgcgtgccgccgccccaccccgagcccaccctgactcgtcgccctcgccggtcgcggtcgccgccgccaccgccgccgtgacgagaaagagatagagggaggagatgccccaactcatcgcccgccgtcgcgcgccgcctcgctcgtgtcgcctcggttggctgctgtcgcatgctaccacccttttccgactcaccggccgatgacgacctcgccccgacatggtggccgagacaacatgagcgacggcggcgcagcaatgaagccagcggtggtcaccggcgacctattcagccattggagggagggaggaagaagagctaaggggtatttttgtccgggatggtatttgagcaaatacactttggtagaggatggtattctagcgaagcccattttagtgatggtatttgagcgaatcctatcttatacgatggtagatatacaattttctcgaactaaacacagccatactcctaccagaaaaaccgatcctctcttgatcagaagattctcatggatttccagggccgcggagataccgcgtccaccaccggaggccgggggaagttctccccaagattgcgtcttccctgagcaaatcaaccggcaccacctttttaccctttccagggaagcatctccccgttttttcaccgatgcgcacggccgccgggccaggccaagcgaagccccagagccaggcaccgaagctgccccgattcccctcccttctcttcccccgatggcgtgccgtgagccaccaatggcactttccctggggtggatctgtgtgtgcaggcagcctggcgcaagttgaaggtgttgtgccaaatgaatcctgcaacagcagcgaactgttttgccgtgcccaccctttgtggtggtgtggtgccccgttcccttccattggtgtttctgtgggctgtgattgtgaaacacagaggagagaagagctagcaggaggatgacacagagaggtttatggcatgtgatgcttggttctttggtggtggacctccaactctcaattccctgctactgttgcctgtgtgacagccacacctccccatcagcatcagctgggggtacttgcaaggtacaacctccatttcagctaaactaatcacggctcatgcgatggcaagctcccattggccgcccagaggaggaagtaaccaactggactcgactgcgggtgaagtagtagtagagtgtacggtgtaggcctgatctcagaccggtcattaataaagtgtcatttgggtaaagcaagtactccggtgcttgaaatccgtaagacgaaattctcagccagagtgaagtcaatggggggaagcttcttattagaggggagtcattagcgcacaccacgtctgcttcaggttttattccctcaaaagcgacaggaaagagcagataaaaaccataattatcattaataaagcaagggtcaatgagagggtgaccaatgctaataccctcaactgaacactagagagccttgacaaaaaaaaaaacagagacaatatgctgctgctacgtgctatatctccaaataatacttgcatgacaataataacttgactaatagtacatcaacaaaaacggtgtctagctggtagtagtacccatcctgtgcctcctcccatagcacaggagataatcaatggagtatcaaatatcaattgtgaactaattatttaaccttggtcttggtcttatgtacacagatgcgaaatgcagagatgccatgtccaatatgcttcttcttcttcttcttctttttcttctatctcgtgattcttcttcttcttcttcttcttcctctcatcatccgggatacacggtagtagggagcttaatttagcagcagcgcaatgcctggctactgtgctgttactacttgtccttcgtgctgttgcgatcatttcgttttcagaactccattgatggttggaagcaagagcacgagttgcatctccctcctcgagcacaccaagagacgagagcattttcatggttggtcgtgggttgctgctccaggaacagggttgtcaaccgagaggctgcatcagctggccgcattgcatctgcaccagaacggagtcgtcgaggcggccgccgccggcgacgtgcgaattgccggcctcgatcttcacctgggcgtagggatggggcatgaagtggtggtgcccggcgccacggccgagcggcggcggcggaggcttgccgtcgacgagcacgccgaactgctccgagacggcggcggcggaggaggaggagtgcgcggtgagcacggacggcggcggcgacggcgaggggttgccgtggtcgtcgtcggggaggttgacggtggtgatgtcgtggatgctggagcggcgcttgtccttgccgccggagttgagccggatgaagtacttctgcgcgtggctggccacctgcgtcggcgtccggctcgtcacgaagttgcgggagatgttcctccagtcacctctgccgtacttcttcagccccatcaagaacaacctggaacaaaaaaagcctcaccaaattcagctccaagaacacgccatggcttcatcagcttggtccaattccatcaaagattctgagagttggggggtggcttacttgtgctcctcctctgtccacggcacgcccttcttgcgctcctggtcagggccgcgcgcgcgcttgccgccgaccatgtagcaggagcgcttgaacccaaggccggcggggtcatcgccgccgtcccagtcaagagtgaacccggagccgccgccgccgccggcggcgccgtagtgggggaaggggacgaggccggcctcgatgaagcagacgtcgttctcgaggtcgtcgtagtgcgtcatgacgtcggccaccgtcttgccgggcagcagcagcgccacccgctcccacctctccgggtcgttccggtcgagcgccgccagcgcctgctcgaacaccttgttctcctcctgcgaccacgctccgccgccgccgcgccggtccggcaagaaccacccgcccgccgccgcagcctggccgacgaagtagtgcgccggcgccggcgggagcacctccatgtacgactccttcatcatctccgcgaccgcgaggcggctggctggctggccgggccaaccgaccaagatttttcacctttctttctcaaaagcgagctcttgggaggtggaagaagagggggaggggagatggggggcggcagagaagggcggtatttatggatgctacagcatcgattccggcagatgccaaagtggccacagatgattcggcctccaccttgagacgccgcttaaaagaaatcgaggcgttcgttgattggcccttggtggagtttgtggcgtctcaaccaaacaaaagcctcctcctcctcctcctcggcttctctcactcctgcgagaagaggagggcagagcacaggagaagctgagctgaggaggagcttggttggggtttcgcccgtgtgcgcgtgtgggtgttggtccaggctgggagaaataataatagggaaacttggtgcctttcctgtgcagttgcaggcaacgttgcgtttctttattggccgttgcttgccgcttttcccaatgctggaggaggaggaggagtcccggcttgtttattcgtcccttcattcattaccaatagagacgatccacttctcatgttgtgctagcattttcggttggccaattcaagattacaaatcattctatcttttatctattatattattaaaacagctaggcatcacattctttgtggaggctagaaattcccacattaatcggaaaaaaagaaaaaaaaagaaaatgagagtccaagtagaagtacaatctaagaatagctatctaaaaatagctgaaattcggaattaaaaataagcaatattgaaagaagtttctatataagaacctaatacgagattaattaaaatttgaaataaaaataaaataaaatctaaaattagaaaagaaaagaagagtccaagtagaaatacaatttaaaaatagctgaaattcggaattaaaaataagcaatattgaaataagtttcaatgtaagaacccaatacgatattaatcaaaattcgaaataaaaataaaataaaatccaaaattaaaaaagaaaaggatagtccaagtaggaatataattttaaaatagctgaaattcggaattaaaaatagggaatattaaaacaagagtccatataagaacacaatacgagattaattaaaattgggaataaaaataaaaataaaatccgaaattagcaaaaacaaaagaagagttcaaataggagtacaatttaaaattagctgaaattcgaaattgaaaataaacaatattgaaagaagaatccatataagaacccaatacgtgattaattaaaattcagaatataaaataaaataatatccaaaattagaaaaattaaaagagagttcaagtaggaatacaattttgaaacaactgaaatctatactattataaaaattgaagatgtttttaccggtattttgttacgtcatccgtgtataagttggtttttaagttcttttatttttaaaagacatatccatcatccggtgaaaaaaaagcgagaaaaaaaaaataaaaaaggagaaaataaaacttctatcgtaaagaaaacgtccgactcctccggtggaaaaaaaaaaggagagacgacggaaaaaaaatcgatacaaaaaataaaaaaaggagagaaaaatttataccgtaaaaaaaagtccgactctgactcctccggtggaaaaaaaaaagagagacgacggaaaaaaaatcaagaaaaaacaaagaaaggagaaaaagaaaacttctataaaaaaaaagaccgactgactcctaaaagaagtccgactcctccggtggaaaaaaaacagaaaaaaataagagaaaaagaacttctatgtaaaaaaagtccgactccataaaaaaagtccgactatctgtggagaaaaaaaaggcaagaaaaagtaaaaaaaaaaaaagagaaaaaaaaacttctaccgtataaaaaaaataaaaacgttcgattccttaaaaaaaagtacgactccctcgaaaaaggacttttttgtccgtaatcttctcttctacttctactattttttttataaaaaatctctactattataaaaaaattaagatgtttttgccggtactataaaaatttaagatgttctattgtcggtaatttggtacgtcatcagtgtatgagtcggtttataaatttgttcgcttttgaaaaaatatatatccttcgagttggtttttaagttcgtccgcttttggaaatataggagttgtataagaaaattcgcatgctaactttagacgaacagactcctaaccgcagcttatgattttctagaaatatatagatccaagcgaattctcacagtgaatttcatcgtaactaaaccatataacaataataagactaaaatagttgtcacccgttgcagcgcatgggcttttcttttgaaaataaaaaataaaaatattaaaagaacacaatacggtattaattaaatttgaaaaaagaattctgaaattagaaatcaaaaaataagatttcaatttggaatacaatttataaataattaaaatttatgataaaaataaagaatattgaacgaaaagaccatctaaaatacatgacgagataaattaagtaacaagcctataatggagcagagtggtggcgattgatacgatatataaaaactgttaataaaacaccaaatagaatcctaataacgagagacgataggaaggccgtgaagcaaacgaacaaaacgattgccgggacttctaaaaagtaaaaataaaaataaacctcaatgataattatattcgatttttaaaatctcaatgacaataaaaaggagaagcagcgggcggggtgtataggagtatagttgcagagctgccgacggttgacgggacttctaggaaataaaaaaatgaattccaacgatagttatgttcaatttttagaaccacaatgacaataaagagtaggcggcgtacgggccgtagaggagcatagtagcatcgtttgacaaaacttctaaaaattataaaaaatgaaacccaacaagacaataaactctaaaaactataaggttcaatttttaaaagttcggaacttctaaaaagtaaataaaaaacaatgataatcatgttcgattttaaaatctcaatgacaataaagaaaggaggcagcgggcgagccgtagagaagtacaatggcaaagccgctgacggtttggcgggacttatagaaagtaaaaatgaacccaaacgataattatgttcgatttttaaaatctcaatgacaataaagagaagagatagtggacggaccatagaggagtataatggcaacgtttgacgggacgcctagaaattataaaaacgaaacccaacttgacaaaaaaaaactctaaaaactataagatccaatttttaaaggttctaaggagaatgaatagaaatagtggtagatcgaacaggcaaataaagaaggagatgatataaggggtagcaactggtgtgacttttaaaaaactatataattagaaacacggggatgataaggtttggtctttcaaactcttaagacaatgagatagctatttaataaatgttaagtaaaaccatactaaaactatatgattttatttaggtgctagccacgcaattgcgcgggccacccagctagttttattaaaatagcttggaaatgaagcaccacgttcgctgtggggctagaaattcccacattatttggggaaaaagaaaaagaaaaggagagtccaagtagaagtacaatttcaaaatagctgaaattcggaattaaaaataatcaatattgaatgaagtttccatataataacccaatacgagattaatcaaaattcgaaataaaataaaataaaattcaaaattagaaaaggaaaggagagtccaagtaggaatacaattgaaaaatagttgaaattcggaattaaaaataagaaatattaaaagaaaagtcaatataagaacccaatacgagattaattaaaattcagaataaaaataaaaataaatctgaatttagcaaaagaaaataaagaagagttcaagtaggaatacaatttaaaattagttaaattcggaattaaaaataagcaatattgaaaaaagatccatataagaactcaatacgagattaattaaaatttcgaataaaaaatatagtaatatccaaaattagaaaaattaaaagagagttcaagtaggaatataattttgaaacaactgaaattgaaaataaaaaataaaaacattaaaagaacacaatacggttgtcaatgtttgatgccgcgattccggtatttacatagtatggggatcgttggtactaggttatacgcgaggctgaggtaaaagagacggggatgaggtttttataggttcaggcccctgaattgtcaggtaataaccctacattatgttggccgaagtcggtattgctcttattcaccataatcacaccattaaaatatttggggtagcctatctaattgttgtcaatatggcggtctgaaggtctgactcgtagtcgacaacagggtagccttcttcctcgaatccgtgccccagagattagagatagcactttcgtctctcctgacagtatccggagacaccgtaagggactagccgtgcttatccctaaagtcgatatctggcgtcttgtcttggcttatgttggcttgtatgttgtggcttctattgtgccgtgtcttctatggtgggtctctcccctctcctcctagggggccttgtatttatacccataggtgtccccttatccaagtagaactagagaaaccaatatggatataatctgagtagtccttgtcgttttcatgtagaactctggttgtctttccttatctggaactcctcctatatctacaggttgtttccatataggacatggtagaactctggttgtctttccttatctggaactcctcctatatctgcaggttgtttccatataggacatggtatgtggtgggtcctgccgagatttagtcgactactattaggtatgtggtatccataaccccgacaacggtattaaatatttttttaaaaaaatctgaaataagaaaaaaaagatttcaattaggattaaaatttataaataactaaaatttgtgataaacataaagactattgaaagaaaagaccatctaaaacacatgacgagataaattaagtaacatatctataaaggagtagagttggtggcggttgatacggcatatagaaattgttaataaaacaccaaatagaatactaatgacgattaaaaggaggacgtcaggcaggccgtaaaacaaacaagtaaggcggttgccgggacttctagaaagtaaaaaaaaacacattgataatcatattcgaattttaaaatctcaatgacaataaaaaggagaagcagcgggcggggtgtataagagtatagttgcagagccgccgacagttgacgggatttctagaaaataataaatgaattgcaacgatagttatgttcgattttttgaatcacaatgacgataaaagagtaggcggtggatgtgttgtagagggacatagtggcatcgtttgatgggacttctaaaaattatgaaaataaaactacaagtctaatttttaaaggttcggaacttctaaaaagtaaaagatacaatcataatcatgttcgattttaaaatcacaatgacaataaagaagggaggcagcgggcgagccgtagaggagtacaatggcaaaaccgctgacggttttgcgggacttctagtaaaagtaaacccaaacgataattatgttcgatttttaaaatctcaatgacaataaagagaagatatagtggacgggccgtagaggagtataatggcaacgtttgacaggacatctaaaaattataaaaacgaaacccaatgtgataataaactataaaaactataaaatctaatttttaaaggttccaaaaagaataaatagaaatagtgatagatcgagcaagcaaataaagaaggagatgacataaggggtagcaactggtgtgacttttaaaaacaatataattagaaacacgaggatgataaggtttggtctttcaaagtcttaacaatgagatagctatttaataaattttaagtaaaatcatactttaaaaaatatatgatttttttttgctagccgcgcaattgcgcgggccacccagctagttgactgaaattaagggatatatgagtttgttatcaaaaattaatcaaaccatagtttgttaatctggtatggttaaattttggcacaccttggcgttaaaaaatttagtagtgttggatgtgtttggtttggtttatagtcttaacaaagttgtagtgtttttatgagagaagacttttggtatttagtttgttaccctatcaaaatttaaaaacaccaaaatttaggccttgtttctttcagcttgggattattataatctagattattgagtcagattactataagctagattgttataatctgtagtagaataagtggttagttgtttcattcctagattattagagcctaaattattgcgtttgcaagtctaaagagggagtggggtggcatggtgggtaatttttcacccaataatctggaaaaagctcacctaaatgagcttatcagattataataagctggcctccagattataataagctacttcaataagttgtctgtttctttcagcttattttcaataatctggattaaaataatcccaagctgaaagaaacagggccttagtaggattgaaattcatacttcctccatccttatctcatcatcacgaaagaatttttaaggtcttctccaattgatcagtctgtccatttatttgtaccatagtaaatagcattgttgcacgcctcacatgcatccaactgcatttgattgcatcatgtttgcatgccccgcatgcacccttgaattaggttttattgtcttggtcttgacaccatgtacaaataggacgatgaaaagggatggagggagtaataaactaaactaagtgaaaccctgtgcatttctatggaaatttagtatgataataataaaaaaataacatccaagatagctagataacatcagattaagtaaattaatgtggtttatgataatttaaatttaaatagtatgtagaatggtgattcaaacgtaaaaagtaaggtggtatgactttatggaagaagaaaagtaggaagatagtttgtaccgtagattaatcatctaaaggctaaaaacaattgatgtgatatgacttaattagagggaaaaggagaaagataatttggatcatatattaatcatttaagcactaactaagtaaggatgaactatataagtatataggatatcataaaacataataaagatatacattgaaacattatgtgaattatgttggatgataatttaacatgtttgtatttgaaaagctcttaattataaaaactataaagatatagcatgtttgcatgatgtttaaatgtgatgattgttagtggatgatgatgtgacatctttgcatgtaagtttaaggagttagtgagagataactttaagtaggataggccagaaggtagcaaccatgggtttgccactgacgaaggcgagctcctggacgcttccttcatattccctcgtcgttggagacataagaactctagcagatgacttatggattagggtgaaaatttgtggaagttagtgaaagaaattatacattagagtatgaaaaatgagtgaatttttaacatttgtcgtgtcctttgatctttaccatgcaagttgacacatgttgtgcctctatctttccctaaattaccatcgcatatccttcttgcatccgctttccctatgtttttctcacctcttctcttctctatatatctttgtcatgaatagcatcacctccttcgctatcttccgccaacttcgtcagaacgcaccaagccaaaaacacatcattaccggattactaatacaaccatttgtactatatataacccctctattttgggaaaaataagaagcgatgtttataagagcttagcttatcgaatgtgctatattttgaaacagtccgcacaagtgtgacgtttctattgataaagcaggagaaaaatacaagtctataatcctgagagattatagatagggaaaaaaatatacatccataccacgcgtctacgtctgatcctaatgctaaatacaggacaagcacacaacacccctaaggaatgtgttttctaaacgacgcctccaagaaggaaatgacaccaatagcaccgccaccgcccgtggaatgggctatatgataatggtaactcaattggacccatggtctccagtaacgctgatctatactcttcaactttgtcgttcaagccgttgcaaaattgggcaagaatcatccttagcggacacatgaatcatgctatcactgtcttactgatcgaaggtgtgacattcaattgaaattgctccaatcaacgtagcatagtcacattttttgcgcaaaattttacaggcgtacgtgcatgttttacctttgttttaatagaagattctaagtggacgtgtgttgtgtgttgtgtgtttcacttttatgttaatgcttgctcttgctgaaaacaaatgctatcactttattgaataaaggactaccttttccaaaacggtctgaatgaaggacgccaaaattctttgatttgcttcttaattctttgcacaagcctaaagctatttgaaatcagtggaagcaattatttatgttactttagtttccaattcagctctatctattctcaaaacaatttaggttgcgttcagaactacaagctcccatcatatgttctattgtttttcgttaacatacttctcaagttgcaaaaagaatatatacaaaagtttcataaagaattatattaatcaaatttttcaagtttttaactaatcatgcgctaatgaactatctcgttttatgtacacggggagaagatcccaatcccttcatccgaacacacgttaacatctttattcctctatgtcatctcgtgttgcatcccaattcaccttaattaacctctttattcctctatgtcatcttttgtttcagagggtcgtcttgtcaaatctcgggataactataggccaaatttctagccaaccgctactagaataacgaagatctatgccaatttcctctatattataaagtgttggattgatggttaagattaccaaaccacaatttggacaaactatagcttgaaaaaaaaaggagggtatatatgaccacatttcatgcagagttagctagccattaaaatgagttctaatatgcagagctatatgaaatttagaaaaatgaaaaggactccaagaaaatgtaagaaatgagtctttaaataaaacacccctagtcttaatttgagcatgatattctgaacctatcatcatattatagagcatggtgtttcatagtttcatactctctccgccacttatattttgggacggagggagttggacctatctatgtaattttttgacctactttattttaattaaataaattaaaatttattttaaatttgtacaaacatagtttatctatgtctatgaaaacttagtttacctagtttcaattaaaatgggcgaatctttacccacggatcgacctgagccatccctaccttgcatctatcgcgggaaggtgttgaaaaaacgttcaaacggcatctcacgtttggtggcccagttcacgtgggggaggaggaggaggtcctttttacaacgaatccttgtgttgcaacttgcaagtcctgtagttcacttatgcctctacagtgcaacagaaagggaaaacgaaagcggaaaaaagagcagagggaggcacgcaccaaactggggggctacagcaacgtacttcgtgccccgtaaataccccatacgaacgatgcgtaaagacctcgccaatcacatgtctatgctacctagtcttcctgaatcctgaccacacatacgagagagcagatagcgccgcgcgtgctcaatttacaatggtgctgccatgccttctctatgtgttttggtgcttaaacagagtccggtgagacgccgagtttgttatgcgagggggagagaggtacaaagagaaagaaaagatacaataggaaggagactttctcactctctccttcctctatcgcaatataaatacaacgtagcgtaaatgtaatacattttaagactataaatctgaacggtttagatccgtagtctacaatatatcccatatatactaggttacatttatattgaaatagtgagggtaatagagaagagtagaataatagagaagtcaagttatctgatgtaaagctgatgttacaactagtacatataaaaatatgttctgtatacatatatactctaatatcaataaataaacctaatatattctttgtgtgttttgtgtgcactctgttccctttctcttgcaagggcggagccaccatgattcctgggtattcccggaaatacccaacttttttttatcaaaaaacaagtatacttctagtatatacacatgtatacatattagtatacctaaatcctcaactctttgatccaaacacagctcaaccggtctcttgcgatgcctccaaccaactcaacccactccgtcatgacccatcagatatcagttgactcacttagccatcactcttccagacggccccctctcgctctccctccgtgacccacccctccctggctcggctccctcgcaccactccccatttgcaaaccctaggtggcggcgcggcgagacggcaaccggcggcgggagctggactgtgctaccgcggagggggaggccattgccgcggcgggcggcgggcggcgcccgacactccgccaaggtaaggcggtcaggtcggttgggtagccggtggccacgaggggcaagggcggccaacggcttagtgcttagacgggaatacccaactttgaaatcctgtctccaccactattctcttgatgtaggtctataccgttaaaactcctaggcaatggtgtcgagcggacgattgtagaagagccagcttcacttattagccttgctctaactggagaagatgagaaccttttcggtaaccacttgcacgtatcctaaatcacatctgaaaattttataatacccctattacaaataaatttatttatcaccaatctcacacatatcaagtcatgaaaagcaaaatgactaagatgaactttactttactaaatcataatgtaattgtttcttgctgcatttatcttccactttcataaagataaatcataatgattgcatgaaagatgaatttattttgggcaaacaaaaggggcaaataaacctgttttggacagagatgatattttggtaactttcatgcctctttactttggagagatattgcgttcatttcgtgtgattctagctagggttgttttaggtgcacaccatgtaattgcacgtttaaaatatgctgtgcatacattgatgatttgtgtttataagggaccaacaaaattaagctgatagagaggttgtcaactgtatacggaatatatatgtatggtacttgctgataaagttaattataagatcgtgtaagatgcgctacattagatatagcttaaacgaaaacttttttttatagaatataaatttggcgtgggctggtctgcctgttagcttatcaaccatggtaaaaatataaattttaaaaattatttttgtgattttttatcatagtttatcttttacatcgactttaaaccgctaaatataacacatatagttttatctataaattctatatctctactattataaaaattaaaaatgtttccgctggattttcggtacgtcatccatgtttgagtggatttttgagttggttatatatcgtctgtatccaattcgacgtgagtctaaaataagtattatacaattctatcctggcacaacccctccctgtcccagcccaacccaacccaaccggtccacaccatctcacgcgcctccactcggccccgcgcgcgcccctctcctgatcaacgtcttttttttctcacttttttctttttctccctttctttccaatatcctctcttttctgtttttttccctcatttttctctcatcataaatatttttttatacgacaagtttgctcttttgcaaatgcttttcatctacagtaaaaaaacatttactaatagaataatcaaagtttcaatatttggtccatgatgtatagagaaatggagtcactcctgttgttccccatcaaaaaatgtatagaaaaatgcacatgcgtcaacttatggaatagtcatccgatcgatttgtaaggctatgtaaatgtttacatgaggaattcttcgtgtaatgacgcaagaagcgagcgcaaccagtttcaatgttatatatgatttctgactttgttttgctattgttttgttggcctttttttggtttgtcatttaaattgacagagtttttatcaaattatgaaaattgtcttcacatgttgcaacatacaaacatttttaatagtatgtgtaaagtttatccccactaagtatagttaatgatatttctctctactctcagtaagccacatcatctcaattatttttagcccttggatgactgatctatagtccaaattgtcttactgcttttcttcacttataaagtcatatcatcttagttttgtctttggatgattaatttatattatcttctttctttttcttctcttattgagtcaaatcaccgtagtttaacttttgaacaatcaatctatatatgattttaattattataaaccgcataaccttacttgtttataatttttttcgatagttatcgaggagagatcgtcaatagcggggaatcgtgagaccccccatttgtgagttcggccgggggcggaggctcatctcttagaaatcactcgctcgtccctaggatcaccggcaagcttgcacgcaatcggattatacaggttcgggccgctatggagcgtaacaccctactcctgtgtttgggattatggatgagttttacaaagatttcttcactctaaaaagcgcactcgcttcctccctcctggagttttggttttttctccctctctcccctttttctttcttttttttcttgtctcagtgggcagggtcctccttttatagctcaaggggataccacatgcgccgcctctacctaccctctatcggagggggatcccaattcacttttcctgggctttaaaccgtgccttctccccgaagctaagcaacaaccgattctcgagtggaaccaggcgccgccccccgcctgacacgggggacaaccctgtcattccctcataaatgaacgatgacctgtgacagcccttcctcgagtgacgctcggacgtgacgggtcatacccacccccactctgccgggtacaagggtgacgtgaggacatggttgccctatccgtcggatgtgacggtgccaggccggtcacagaccggtcacatccgttggatagaggttagctaggcgcgccgcacgtctgcccttaccgcattaaatgcggtgagggacagttggggcgtcgcacatttatagctgttcagcctgtgctctcgctctttccctccgccgcgtggcagccgggtgagggcctcggggcgaagacgcgggatagcccgagggggtgacgccatgccccgaggccccccccctcccccccgcggcttccacgactcgcgtgacgcgcgaatggggctaacttgcagagtcacgtggccggaaggaaagtaattcccctctacttcacatacccccgggaccatatctccgacagtagcccccggtgctatatcaggtattgatttcctgagatcgttctgacatggcgcctcacgactcctcgagctggggttgtgggcccggcaggggatccaaaaggatatcaccgcgtggccaggttggcgtgccaaccataacagcagtttgaccgccattgaccgtgctcatgatgaagatacttgaggcgcgataatcccgatgggtcagtcagaccacgcctcgattctcccgctcgctactcgtgtggcggtagtggtgatggtttgctcaacctgcgctcatagccattgtgcactccacctcgaatgcgccactgacagacgcactaaaggcgggaacggatacaacgggcgacatgatgattgggcgcaagatgcgaagagacaaatgcgggcgcgagaatcgtgggggcaagtatgggagcgcgaaacgaggaggcaagtgcggatgaagcgaggataaaagggggcggaggcagagactctgcccccttcctttcgccaaccgcccactcgtcatttcgcttctcgaaccctaacattctcgccaccttatactgtctcgcgctccacgctctccgccacttctccgccggttgccatggcccaagacaccgatgacgcagtgcttccttcctcctgcatcacagcagacaggcaccttagccttcccttcaagatcatgccggacggtgccatcatgcgggcgggagagtcgcggccgcggccgcgatatccggagcgatccgtgcacctcttgtccttcgccatgacgggcttgattccgccgttctccagattcttccatgaggttctggatttctacgaaattcatgccttgcatctcgcacccaatgccgtgatgacgctggccatcttcgcgcatttgtacgagatgttcattggggtgcgaccgacgatgcggttgttccaggccttcttcattccacagctgttgcaaggcgcggtggtggggggatgctacttccaaccccggccaggcacagcgggtcagtacatcgagagccatctccgcaagaaatgggaggactggaagaaggattggttctacaccgcgttgctggaccatccgcgacttcgagttcccgctggccctcctgaaaggtccgctgcatggctggcgacttcggagctgggcgaggaatacgacgcggtgtgggatcgccttaggggcctgcggagcctgggtctcacgggggcgatggtctttggcgattacttccgccgccgcatcgcacctcttcaggaatgatcccgtggagcgtgggaatacattggtcccaacgaccccatgcggacgcatgtgggcgagcgctaggactggggtgcggaggacgcgaagatggtgattcggcgagtgctgggcctagactctgccgagccaacactaatcccagatgggattcttcccctctgctacgaccgcgaccgggagagcattctggccgtgatgtctgccgtcggcgccggtaggagccggtccagccgaggcggcgccagcagtagcgtcgtcggcacgggtggcggtggtgcgaccacgggcgggagccgggccggcggtacaggcggcggtggctcaagggcgcctggatcgagccacggacccggagacgattccgcctgtgacccaaaggggaaacggaaggtggcctattcccggccgccctctccactcatgcctttaattcctttttgctgtgtgcccgtagcaggcacttcttgtatttaggccattgtaccatcctatcttgttctgcaactgaaacttctttaacccctcttactcttttaccttttccattggatgcctgtgacatagagagaagaaaaaaccagggcaaaaggggataattagactgcctgcgattgacatgtcgttttgaccccccccctcgggcttgttctagcgagaagataaatccgcgctcggtccatggaacctaagtggtgataggcaagaccatcgccctgctggagccgcccagcgggactggccagaccgaggctgcgacgaccgggggtcggggatgaccgtatgtaggcccttccgatcccccggggttcggcacaacccggggcgcggcccgcgctcgtgctccctttcggcgattttcaggccgccttacggcacttagggtttagagtaaacacggattatcccttgaaccgggacaagccagaggaaggggagaaaaacggtgtccacaaaaaagtagaaaaattcattgcttgtaaaaggatacacagtggtagcccccggccagtcccgcacaaaccgaggggttgtgcgggggctggcccgtgctccaggaaagcaaaaaatctcgatgtcatggatagaaacgacggaggtgctcgatattccaggggttgggcagctctgtgccgtcctccatggttaaccgaacggagcctggccgaggcactttgatcactttgtatggcccttcccacattggcgagagcttgctcagccccaggcgcgactgaacgcggcgtaggacgaggtcgccaacttgtagtgatcgggcccggacgtggcgctgatggtagcgtcgcaggctttgttgatagcgcgcggcacgcaaggccgctccccttctctgttcttcaagataatcgagatcgtcgcggcaaaggtcatcctggttggcctcgttgtacaacacgacacgaggcgacccgagggaaagctcggagggtaggaccgcttcggcgccgtacaccaagaaaaatggtgtttcgcccgtggcgcggcttggagtggtccgattttcccacaacacggtgggcaactcctcgagccatgaatccccgtgcttcttcaggacgttgtaagtcttggtcttgagtcctttgaggatttcggcgttggctcgctcgacttggccgttgctcttggggtgggcgggtgaggcaaagcacaatttgattcccatgtcgtcacagtaatcgccaaacagctcactggtgaactgggtaccgttgtctgtaatgatacagttgggcactccgaatcgagacgtgatgcccttgatgaacttaagagcagaatgcttgtcgattttgacaactgggtaggccacgggccacttggtgaatttgtcgatggcgacgtacaagtgctgatacctgcctcaagccgccttgaatggcccaaggatgtccagcccccaaactgcgaaaggccaagatagtgggatgacctgtaaggcttgggccggctggtgggtctgcttggcgtggaactggcgtgccttgcaccgttggacccattcttgggcatcttgtaatgcagttggccaataaaaaccttgccggaaggccttttcgactaaagttcgtgaggccgaatgggctccgcactcaccctgatgagagtcggctatgagctcgatgccctgctctcgagaaatacacttcaagagtatcccgttggcggcacgctggtatagggtcccttctataaggacatactgtttggagatgcgcgcgagcttttcagcttctgcgcgatcctcaggatgagtattgccttcgagatacgcccggatgtcggtcatccacacgacctgatgaggggggtcagggttgaccccctcgggccccgaggggcgcgggtcgcccggagtcgggtcggtgggcgtgtcattggggtccctcaaagggctcggtcgcgccgatggttgtgcgagcctttcctcgaaggtccctggggggagtggggctcgtgccgacgcaacacgcgacaactcgtcagcaattgtgttgtcgcgccggggcacgtgccggagctcaagtccatcgaagtggcgttccatgcgccgtacctcgtggacgtacgcttccatttgcgagtcggtgcactgatactctttggatacttgatttatgaccagctgggagtctcccaagaccaggagacggcggatgcccattccggccgtagccctcaatcccgcgaggagcccttcatattctgccatgttgttcgtggctcggaagtcgagacaaacgacgtatttgaggacatccccgtttggcgaggtcagcgtgactccggcacctgcaccttgaaagttgagggagccgtcaaaatgcataacctagtgcccgccgcgaatgtcggcgtttggatcctcttcttctccgggaagggaaaaagggacattggacggaacaggttcgtccatcggggtccattccgcgatgaagtcagccaggatttgacttttgatcgcgtgccgcggttcgaactgcaaaccgaactcagccagctcgatggcccattttaccactcgtccaatacccttgtcacaccctaaaaattcaaaatatataaattgttgtttaattggaacttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagtccggcccagttcaccgccgcgcgcgcgcgtccgcccgctgacaggtggggtcgtcgtcaacctccggccgccgcagcccgaaaccctagtttcgcgccgccgccgtttccttccaaaatcctgccgctcctttccgtttccggtgaaattgattgaggggaaacaatctttgggatctcctctaccttttcccctttggaaacgtcggctaattcgttttggaagttcgtggaatcaagttcgattcggatcggtctctttccttcaaaccccgatctttccttcccgtcgccggccgccgtgggccttcgccgtcgcctcctagcccctttaaaaggttccccgagctctcctctacccgtcgccaccttcgccttcgtctctcgtcgtccgtagtgccctagcgccgtgtagcttcgagccgccgtcgtcgccgccgctccagccgtgcgccgccgtcgtttcagccgtcgccgtcgctcgggaaggtcgccgtagtgatcgtcaagtcgccgccgtcctcgtccgccgcttcgccgccgccgaagaccgccggagcaccgccgtcaccgccgacccgatctccgccgccgtttcaacctcatcgccgtcgccgtccgttgctcttccgccgcctttttggtcgccggtgagttcgccgcgtcgccctctacccgttggtgccctccgttcgtgccgtagtgcagccgttcgccggcgagcatgcgcgcccgagccgccgagccgccgtcgccggtggtgacgtcatcgccgacgtcatcgtcgcccttccccgtgagccggtcgtggaccgttcgatctcggccgtccgttttggatcaagtcgatctcggccgtccgttcgtgtgaaccgccgccgtgcgcccggtccaccgaaaccctagcccgctgacgcaataaatctctttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatgcttagaaacattagcacactattgggataacttatgactcactattattttaatgatggcttaatgattgttcacgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatagttcattgcggagcaccagactgagaagtggcggagataagcccacggaggtcgctggggagtccatgccttgtttataagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgtgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttagatagaaattccgggcgtgacaaccctctcggttgtgcaaaatttggccaacagggtatgtcgtcactacggaaacccgatgcgcttggaagtaatgacgcaacttccttgaggccattaagacggcgtaaagcattttctgggcctgcgaataccgggttttcgcatctcgaagtgccttgctaacaaagtagacaggccgctgcacctttcggcgggaccaattcgtgttgtcaggggctgatgactcggagcgcgcctgttcggaggtctcggggggatcccggactgcctcaggatgatgaggctcggggccacctgccaaagccaccgctcctcccttgggggcctcagggtcctcccgggggctggaaactttgggcgctaggccttcgggggatgagaggccattgcaagccgaaggggccacccgttcgccttcctcacgctcaactactaaggtggcactcaccacatggggggtcgcggccaagtagagtagcaatggttcctccggtcccagggccaccaagatgggggggaagtgaggtaagctttcagttgattgagagcttgctcagcttcctccgtccatacaaatggcccggagcgcttgaggagcttgaataggggcagtgccctctcacccagcctcgatataaatcgctcagggcggccatgcatccagtgacgcactgcacatccctaagcttgctgggggggcgcatcctctctatcgcgcgtattttctcaggattcgcttctatgcctcgggaagagacaagaaaatcgagaagtttgcccgccggcacgccgaacacacacttatcggggttcagctttacgcgcgtggacctaagactatcgaaagtttcggccagatcctgtagcaacgtgtcctggtggtgcgtctttaccaccagatcatcgacatatgcctctacattgtgccctatctgattacttaaggtaatacgagtcatgcgctgaaaagtagggcctgcattcttcaacctaaaaggcatagttgtataacaaaaggtgcccacaggagtaataaaggcggtttttcctcatctttcctagccatacgaatctgatggtaccctgagtatgcttctaaaaagcacaaaaggttgcaccccgcagtggagtcgattatttgatctatgcgtggtagagggaagggatctttggggcatgccttgttgaggtcggtgtagtcgatgcacattcgtagcttgccgttggtcttcgggacgaccaccgggttcgccagccactccggatggatcacctcgcgaatgaaatcagcctccaggagccgcgccacttcctccctgatgaaggcctgccgctccggggcttgacgccgtactttctgccggacaggacgcgcatctggccgcacggcaaggcggtgctcgatcacctccctggggaccccgggcatatctgacggcttccatgcgaaaacgtcagaattcgcccgcaggaaggagacgagcgcgccttcctatttggcggtcttggacggatcgtcgccaagggggatttccttgatgggcacctcgtcagccgaggtgaggcgcttcttggaagcgcgggacgcagaggcttctgggcctgcggctccgtggccaccgccaagttgtctgcgcgctgctccgcgcaggcgagggcgaccttgacatcactaaggacggtgatgggaccagcaggacccagcatcttcatctggaggtaggcgtagtgggtggcgaccatgaacttcaccaacgcaggtctgcccagaactgcattgtagggcagattgaggtccgccacatcgaagtcgatccgctcggtgtggaagttggtggagtcaccgaaggtcaccggaagctctacatggccaagcggccatgtgtgcctcagagtaacgccattgattgggagcgacggctggagcttcatccccggggccttgagcgcatcaaaggcagccggggagatgatgctcagactgcccccccatccaccagcacacgtttcatcttgacattgtggatgctcggggagaccaccagggccaactgcctcccccccccccgagcaacaaccgtcggatggtcgctctggtcgaatgtgagctttacttccgaccagcgcgccttccggaccgcctcatgcgtgggaacaacggccagaagctcccgcttcatggccttgaagcttcggcgagaggcgtgagcgcaagcccccccgtcgagcgtggcgacggtcccctgaggtatctggaaatccagatcctcaccgtctccaccatcatcggcggggcccttgtccttggcctcccctcgccggtcaccggttgaggtcgcgggggctttgccctcccgtcgaccctgccagttttcctcatcagcctttcggaaccgctcggccaaattcttgaccgagcggcagtcggcgagactgtggcggtaagtgttgtgtaccgagcaccacttatccgccgaccggccctcgccggagggaacagcggggctcggcttatcgccggtggcctttcctttgcgcggggcccgcgtgggcccgtctgctgcaaggacatggtcctcgtcatcggagcgggctggtttccttttgcctctcctatctcgccgcttagagcggggggcagattcgggggtagccgcagccgccgcaccggtgccgggggagttccaggcccatgcctcctccttccgggccaccttgtccgccagctcgaagagctcggcagtggtcttgggctccttggaggcaatcttctccagcatgcgattatgtcacacgccgttccggaatgcatatacaactgcgtgggctagaatgcacggaatagtgttgcggacctgacagaagcgctgtatatacgaacggagggactcatcatccttctgccgtacagcgtgtaggtccgcctcttcccccgggcggggatatgtgccctggaagttcgtaatgaactgctggcacagatcctcccaggagtgaatggagccggggggctgggtcatcaaccagccacgcgcctgacccttgagggctatgggaaagtaattcgccatgacccggtcgtcacccccttccgccacgataaccgtggtgtagatctggaggaactcggagggattgatgctaccatcatacttctccgtaaggttggggcgaaacttcgggggccaccgaacattccgaagactcgccacaaaggccctacaacccgtccccccaggggtgagtgtggggggagggccgccccatgaagaggagcgtggcgctccagatgaagaggcgccttccccgatacgggcagctcggcgctcgtctcggcgtcgctcgatgttgattcgagcgtcctgcgtcccgtagaggccgtcatgatgcctccggctttctgaggcccctgacgatgttagaaccgtggatcgcctcgagatcgtggccgattgacaagcccttcttcttgccgacgaggagagggtgaccgaggtacgcgacgtaccagcggcagcggatcggccactcgtggctaactgccgctgggcagtagtgaccaagttggccacgtcgtccagccaacgcagaacaggagtctccggctccgggttcaccgggggatgccgcagaagggcacctgctgcctgaagcgcgccttggggcgaaccgccgtctccatagtcgagacggcggcgtgtcccggcgcgtcgcggcctccctccgccagggggcggagaaagagccgaatcacccgaacgagtgagatcctccctccgcgaaggttcgcggcggggaggagttggagaaccatggcgatggtgacgaggacctcggctcgcgccggaattcccactcccggatggggtgggagtaaacgccaccgcctcctcctctacttccaggacctcaaccatggtcggctaaggcctggagaaaattgggacgaaagaaagcgacttcctctcggaatgcgcaggcgccccctacctggcgcgccagctgttgaggagagatcctcaatagcggggaatcgtgagaccccccatttgtgagttcggctaggggcggaggctcatctcttggaaatcactcactcgtccctaggatcaccggcaagcttgcacgcaatcggattagacaggttcgggctgctatagagcgtaacaccctactcctgtgtttgggattatggatgagttttacaaagatttcttcactctagaaagcgcactcgcttcctccctcctggagtttaggttttttctccctctctcccctttttctttcttttttttcttgtctcagtgggcagggtcctccttttatagctcaaggggataccacatgcgccgcctctacctaccctctatcggagggggatcccaattcacttttcctgggct

SEQ ID NO: 13050 - DNA, 30660 bp, Oryza sativa
cacgactcgcgtgccgcgcgaatggggctaacttgcagagtcacgtggccggagggaaagtaattcccctctaattcacatacccccgggtccatatctccgacaatagtagattagaaataaaaattatacagggcatgttcggctgcactacagcgagctgcgacagagccgccttgcacagtattttgtgtagcacagctgtgtagcaggcttgctgccgctgtaacgtgctgccgaatacagccacaaagtgctattttacaatattatttctattaatatctatcctacatgaaaaacatgtattggtggtggttgttctccaccactagcgcaaacctgacagtgagccctttaagtgggctagcctcccactctcccatagtactgtcatttcgctctctgttttatttaaaagaaaaaaaatcagtgtctatattcgtggtcttaagtgatataggtcgtgggcataaatttgacccattgcattatatcaatgacatgtgactaatggatggaaaaccacaaaaatcataaaagtgttgttcgctttggtgtactaggattgataaccctttcttccataagaaaatttgttgcaacgcatgggctatttgttgtcatataaaactttcgaagcaaaacgctggatttttttctagttactgattattttacctttagtttatgcgttcattttgacacggcttatgagccgtacttcaaactgataataactagcactggctagtactactattttccttagattcccagccaagaggatgccatcgcgtgatagcatacatagcatggtcctcctccctcaatcagattcttggaatacttgcattgcatccaagtttcatcggtgcggccttcttgtctggtcagaaactaacaccctagataaagggctagctaaaacctaagcgcgagaccgcgagagcgaaccaaagctatgctagccattattgcgacttggcaggatttttgacatcttggttatttcagaaatcatattttataaataaaacctctataaaacttaatgaatatggctctctacctcgattctataaatatgctagcgctgggatgggatgtctcggtgccgcatacactagtgcgacattgaacctcaacgccgatgttttgacgctgacctctcctacttaatgacaactctcattttttaaatttaaatactattgatttgctttcatattttggaaaaatcgaataaatcaatgtatcgtactttattggtttgtttatactactttagaaaaattctaatggtccacctcttctgttgtattgtagtttttacatattatcatcttctcaatatcgatatgctatcatattttagaaaaactgaacaaatcaatgtatcttaattcatttctgctagtttattttatttataaaaacttaatccatgaggagtacgtaggttcctccctcttccccatacataaatcctattaatttgctgtcaaattttgtaaaacaattacaaataatgtatcatcatatcattcaatttaccctatttgttttcttaaaatttgatagcaaattagtaggatttaggaatgataaggagggagggagccacatcctcctccaagattaagatttaatagaagtaaattagtagaaaatgaattaggatatattgatttatttagtttttcaaaaatatgacagtaaattaatttgatttggtgccgaaacccagcgtgtatttagcgccaaggcatctaacgacgtagggatgcatacaatatctttttaagctaatctatttctataaaatatgtttttaaaaggactaaaatgtcaaaaatccagacaacttgcggcctctccttcctttcactcttccactgcccaaaccgaaagttcccttggaccgtgtggcaccggtgcttttcggcgatgccactctccgttgtgcccaccggccggcgtcatcctcgcctccggctttttctctcccggcagacggcgttcgcttgtaatggacgcacacacatcaccctgacctcattccgatgtgtccatccatccaatattctcgcgccgacccttgtcatgctcggaggaaagcaaagtcccattcgatactcttctaaccaaactggacaatcatgagtcacaaagtttgtaactaaagattagttagtgtgctctgtcagttggtaactacaggagtgctcactgctttatgtgcagctagccagctaacatggcagcagcagcaccagtgccagtagatctctgttaggtgcttatagcaatagcagtgtgtctgtgagaattgtcggatctcacatgccacctagatcaagaacgtgttaagctacatgattcataatgcaagttacttgtagtaggtcctaccagtaccacatttttcacttttcatctctctcatctctccctttccccaccggtaccggaggaagtcaaggtcggagagagcaagacgccgagcggagtggcccaagcagcaattgtaccgggctaagtggcggtggctagcagggtggccctagcattgacggcactgggtggagcagcggcagggcgaacatcctcctctctttcccttatcctcttccccttccggtctcgtcctttggctacaccgagcccacgcagtggcggcagtcgaggagctccttagcagcacagccacgtggggcagatcgagctgatgcccgccctccctccccaactctggccaccaccatctgtgtgtgccataatggtcacaaccgacgagctagggacatatctggcaatgtcggcgtccccgctcctctcctctctccagtctcatcccttggctaccctgagcccacacggcggtggcagcttccttgagcccacgcggtgacaacaatcttctcaagcccacgtggcggatttggccagagaggtgatccagacgatgcctcagctcattggtggcaacctccccaagcccacttgggggatctagttggaaaagtggtctagccagcggcagcagcctccccgagtacccaatcgatgccgccgttgttttcggaagcttggccgacggcagcagcctcggcaatggcatcgttgttttcctgcggctcgatagtgacggataaagctgtggcttcatacccgcttcctatatctagcttgctttttatgacaaggccggccgaagaacgggtgtttctttggacgcgtgagcttcacgtgtgtagtgctagaggcaaatgtggcagcgaatctccaacgtgtcatgctcaagctgaatgccatgtcgggcgcattttgaacgcccttagactgtctctggtaaaggtggtacatatcttctactttctttatttttatgagcacgtttatcgaagcgatgaacaatatatttatttttaaaaaaatctgtagaaaagttacttaaaaattatattaacctaattttcaagttaatttatagcttgtgtacttaactaatcatacgtaactagcacataatcttcccatccgaactcattctgtctgcgttctttgcctaaaggaaaatttctcgtacacgcaaacggagaaagctgcacataattaattaaatattaactattataaacttaaaaaataattttatttttaaaaaatcttctattgagattttgttaaaaaataaacaatttaaccatttgaaaaacgttttaatggaaaatgtgaaagtttaagtttagaaccgaagaaaaagacagggcatctaggctaacacgcaaacatttgtactgatggctggttacactcggctactggcacatggattaatgttttttttccttcttaactttttaatgaaagtattagaagaattgatcattgatgtgaaccgtagttgattttgtgtctgtgtgtgtgtgtgggggtggggggggggtgcattctgtgaaatgcattacgtgccgagcgatggatggtgcgacggagaattggatccttcgctgtcacgcccccactttcgccgtcccgttcgagacgtgacaacctactacccaccttcctcgcggccttacacaaacacgcacacactgacaccgcgacacgcacaaatgtctctgtctaatggatcgtagctgtgcttcctatatatatatatatatatatatatatatatatatatatacagtacgagcgtgtcttgtaccgtttcgtactctctttcttctcttttattcgtcgcacacgtctacaagagagtatccaaaagcttacgcagaagaacttaatatactcgagattaccgtgataatacaattattagagatgtgtagttttaacctgaggtctcgtgttcaatctctatacactcacaattttaactcaaaatctctctcttattttaattcaatatacaacgtgcgtatttgatatttatatactatagttgattgaattctaaatagctgactttccgcccaacacactgattctatttttgttttacatttttctgtataaaccttcacttttatattaactagcatgattgcgcggctagcatcattatattttctctcatataatagtatatatggtttctcaatgtattattcaaatatattaaaatgataacataattttaaattttgtactaactttacgaaactactaatgcgtaatattcgtattgtattttatataggtgttagttattgattatttttaatatcaaattttagttatttgtaaattatatttctatatggactctagactcctctttcaatattatttttaatttcgagttttcgttatctgtaaattatatttctatatagactgtagtctctaggctcttcttccaatatttttcatttttaattctgattttttattatttctaattgtatttctatgtggactctaaactcatctttcaatattctttaatttttaatttttaatttcagttacttctaaattgtattcctatattgactttagattcgtcttcccatgttttttaattttgaattttagttatttgtaaattatatttttatacggactctaaacactacttttaattttattatgtgtattccgaattttagttagttttaaattcctatatggagtctatactctacttctaatattccttatttttaattccaaatttcgctatttcctaattgtatttttatatggactctgtttttctttttctccaattaatatgagaatttctagaccgtgagagcgaacatagaggctcatttttctatacctttaataagttaatagattaatcttgtatggtgtatttccatctgaatttttttttgtctccgtcattggcaaaactagagtcattggatcattgctactaatcgccgacagtatttgttacgtttttttttcttttcatcacatttgactttgaaccgcaaataagtagtaaaagtgaaaaattacaccctaaaattatttttcgtctcatacgtaataggcacacgtctttggttaagccatagctcaaaaattgcctaccatcttttgcacaatatgcggtgttagagtctgtttggatgggactaaaaatttttaatccatatcacatcggatgttggacacactaattagaagtattaaatgtagactattgacaaaactcattccataaccctggactattgactcgctcttacaactttcaagctggattttcttttttttttctttattacattgtttcatatatggctgactataaacgtaacgcttattaacgataaaaatatattttagggtaaaacttatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgttcttaactatgtactaccctcgttctagaatataaaaagttttagagttggacacagctattaagaaagtgagtagagttagatatggagagattgtaattggttgagaagtggaggtaagtgaaaaaagtgaatggtggagagttgtaattggttggtaaacaaatattggtggagaagttgttatattttgggataaattctaaatgctaaaattgttatattttggacggagggattactaaacaaccaataaataaactaccatagaaaaatcaaaattaactctaaacattacaaggcagtcatggtgttagaatttgtatatggaatgcatatacaaagtcaattatagtgtaggatttggagttgttctatgtgtttggataaagttagtcgaatatgtcataggctctctctgaaatacagtggtaccaccggttgtaactgcacgacgactgcaacaactggtcggcagcctagttggtcgatgatagtggataccttgatatactgtagctatgttggattagaaaggagtgttttcataatctgtgtttcaaggatgttctccctccgttcaaataaacgaatctaggaatgtgacactatgtccagattcgatgtactagaaaatatcatatccagtcctatgttgattttttatgggacggaggaagtaggttttgactaaacatcgctgacaaatatcatgatttgttgtcttcatcacttcaaggtcttctatggcatactccctccgtactcgtaaaggaagtcgttttggacagcgacacggtctccaaaacataactttaacttcttgtttctataaaaatatttattaaaaagtgatatatgtatacttttatgaaagtattttttaagacaaatctattcatataatttttacattttcaaactcaacaatttgagagttattcatgatttatattcccaaggtttgacttaagcattgtcctaaacaatttcctttataagtacggaggaagtacttcataatttgggtatcgatgttgattttagagtcggtttcctaacacctagaaaaactaaggtttaagccctaggcttgactccaaaactctaattaaatcttttagaaattggatgaaaattttgaaaatgtattacgtctaaccaaaactgactaattcaaccctaggcttgcacgttttctgtctgggtcttcaaggcgacagttgagctaaacacctagcactcacctcatttcaaatgtgcttggatttaactttcttggtagaatttgtatattctcgaaaaatagctatgcttatttgagtaagaaaatgttgttagctaatagttgggaaaatgctttatatcgcacgtccgacgaaatggaaatatcggacgtctcatctaccccactggaatgctgcaaatcgacagcatgatggatcggaagaaccctgtcaccgtaacaggtatgactagctgtttctttttattcttttctcctctctttaaatattttttcttctaaattacttatccgatctacgaaccgatcacaccgttgtattcgttgtaattaaatctttacaacaagatatcatatgatcatattatgtcaaaagaaaaacatgtgtttcaaactgttaaaactaaatgtttcatacgtaacagtgatatgtttcaatgtacgccttcagtgtgtttcacaaaattcctgaaactacctgctactactctctctccacctcatccatgcacacatgcatgtattttagcaagcttcaaaataatttttctctcaaattaattatccaatctatgatccgagacatcattgtatttgttttaattaaatctttacaacaagatatcgcatgattattttgataaaagaaaaacatatgtttcaatccgttaatactagttgtttcatacgtgacagcgacatgtttcaacgggtatcttcaccatgtttcataaaatatttaaacgtttcagttgctgattttttgtttcacttgttggtcaactgcaacatttgaccgtccgatttttttggcatcggacgtccgatgggtagcttcctcctaagagcccctttgaattggaggaaaaacatagtaattttggaggatttcaatcctataggaaattttcctataaagccctttgaaacaaaggattgaatcatatccaatcctttgaaattcctatggaatggacaatcctatagaaattttggaggaaatttagcaagatcaacctcttggtaactttcatttgagtctatccctctcatccaattccagtttaatcaaacggtcattcctgtgtttttcctgcgttttaaaatcctctgttttacacttgcattcctatcaaaatccattgttttttctattcctacgttttctcaaaggggccctaatagttgttaaaaaatgttctttaacggcttaacctgatcacaatagatgataatggtctattgttagtgctagcaacggtgatcaaatttcagtcctctaaaaaaaatctccatgctactgggtggcacagaagatccaatcttcagttgatgtcgcccttcagactaagtaaattggtacggctctcgatgtacttgtgttgccagccaatgacaaggccagcgtacaactaagaagtcatgacaccaacaattaacgacaagtcatatgattaagatgtcatgtagtagacctaagcaaagcactgccgaatctcatctctctagcgtacattaaatattcagatcgtcgtcaaaaagaactttcgcatcattagatattttttccaacttgtgctaccatataataccaacgatggataatagttgagcaaatgtatggaagttgcagccaaaaatgtcgcacgaagatgaaaaggagtatctaatttgtaggaaattgcctctttgtaattttaaatattacttttacttaaaatttgctggataaaagaacataagttttttttaaaaaaaaatcggccaacgagtttgtgtgaaacctaagtacaagcccgagtaggtcgcccacaactggggactttaccagtgcgctaaaattttcagtttgttaatagtagatggcagcgcgtatccatggaaagggaacatcctgtcaattttctcttcttcccttatttctctgcgtctgatgatatattgacatgtggactgcaaattggatcttgttatttctaatggtctccaattttctaaaaccattatttcgatctccatcttgcaagagttgagcaagctctttcacgtctttcctcattcaccagaatcaaagttgagttggatgtttgaagtggtgaatatcctatttcctctggtcagtagtcatggtctcactggtcttttcttttttttttctattttcaactggaccctactcttgttagcttgtcactatggcctttttgtatttgaacttgtttacttgattatgttgagctatgaaatggtagtacacctgcaattattgggtctctttatatgtttattattgaccattgacacgttgaaaggtggttcctacatcaatgcattttttaagagcaagtttaacaatgtagctaagtgctagcttcaaaaatgctacattatctataaccaacctaatactttattaattatgaatatatactacctcacatgtcctaaaatataacaaattttagcctttataatttatcctataatataataacatctaaatcaacattctattctcaacaaccacaaccttccaccattcaatttccctacctaccttcatttctcaaccaatcaaaatcttccaccatttaattatatatactttcttaataattatgtttaactctaaaatttcttatattatgagacggaggtaatacatcatcaatacatggctcatctctctttctcacatggtttattagggttgtattgtagctggttataaatttgatctcattttttcattgccctctctgcatataaatataagagtgataatttttatgcctgtttgtatcattttgttgcactaaataacaacggatacttctactgtacactgtgtagtgagcagggatgcccaatagtgagagtgcgatatgcagctctacagttcctcacctcttttggcaatagatacaacagcaaggagttgctctttggggaaatgaagggataccattgcataaattaatcgttctttgcccaggcgttctgatgcctccatcacatgacctcacaaagaaccaaacgagcattttggatgcattgcaactccattgccaggaagaaagtacaccaaatgctgacacaagagcttggcctggaagaggattcccctcatgtcatttgttttgttcaaaaaagtgacttttgctggcagttttgtatgacaaaaccattcaatttctctccttgttgggagaaagaacaaagtagggagaatcttagggaggttggtcatcagcattgctggcggttgatgcggttgaatattgcgaccttgatgcgagagcatttgctcaaggaaggcatctggtgctgcttatggcagaaacgagagatgcatcttatttggttagaaagccagccaccgaagaaaaaacgatgtggaagattcgttcgtcatgtaagaagatatttgatgagctcctgaaaactcatgttctctcttgagtttacctggccgagaaggtagagtttgttggacttaattcagcccatggctggatgctcatacatgttcggaaaaaaaatccactttacgtctcacaagtttggctgtttgagtcaactttcatttatgcccatcaactataaaactgggtataaaacatccttcaactatcaaaaccaatgcaaatcaaatctctcgacaatatttagagtagtttgggttgatgtggcatcatagttagtaaaaagaaaataaaaatacatagggacccacatgtaagtggcggtcggttcaccttcttcctccctccccctctctccagggaaaatctacaatgaaaattatcggatgtcctgaacctatcaatcataagtataatgctttatttttgtgctaaaatgtgtcctatgtatcatatggattgtacttgtatgtagatctgctcctgcctctcactttaacctctcctctctcttctctccctgtgggcattgttgacgaggacgaccgtatgcaggacaatgtcactgtgcttattgctccatccaaacgatgtagccgtcgccggatgtgccacttgcgtggccttctccctccaccatttaggttgtgcgtgagcgcatcgtttgcaccccttgatttcattgtcgaccggccacagcgcgacagccacgattgcattgtcacatgttctcaaccttgtctctccgtccatggatcggactggcctagcagttgggggtaggtcatgcaaggaggggtatcgctgttgggagaggagccaagagtagtgcccctcatggagagggattggcaaaaggactcaatttggtgacgggtgccgtcgattgatgttgttgttaatgcgaagtagtagatctatcgagatcaagagcgacgacaactgtgagggggtggaccagagcagcttgtggatgtcctaaaagagagtggttgaattgtttccctcactgggttttggggtggcaggagaggagggggagcgagaggaatcatcatgatcgttaggcggtggtgggggaggagggaagagagggttgtgtgtgaagaggacaaggaaaaggcccgaaggaggagaagcttcttttgaaggttgatgcggcagagcaccatggcggtggcagcatgtgactactggcccaattaggattgacttgtgtagcccatgaaaattgtatgcacatgtttaataccacattgctaatttagtaagggtgaaatcaacttataagagtttatccatccaacaatataactctttggtttatccttttacatgagactaaggatggaagtgtaagtaagtccgctcgttggatgggttgggctgcacctacgcggttctagagggcgggtagtagtggtacaagagtactagtcaggaccaacgcctagctccaacgatcagcgctagccgcctttcttcccaccatggtcgcttatgtagcgacatccccgtgctcggcagtgccgccgtatgggttgcgaccaacatcaagccgtactaccccatcatgggacatctctcttgtggccatctacaacgagatcatcagcacgatgatgaagaatgccttcatcaccggtctcatccccgtcatatgcatccttatctccaagccacactccctcagcaacgtgttcatctctgcaccaccattagctagttggtttctcgacgtccttgactgtctcgtgttagggctgatgctcgagttccaccacacgacgagatcgacgttcgtcaacccctacctacttcagttacaacgacaacacgataccatacatgctagcatgtgggtcccatcaagttttttttattttttgtttctagtgccatgtatgcgtcatgtcggacgaagactaagtcaacaaaccatataggcaccacgttaatttgcactgattttgtaaattgggggacgctccacacctggttttggaggcgagcgacgcgaatgaaattagaccatatagttgagggataataattggacttttacctagatgtttcgaaaacattgtggaatcataaaatgaaggcccaacatgcgttgcaaaagttgccggcctgcagttgcggcccatcgaaatcagtccactgttttattcggccatatgaggccttcgattcagccggcggtcgccccccgttttcgccatgttgcggagataccgggcagtgcggcgtgccgccgccgccggatgtcgatggtggcgagtcaggatggcggcgcggcccgaaacagcggctacacagttgaaaggtaataaggatttggccgagccgtgcgagtcgctggcgttgacgacgcaaattgacgcgacgcgagcccaatactccccgtatatatctccagtttgcacgaccaactgccagctgcaaaaggcgagagttcagtggaaaaaacagatggtcgctgttcagaccgtgcatgcggcgctcttgccgtcgacgacgacgacgcgcaggcggccatcaccgggtaggctaccgaggcgttcccccatccgcgcacgagccggatcgtccgagacatcgtcgccacgcggccgcgagaactggcgggtgcaggaggcgctcgcacgggtcgccgagatccaggttctgaaggtccgcatcgccagcttcctcgacgactgctccgagaacctgctctggctcgcggagaacgcagcgctcgacgcgacggcacaggacagcctgagggtgctcgacctcgacggcgccgccgacgatgaggtgagagcggccgtttcttgcaattaacacatggccggggagttaacacatgacacgttcgtccgtggttgcttttctgcagataatggagaggctgtactgtaagttgggtcgttcgacgacgcgcaagcagaggagaagtggatggacttgatcggcttgggcatagacgaaggtgtatccgttgaaagcatcggtgaggaagccaaacatgaacatgtgctggtggcaagggagagcggacggtacaggactcgcaggaacgtttacctcggtgtcatgggattgatctgggttggcctgatgcagaccaccgtgttcgcggcgcccaacgtggagttggacaagtttgcggccctgtgtctcatctttcttgcccatattgttcaggtctgcttcaaggaggaaactgataagaaacaagtgtgtgtaaatcatgagactcagatcagcggaaggcagcggtagactccaatcatttggtttggtttaaagtagacagggatatgacaggcaatttggacagtaatgatatgttacatgtaataactttacacgtcgtaaaattatagcggttgatatagtttacttaactgtctggtaaccaatggacaatatccttctctttcttcccccttctccttccaagttattttagcctgagtttgatttggagatgagttgtgatggtttaaccctatccttatttttttttagagatttgctccggtccaacaggtataggtacgtcacaataccaaatcgtttttcgatcgttggatctaacaatttggatgagttgtgatcgttggataggcattgttagatccaacgattgaaaacgacttggtttcatgaggtaccggtatctcaagatattttttgctggattagagcaaatctctattttttaataagaaggtttcatctatttatttggcgcaagagatagaatgatcatattttttaaaagaaatgggagggtggtatgtatatcaatgagaaagataaagaagctgatccggatttaaaggaaatattcttttttatagattatttcatcctaactattctcaaaccaaactctataaaatgggttcgtcccgaccgatcatgtaatcatgttcttctaaccaaacacatgctaaactctataaaatgggttcgtcccgaccgatcatgtaatcatgttcttctaaccaaacacatgctttaaatggagccagctgattaggagtcacctggactccaatgcctagtagtcaatgttagtaaatgcttttgattgcctgagctcgatgatgttgttggctttaccactactagtaaatctcccaatgcaaatagatagtgttacatgtagacttccgtattccctccgtttaaaaggaaccaatttcatcactagttaggaattagttcttttgtaacggaggaaatattgtttggctatgtaagagtgcgcagcccggcccaccaaccgtagaccacccaggttatattgggcctgctccaccacaagcccaaccgaagccacaactttaggtccgcccggcacaccaaccgtggaccacctaggtcatattgggcctgctccaccacaggcccaaccggagccacaactttaggtcctaggcctatacaacccaaaaagactagtcatcgtgctcctccatcatcaattaccgatgtgggactaaacccaacgtcacacatcaacatcaacccatgtgaccccgaagacttgttatctagcctccccaccatgtgacccataaaaattgttccgggttccaaacctccccaccatgataccacatgtaacccatagaaattattccgggttccaaaactccccaccatgataccacatgtaacccatagaaattattccgggttccaaacctccccaccatgataccacttgttgcagcctgctccagcacagacccaaccggagccacaactttaagtcctgggcttacacaaatcaaaagactagtctgatgggtggggatcgcccccaccttttaaatcgtgctcccctatcatcaattaccgatgtgggactaaacccaacaggctagctagtaaccatggtcgtttttgtctcttcccgcactgaatcttgacacgtcaaatccggacatctatgtccgtatccaatgtccgtaccccaaaaaaaagaaattgttgggtcagtacaacacggtgtcatatccgaagttccgaaacaagttccacactttcactgttttcaccctgctgactgggccttgtggcaagcaggagcacatgccggcccgtcccgccgtgcacccgcgcgcgcccacgaaacacaacaccgccgcggcgttacggcccaaaacagggagccccatccgccgcctcctcgtcatccggcggcgccgcgcggctgtacgcctcacgagaatgataacgacttctgctgatccgccgcgtccctttcgtacgccatccaggccccggggggatagcatacgctgcggcgccgatctgcagtgcccgccgccgcctgacattctcacctctctgctgcctgctaattcatcggccgccaccttgtttttactgccatgcatgtagcagtggtaattacagtatgtcggtacactcattgtcatgcagtaacagccaggagagttctgactgcgcccatgtgatgaactgatgatggggtttgatttctccctgcagatactactactgcagtactgctatcgctaaacatgagagggatcggggcccctttttcctacgtccagtccaattcaggtgcgctttttaatttttcgaattgccgaatcattccttgcattttttttctagtacacatctaggcaaattagttacagtatgtaacctgaacaagaatttcctcctatctagaagtgcataattaattagcatactttatgtaccggagaaacgttggtttctagataagttcggaagaaaagatttatcatccgtggaaagaattaaaagtttccccttggtacgcactcttcgtttgcttcacgatatgttcagtgctggagaagcgttcagcattcatctacagcatcctttgatggctcatgatagctttcataggaaaggccaagcaaagtatcgagcatggacggacgagcacattgcacccacaaaccacaccaactctctcactctcagccacaggagcgaggcgtgtcgagacgctctcgatggcacacgaacagcagctactccagctcgcactgatccgagccgagcatccgatgcagaaagttcatgatcccctatgattgtacacctctcggtcctgtttggcgaagcttaagattctgagaaatagatgattggtagccagtttctcagaatatggaaaaagtgggtttcccagtttctgatttttagttcattttctagattttacaactatatctttttaaaatttaatataggggagcttttattctataagctcccaagcaggccctcattatctctctgaaactctgcagtacgtgcaaggcagcagcgcaacaccaacatgcgtagcagaggcatcagcagcagcagcagcagcatcagcagacagtgcacccgaaatccaagcgggaggcaatgattaggggaaggaaaatccggggggatgaaaaaaaaggttaatctttttttgcgctcgtatgattcgatgcgtaaaagggatctttgatcgtggtaaaccatcatcatgagcgattagtagcggtagtaggcgcctcgagatccgcgctgggccggagatgccttccatgatgctgctgggcgccgatggatcatggatgggagccaagatgatctgcctgctcctcctcggctcctctttaccattctgcatctctatgctttgctgtagtatagcctagctttcctcgactctgctttgctagggggcatttaactatctgccacttttattacatggtaattaaaaatttattactcgcagtctataacgagctagctgggctcctttgagcatgttatcttaacgagttaatttggcttgattcattaatcttaatgagttaaaagtctagcttagttcttgagcggtctagttaaattcgttagttttgttgacgcgttaattatataaacctaataattttaaattttattattatctcatatactaacttaatactccctccattccaaattgatctacatatagtttttttagattattcctaaataatcttcacatttgtcttcatttattaagtctattcgttatttgtgcgttggagtaaatagacattaatgcatgcatccatgcacacaagtatttatagcccacaagcaatatcttaatttgctattggctagaaaatattggggatggtacatgcatcgaatgtattgctagagtaaatatagtatgagagaattattagtttttcttggttttggtgtacctattaaatatgtagatcaatttggaatgaagggagtaccaaatactaactaataactcacttaaatataaatagtttggatgactaatcactagttaagacacactaactatataaagatatgatgatgatagtctatatcaatgagctaaatgagcatcatgcgagttggctcgttattcacgaggtaaaaacttagatttgtttgactcattgtaactccagttctagccaatccagcttcgctcgctacgaaccaatccgagccataagtttcgagttttgttgaataatttgacgatgaaattttgatagcaaataatagttatagtgaagtttgtccgggttcaaaaagttatctagctccgccgctggccggctgctgctagaacagttctaccgtctacgaatctacagggcagtacactacttccactcaactgctactactgcattgttctctaccgcctagtatgctatacaacgcacgaatgacttgtggccggggaaagggtggtgattaaagctggtgcaatgcaatacatgcatgcactcctctttgctcgctttttctacccccactttggttgggagcctttgaaccccagtgtggcatgcagcagcagctgatgattcccatgcaaatatactccaaatctgcctttgtgaggatgtgtttgttgctagctactgctaccatctctccctcatgggccacatccccggcctcctttgtgagctccaaggcatgctgtcctcggctattattttcaagctccagcagagccgcatgccaattgctaatgctccatcattgggcctatctgctgctgtttcatttagacctgtttcaggttcaggcagtcacacatgctactccagattcttttaaccgagcatcataagtcatttggtaatttagtatagccgtgctgcaattatggttgcaacttcaacatgctcgtatgagtatttagcgtagaaatccgggggatcttcgcgtagaagaactttctgcgcctgttaataattattagctactcaagttatgaaagttcagtattgtttttcctcttgatctttatacgtgctttcgatcaaagttcattcttaaccatccacttgcgcattattggaaaaattgaggacgagaaaaggctggactgttagactgaaaatctaaaagccagagagttctgtcacaaaaaaaaatggctctgtttcagtgacaacagcatctacgagtatttctttttgcaggcacaaggacgcagaatttgcagacgcacactccaaaaactatcgtgctgatgaggatatctcaggctctctgcatgctggtcctgcacactctgcctctctcttcccaactgtgcacgccatgccatgccatgccatgcaagcacacaggttgcaggatcgcgagcttgcaaactgcaacacacattctctcatcgggatctgcgtcgaatggcggatgcgagagagagagaaagggataacaacaagcaaagcagcgccgctgtgagcttttgcagtagcaagttggcaggaaaaatcctaaccgatcaaacggatcgagcagagattttcagatttcagtacgacgatcgacgcgatggcgaaaatttacagcgagagagaggcttagcatagctacgtactagtacttcttctagtactagctaggcttaaagatgaacaacgaatccgtccacatgttaacgcaatcatcatcagtggcgcgggttgttgttctttcgcacattcccatacgttttacatgtgcagtgcctcatttctttctcctattcttcttctcctcctcctcctcctctttctcgttctcttcttttgtgttttgggtgtatgtgcatcctttgatgccgagctctcccttttgtcagcagaggaaaaaaatggcgagggagaaaggtgttgcccgaaaatgccacggcgaggtatctgcttctgtgtgtgtgtgatactgtgatgtgatcgatcccgatgcgtttcgccgatcgatcaaaggggagcactgttcacgatcgcggcctccttttgctttcgttgggcttgctcaaaagaggatggggggtatgtagcctgcctagcttagcatcttcttgcccggggatttcatcagtacaggtgaaaatgtcaccgttaggccaatcattctcctgctgctgcccatctgtttaactgtttttgttcgaatatctgctgcctgaagtgacatcagacgtctttttttttttttgtgtgtgtgtgtggtttggtaaaattggtagcctgaggtatgagcagataaaaccagaggcaaaattttcagatatctattgttagtgcgatttgtaactaggaaattcagtaagaaggttcgttgtttatatttataagttaataacaacggaaatgctcagtttgattcgggtggaaacgtgatcttccaagaactgaatcttgctcatatcttgcattgtctgaacaaagatccaggacggcgattaatataaccacggctgtgaattagtttatggcacagcgttatctgaaccctctattccttcctagaagctcgtaacatggcccgtttcatgctttggtttctcactaatcaagacctgtaagtcacctatagaaaaaaaaaagatgctcctgtgtgcattgaggcacatcgcacatgtgagagatggagctactgttcctgatcaaagggaggctaggggtgcaaaagataaggtaccatgattaattatcattcctaagctcgagaaggggacaactttggcctcccatcatgtgcccggaacgctccctttcaccaatctgctaattagctcctcctactaggagcttgtttgatcagatgcccatcttttgtcctaaactcgcctaagtaggacaaatctgaagtggagaggacagtgacaaccgggtgccacttttgttctcttgctgtttgcatctgtttggttagtcttgcagggaaaatgaccatcctagcctgcaaaggaaacaaggagatggggataaaaagggaaagctggaaagggaaagttcatatcggctgtcaagaagaaaagcgcttcagaaggaatgtgatgctttcagattttgctttgactagctagggagaattacaatttacctgcaggtggttacttgtaggtttgtatgaggaatgacagtgctttcacgactgcatttgtttgttctagcactcaaatggtacttagcagatgtaataagattccattaacgagattccctgcaacggttctttccacgaaatccacaggccagaaaaggcctgcctgctgagtggattgactctggctgatttatggcacgaatgcgctaaactcttttaaaaggaacgtttgaatgtttgatattctcactgtgcattttagagtgacgatggagaatgaagttgtggagagatagcttcatgaaatatctgaagaaacatctccagatttatcagatatttcacgtggttcagactttagagttcacatcgtcacggcctgcccttttcttcagcttctcgtgtgttcggggcatctgcctgggaatatctgatgaaacttacgcgtaggacataatcaagcctggtgccccaagtcataaggattttttacatgcaacgcgacgagcgctgtctcgtgaaagtcaaataaaattgttgtagaactctacatgacttcatatcgctctcctgataagggcaaaaacaaaatacaggaaagtaggaaaccaaagactgtcaaccagtgctgttctctagtaaaataaactggtatttttggcatggcgttgctcggacttaattgatcatcagaagaattgtactagtagtgcttttttagactgatgaagctttcagattctagagtttgaactcgaagaaaatgaaggaacactgctgccaaagcatttcttcggaaaagggaatttggtatatacgtcaacattcttaacacgtttcttgtttgctactagttgccaagcgtgcaaacatcattataatgtttaatacagtgtcaacgggtccggcttgcctacaagattccttaggaccatatcaaatgcaaccaacaatacatctttctgttcctttttcattcctttccctgatgaataaatagtacagaacccactattgtgttcgatgattgccttttctaatcataggttaggagggaaaatacaatgatattgatgcatgtacatttattggcaagcctatcaacacagtatcatacggtgaagctaaattccttttcataagattggtctgagttataaaacaatgactacatgcatgacaagtgaaaaaaaaaagagagaagaaagtaaggtgatcaatcggccacccaaaccttactaacttgtttagttttaatggagtgggagcgtccctcaaacctaaacaactgttttatccttctcaatgtagtacttatttttctagcaaactattgtgcttcactcattaactacatcgtaattacctttcttaaagaaaacattaatattccataattatactaagagtactagtgcttgtatggatacattgatgaagggtaagaaggaaaactacatcattaaaagtgctttagaatgtgagaataatagcaagtattttgaaacaaataaaatactagaacaataaataaattgaaacgtatggagtaacatattacgaatcaagaaccacaagatataaaaattctcgtttgctaaactatgacatattagtacactctctctctcggattgataaaaaatagacgaactgtgctcaacgtacccagccaatgcacaaaatataaagagaaattgttttgttggaacagatctcataatttgaactacattaaaacagatcttgccatgcatcctcgaagaagaagaataagatcttgtggtccgagttagatctcaatctgatgaaaacattgttttgaatgtttagaacataaccacaaattaacaagaccatgatgtactcacaagtaggtggaaataactccaagcaagtgattgcaaaacaacttagggcagtcacaaccctccacctaggatggtgtctatggcattaactacattgccatgtagtacttttagcttatgtggcactatattaattaagagagagagtgaagagaggaagaaactgggtctcatgcaagacacagcttcaacacgagaacctatgtactagacactatcaagttttgcattgggagagaatagtgtcttcataatagatgaagaataaatatgattggtagaaaagagagatgatctatttattaatggcccactttaagaaaccatgggttgtagagtgtagtttctattgtgatgtcttattgatatggcaccatagacactacttatggacactatgggttgggactgccctaataagggagcgaacaccgcatcgcccctatgcaagggacttgagggatgattgaaatcatagctactgccattcttctcatctcctccacctcaccgctaccggaaaacagtacaatgagctaggatggtggcgccgaggattggtttgccacctagttttggtgcgaagaaaggaaggtgcaaggtgacgatgaagaaggcatgacgttgaaagcgacatgcccgggggggagggggcttcctccgtgagcatagatctggtgcctcctcgactcggtttggctggaacacgtgatgcgaccttacgatggtagacaagcaaacgattggtgttgagtaggttgccaatgtcaatgacggcatgagtggccacagatggcataggcaactgacacaggagaaggaagcgattgcggctgaggtgttgccctagggggaagggggggtcatagagtagcgtagtaagaaagcaactgagatggtgcttggacgaagcaacatcctggttgtttggatggtgatgacatggaggtctctaccgcatacgacggcttagacgatggcaagtgggtttatcctaggagctcctccccctcaaacggttggcatgcttctaaacctgatcactaggagcttcaagcaaagagggaggcgatggttttggtcggaagggtgttgcttggcggaagacaacaacctttggcatcggcaacatgttgaatgaccttgtggtagctaggtgtaggtggttgtccaacacattagaggtactgtgctggagacttttgtgttgtggcggagtaaaaggtactacattgggtgtgatctaggatatgataacccacgatttcatgatcctgcaaggtggaggtgtgagtctggtggattttgtgatgatatcctgcatctttgttgtggtagagtcagagatgctacatcggtgtagcaagctaggcaatataacaacttcttcgctttggcaacgaagattggaaggtacaaagagcttagggaaaaggccatgcctggtcttagatcaatgctggcgacgtcaacgttcgtgggcaattgggcatcatttctatccttggaggcgttataatggcatttctcttgcttaaatataaaacctagtatgttgttttggaccgaccttgataccgtcgtagatgatgtatctttcttgaaggcttcgcctagaaggtcatgctatatgtttgtggtggttgttgcgactaacgatagctagttgaagctgtttgatcgttatgccatgaacttgacaacaaagacttgtgatgggtctcggtaggttgtcattgtaggtttttcgtgtttctttgtctgggtttttatcggtttcacttcaatttattgtgtcgttttaaagtttttaggccaagtttcacttataaactttgtcgactttagttttctatcaaagtaggagctctctaccctttatgatggatttttatgaaaaaaaatatatagctctataccataagcctcccattgtttgtcccacagcttataagtagttgcataattttaaattttaaatttattattgaatttggctttagttttttcatcatagtttatttttaacacattgacttttaaatcaccaagacatactccatttgtcacataaaaaatcaacttatgactataaatcttgacataagctaaactagctgggtggcccgcgcaattgcgcggctagcacccatacaaaattatctattttttaatatgattttacttaaaatttattaaataactatcttattgtcttaagactttaaaagacaaaaccttatcatccccatgcttctaattttatggtttttaaaagtcatatcaattgctacaccttactttgtcacgccttctttatttgcttgctcgatccactattgtttctatttattctttctttttagaacctttaaaaatcggaccttatagtttttaaagttcatttcttgttgggttacatttttataaattttagaagtcccatcaaacgttgctagtatactcctctatggccagtccattgtctcctctctttattgtctttgaggttttaaaaatcgaacaaaattatcttttgggttcattttttactttctagaagtcatgccaaaccatcagcagttgtgccattgtactctatacggctcgcccattacctctcctcattattgtcattgagattttaatatcaaacatgatgatcattggggtttatttttttactttttaaagtcctgccaaccgccgtgaacatgttgcttaatggcatgtccaacgtctatccttttaatcatcatcgagattctatttagggttttgttaatatttttagatgtatcatcaaccgtcaacactcaattgctttacatgtctcatcaaactgtcaacggcttcgttactatactcctctaaggcccacctgcttcctcccctctttatttttttttgagattttaaaaactgaactgattgtcattagtgtttatttttctactttctaaaagtcccatcaatcgtcgtgactatgctgcttaacggcatgctcatcgttcctcaccctaatcattattgggattctatttaaagttttgtttatttttcttagatgtcccatcaatcactaccattctacttctttacgcgcatattgcttctctttttattgttatttgtcatcggtgttctagagatggacttcttttcttttctttttattttgaaaattccatatttttcattccgatggtttttatttataaactatattcctatctgaactcttttaattatttttttgtttttggaatttattttatttgttcttccgaatattagtattgggtcatatattcttagatggtcctttattttaatagtcattgttttttattgcgaattttagttatgttcatagatggtcttttatttcaatagtctttattttttattacgaattttagttatttatagattgtattcctagttgaactcttcgttttccttttctaattttggatttttttttctaactctatgtggcccacacaattgcgcagctagcacccataaagaattatctaatcggtgcggtgttcattggcaaattatcacgtttatggagtgagtttgaacggtgtcccatgggccacggctaaaaccacgaagtcgaagtgtcctgtagcaaaatttgcctttgtataaagattagtacactcctgaacgtatctaagctattattaatttatttttattatgaaatttattttctttagaattcttattgattcgtattttaaatttaatttaatcccgcattgtgtttcatttgtttttcatctgtacggtatgtacttggcggtagtaatggtggcaataatcactgtacataaattgatatatatacatgtcttacgtcaaatggaaatgctgctagggtacataaaaggaagtgcttctatgaagaaaagaaaaggctgagtgcctcaatcggacaataagtcctattcaaattaagcttaagctgccttggttaggagtccgatccaagccagatcgtatatatttctatgtttgattttataatttcgatcagaatttattttatttttttatttcaaatttaatttattctcatattggatttttatattgactcttctttcaatattacttatttttaattacgaatttcagttatttttaaattatatttctatatatagattcatcttttattttttattatttattataatgagggagtaagagaggaaattactgcatagtagagtcctaatgggacttctgctcatgcatgcgcctgatttgattcacagtagtatttgtttcggtgcccactatcttggttcgtattgctttcccataaatctatcaggaattcaattttcatataaatgattgtattttatatacaactctatcgatcaatctacaccactacaatctgaatctactataattctatttttttcttcttttctccgattaatgtgggaatttctagcccctacagtgaacgtggtgcctccttttaaagctgttttaataatataactagctgggtggcccgcacaattgcacggctagcacccatattaaattatattttttaaatataattttacttaaaatttattaaatagttactcgttgtcttaagattttgaaagaccaaaccttatcatcctcgtgtttctaatttatttcagttgctacctcttacttctgtcttattagctcgctcgatctactattatttctattcattctccttggaatatttaaaaattggatctaaaagcttatagttttatagtttttagagtttattgtcctgttgggcttcttttttataatttatagaagtcccgtcaaacactgacattatactcctctacaaccgtccactgcatcttctctttattgtcattgctattttaaaaatcgaacataattatcgttaggtttattattttttactttctaaagttccgccaaaacgttagtgactttgtcactgtactcctctacagctcgcccgctgccgccgttctttattatcattgagattttaaaataaaaaatgattatcattggggttttttttttttactttttagaagcccgaacctttaaaaagtgaaacttcttatagtttttagagttttattgtctcgatggatttcatgttttttataatttttagaaatcccgtcaaacactgccactatacttctctacgacccgtccgccgcataatctttattgtcattgggattgtaaaaattgaacacaactatcattggaattcatttttcacattccagaagacccaccaaccatcagcggctctaccattgtacttctgtacgacccgcccgctgcgtctcatttttattgtaattaagattttaaaaatcaaatatgattattattggggtttatttttttactttctataagtccccgccaaccgccttgactgattgcttcacgacctgcccgccatttttccttttaatcgtcattaggattctatttggtgttttattaatagtttttagatgtctcatcaaccgctaccactctgctcctttatatgcctgttacttaattaatctcgtcatgtgctttagatagtcttttctttcaatagtttttttatcaccaattttagttatttataaattgtattcctagttgaaatctttttttctttttctaatttcaaattttattttatttattattatgttcttttgatatttttattttttttattttcaattttagttgtttcaaaattgtattcctactttaactctctttttaatctgcctaatttcgaattttattgtatttttatttcgaattttaattaatctactattgggttcttatatgtactctttttcaatattgtttatatttaattccgaatttaagaattttaaattgtatttctagttgaactcttattttcttttcttttttctaatttcgattttttatttttttattcagaattttaattaatctcgtattggattcttatatggactcttctttcaatatttcttatttttaattccgaatttcagttatttataaattgtattcctactcgaactttttttttatttttctaatttttaaatttattttattattattccaatattaattaatcacgtattggtttcctatatggactcctctctccatattacatgttttaaatttcgaatttcagctaattttagattgtacttctacttagacttttcttttctttttctccgattaatatgggaatttatagcctccacagcgaacgtggtgcctccttttaaagctgttttaataatataatagaatagatagatccaggttagtagataaaagttgattttttttattgaacgacgtgagtaagtatcaacgtttcatccataaattatttttatattgccaacaaattattttacggctaactgcgtatccgcttaaggctacatttaaacaaaacatgtttttagctagtgattaattaagtattaactattataaacttaaaataaaattatttattaattaaaaaatatatgtttagcggtttgggagggtgcatatatgaaaaaggagaaaatagctcactttaacgagctagtaattcaaactcagccgagctcgaccttcagaaccgagaatggccaatagattatgcccctggcccttctgctgccccgtccatttcccgtccacttgacactgatgcttcgcacgagagcagattatgccgtgataatcacctttggatcaagcaaatcacgaaaggacaaccttgtccaaatcacagggcgataaatagccagaacatggcgagatgcacaacgaagcagagtgtgcaaggaagagagagcgtgtgctgtggctgtgctgtgcgcctgtgcagctgtgctgcgtttgatcccccttcccctccctcggaaacggggaaaagcaaaacactcccaaagcccaagacggccagagaggaagaaagcaagcaaaagcagagagagagagagaaacaaggcagcagcagcagcagcagcagtagcagaggctagcagcacagagaggggccccgtgattccccccccccccccccctcttcatctttcactttccccatctcttttttttcaccattttaccactactgctgcctcacgcagtcacgacgctgaagtggtagtagtagtacgctctcaaaacccaaccttgaatccgtcacgctcactcacgcagctcacaggctcacagctgcagctacttactactggtacgggctcagggccagcagccagagtgaaggggaggcgaggcgaggcgagccgtgtcaatgtccaagaaatgtgatggcgcgctccggtgaggcgactggttaggttagccgaggagggggaggaggcgaggcgaggcgagggcgagatgacactgcagatggagccgccgccgccgccgccgaggcggtcggtgtcgacgagctgcgacctgcacccgggggagacgttcacgggcttctgcgccgcgtgcctccgcgagcgcctcgcggggctcgaggcgtccaccgccgccgcggccgccgcgccgggccgcaggtccacctccgccatccgctcgctcttctccaggccattcgtcgccgccggcggtggcggcggcggc

SEQ ID NO: 13051 - DNA, 6114 bp, Oryza sativa
cccggacctccggcgatgcaagtcgttctcgtgcggccacggcggagacgtgctcgccggtggctgcggggacgagccgcagcggcggtcgtgtgacgtgcgcgggaggagcacgctatgggcgctgttccaccaggacgaccgcgagcgcgtccgcgacggcacggcgttcggggcgttcccggcctcgtcctcagccgcggcagcggcgctcgcctctgaagtacaacctcagccgccgccgccgccgccgccgtgcgttcctgaggtgttcctggaggaggagatagctatggctgaggagtctgacgagattactccagtggtggagccaatcttggtggtggacacctccggggagatggaaacggaagccaatggtggacgggaggccaaggccatgaaggaccacatagatctagagtgttcgcaggccaagaagccgcagcccaaggacctgaaggaaatcgccgggagcttctggctcgccgcctcggtgttcagcaagaagtggcagaagtggagacgaaagcagaagctcaagaagcaggacgccgctggcagcaaggcagcagccgcagcaatgccgccgccggagaagccctccaagccctcgttcctccggcggagtcgcctccgtggagaagcctgctcggagttcgccggaggtcggcgttcgtgcgacactgacccaaggttctccctcgatgccggccgaatgtccgtcgacgatgtaggcttctcctgggacgagccccgcgcgtcgtgggacggctacctgttcggcgccggcaccggcattggcctcggccgcgcgcccccgccgctctcccgcctgccgcccattctctccgcgatggaggactccccagccggcatcgtcgagcgttccgacggccaaatcccggtggaggacgactcccagccggagcccgatcccgacgccgacaccccgggcggctcggtgcagacccgagactattacgacacgtcgtcgtcaagccggaggcggcggagcctggagcggaccagctcggtgcggaggccgtcattcgaagtcaccgacgcaaagccagtgctgccggcggcggccgccataacaagcgtcaaagattcgccgctaattgggagctcagagttctaccacttccagcatgccgaggacctgctcgaacaccaccggttcagcaccagctccctcatcgaagacttccccatgagcctggacgccgcgttcccgggccccgacaagaagccccggaggtggcgcaaggcgtggagcctctggggcctgatacaccgccgcgccgccggccgcaggggcggcgcgtccgacgtcgcggacagggccttctcggagccgtggccggagctgcgcgtccgcgggtgcaacgccaggatgcagcggtgcaacagcaacgccagcgcgcggagctctttcagcagcaacagcggcggcctcggcagctcgaggcgcagctacgtcgacggcaacggcaacgtcgtcaagcggcggcgggaggagtgcgccctggagcgcaaccgcagcgcgcgctactcgccggggcacgctgacaacggcatgctgcggttctacctcacgccgatgcggagcgccagcggccggcgcgccccggggctaccggccaaaggcggccggcaactgaggtcgcaatcgttcgcgcgtagcatgctccggctgtactgagttgtgtttttcgttgcagcagtagtggaggctcaatggcaatggtataaccataaatctttttttacatccttgtgtagcgcagtgttaattccgttcatttggggggttggattggatagaatggaggtttatctcataatcacctcttaatatcttgtcttgtgccgtagtatctggacaacgtactaactatcgataacgtgtagtagtagctgtagtaatgctgcaggccagaatggcagatcgaccgatgatcgggatcggaggatagaagctgcagctacagctatcctgcaaattctaaactggtgtccaagtcatggtgaagaggggtcctactagacagtgccgaattctgaattcgtttgacatggcgctgccttgccaagcggcagctgagcgctactactaggctcggccccggccgctaggctgcacctgaccgaccgatcccttcgcgaactgtagctgccgctgcctcggaaaccgttaaagtcgcgctcgtattccgctggtcccgccgtgccacacccccaagccccaagtgctgtgcgcgcgggcgcgcggcgtcggcgtcgtcgcgtcgcgtgttgcgttgcagctcgcggcgcgggtgtgtttgttctaccgttctactagcgtttggatttggtcggttggcttcacgacgctgcggggtgcgggccgtgcgccgcggcgggcgcgtgcgtgcgtgcgcacggggtttgttggggtccggcatctgtgggatctgtggggaggggagattctgatttggagggaggggaggacgtacgtggccatgaggccatgagggggggaggctcaagtaatcggcggtgtgccggatctaaggtcgatgtgtggggattatgattatcttatgcgtcgccggacatgtgcacgagaaaccacatgtttggcgaaggactcatcgaactggtactggaacacagttttttttttttttttttgagattgttaggaagggaaaccggagtttgcattgtaagcgttgaatggttgccataacttgtaccatgtcatttctttttcagtttatttacacgatccgcttggaagcaagctttctctcgccccccacaaacccttaatcaatgttataacgacgctgtcgtctctaagactctgtaacctttttttttatctatcaatgaaaagttcaggtgggaaaactctcctttccagtgttttatcaaaacaaatagtttatttacacgaaacatctatgcacacattcctcgcaaaaaaaaaaaaggatgtatacacacattcactagtatgcctgttaatacatggttaaaacgagaagatcagcaacaaatatctggcctttgtcgctgaactcttcaatatttctctaccggcgtgggagttatatttaaccaaggacctaagaggcgaaccaattagctagtgatcagctaaatggggatgcaagtgaacaatcgcactattagagtgaaaacagacaggtacaatcatattatgatattctcatatcttaacatatattttcctttaaaatcagagccagagccagatacgaatagtactagataacatatcactcatcccgtattctattcagtattatttccttcgaatcggattcaggacaattatctatttgtatctctagtttatatatatataaatataagaggcaattatagtgttagaagatatacaataaaggaaaaaaatatacaatattacatgtgagctcgtaaaatagtgattaaccaatattttatcatgtttgtaggtggatttataatagacttttatatatgttttataatataggacatacggacacggctacaagtctttcatattctaacccatatttttcatggatggatattatcgagtatctctttttctcccatatttttctcgcaagtctcggatcgggtgagtggctgagaaatacacgcctcattttcaacccaacacattatccataaaaacttgcttaataatttatttagtacaaagtttgaattttttttgactaggatgtgttatgcaaggaaaaaaaggttgcccaccctacttgcgttcttacaaccagatggttagaaagagaatgtgtcggaggtgaggtaaaaggtgtattttttgaagactttttgtcggctgctgcttataaggtaaagatatgtctgaagcgagaaaaataattttaggataagatttacatagtttttctctctcaagttttagccatccaaaagccaaagctaagtaatatttttttaaaaaaaactattatcaaattgtcgacgagtggtacttgtggaccggatgagttgggtattgaggtacgttagaacgaggatctacataatacgatatcaagcagacaaaatacaaggtttatactggtttaggccccttgtcaggtaatagccatagtccagtttatatgagattgatgatgaggaaccacagattacaaaggaagtaaacaaaacagatgataccgacaagatcgtagtcgatgaattcgacgagatctcccggcgacttggctccgcgtactctggcttcgtgaactatggtgggtgtgtatgcaatgaaattcgatgccttgcacccctccctaggggtcccttttataccacggatcatcttgacccccaattaaggcctggagatatttgatctggtacggtataacataatctctatcccttccaagtaggattttggaaatcacttatctcgtagagatatttccgtaatttgcaacagattccaacgacgtatacggaaacaatccatatacgtgaaagtataccttatcggtatattccataagtcgtaggataggaggcatgttttatccgtaaccctgacacaaattaaactacaaatttagaagttggttagttcaaaaaaaaaacatccggtctggagagggagttgtggaggagaaagagaggcgaaatgggttagagttatcaactgtggaatagaggcagcagctcatctccgtcatcagggagtccaaatctagcaaaacctggtctcgtagctaagcccgtcaccctagttgtcttccacagctcgtagccaaatctagccaaaaagaggagatgaagaggtagtatctcgaccaagcagtatcccttgagcttgcgagtcaccgagccattcttggtcgtccctcacttcgttatcatgcttcttcaacaagcacctatgcacgagggagagctggagacgaagatcattaaggatccgtcatgatttgaggttgtttggaacctctttgttgcaccaaaccacttgtcgctatcggggttatccggaggagcttgccgtgcggcagccagccaacagcagctacattgctgcaaccagccagcagaagatacatatgttgcaaccagccaagacattagcaagatacattgtttcctcgaatccgtccgctgctggcctgctgcaatctaacggttggcctgcgcagccgcaacccagggcggtaaagcagctccacctaataaccctatcgtagagtctggatttagactaaggtgtagatctggctaagtttgtgttgctcaccgttgtctagatctgagatatatatacggtggatcaactcatcaacccttaggttagtctccttccccctatctctatctcatctcgttgtcctcttctcccattttaaattcatgcctcactatttctcgtgttaccgcactatgttagttcttatattttgggataaattttaaatgatagatgtagctatatattttggtatgtagggagcatttcacgacacctaaacttttaaattaatgatatgttgttctctttacatttgactttaaaatgtaattagcggtggaaaaacttgaagctcgtgattcggatcgacttaatcttgtagtcataattagtcgaaccgaacgggcttttagctcatgagtttatcaagtcagttcgcgagctgctcatttaggttgttagcataaatatcacaatatctaattatactttgtgccgtttagccagtgcttaatctttagcgacatcaaatcaattttatgttcacatacgtataaatttaaaattatagaagtggtataaacaagatgattttttttttgccgggaacaagatgaaggttgttaactacttcctctgttccacaaaaactcaaccttctagtaaaatgaatgtagacaaagagatacccaggttcattgcactagaaggggtcacatcccctcgtaggtttagtttttttgaatggagagagtagtctactcgcgagtcgggctgaatttttaatcgttaaggtcaatgagctaagttaaacccaaatgagcctaatcttgattcgttaagggggt

SEQ ID NO: 13052 - DNA, 9727 bp, Oryza sativa
tcatcagtcatggacagttggagttggacacaaggcgattctttccgagagcgaagcgagagtccatcgacagggctataccacggcggaatgaatacgatgagacttgattgggcattcagatgtgtacgtgatggcgagtgaagtggcagcgcagcgcaggcgggccagctagcgcctctgatacccccgctgttaactctcgcattcattgctctggctgccgcagtgaaggcgaacacatacgagcgaatatatggtgatgctggcttatcgcatcgacgttcctttgcgtgactcttcgctcgttgtctcatctcatcttctcatggagagagccatctacatccattccattccatggacttctcctgttaacagttagtaggcaaccgaactgacccgactgttagtatacgtgaagtagtgagactcgcgtggcataacgtacaacatgttgggtttcggctgttctacgtgggccgtgcagtcagtcacacgtagtactactctctcggctgtggatatactccactgtggtgcggtgaacaagaacagagatccacggaacaagtgcacggtgcacggaaggcgctgtactgtacagtttgtcacctccgagttccaacccgtttccattacggcgaactgtttcggtcttttccgtccggcgagtacttggatccatggttcagacgcagtaatcaactgccagatggtagtaacagtagtactactagtagtacctgtctcagtgctggggagcgggaaaaagaacgcacagattcgtctgaaaaacatgctcgtctgaatttttactgttgcctacccaagactgaatatttgttcatctccttgcggtagaggccgtgttcgacgtcgtcggcgttgttgacgacgaccgcgccgacctctccccgattgcgtgccgtgccatggccgtcggacatgtcgggggcatgctctctgctgatctctctaccaagatcaccggccgccatgcaccgtcgcgatgaaccatgtagatcttggagcagaagagggaacattgaagcagaacaagtagcatgaactatctgcagggtcagcattggcctggttagagttgactgcggaacaatccccaggggagcacaaaatcgttctccaaggagcgttgctcccatccagcaacttgtaccggcaggtactggtaccggcaggtatagagataaattcatccatccatgttagaagggtacgatcggtaaacagagaaaggagtcgcaccctcgctttctcctttttgttctttctctgtttcctccctccgtgcggcgccgctttctcatctaatctccttttttcccctccctccgagcgcaaccccacccgtgcgaagcccgcctgagccgcgcgcatgctcgccccgcatccatgcccccgcctgtgcgctcgcttgctcgccctgcatccgccgcccgcggcggcggaaccagcgagctccttcaccagcggcttcattcacacccttactcgaattgcagtgatcagtaaaatgatattgcagagaacaagcaacgattgagctcatcaaaacatccaataaatcgtacaatacaaatcctataagtaatgaagaagaagagcatatgcagcccagaaaataaaagtatctactgctgcaaccaaccgaagctaatgatttagatcggatgaaaagaaatcaatgcatacactgcacatcgcctgctaagatgactccatgaccacctcgccgctgcagccgccacaacgccggctccgacgaccacctcgtcaccatggccggcaccatcgcgcctgtcaccacctcgcagccaaggctgcccacacaccagccgccgccgctacctcgtgaccgcggccaccaccaggccaccgccgcgcccaccaccagcagcaccaggccactgccgcgcccgccaccactgcacccaacacaacctcgccgcaacgaaccacttgccgccaccgccgccgccgccacctccgcctcaaacggatcagacgccgccgcctcaaatggatcagccgccgccacgccgcctcctcccacgaagcaagttgccgccgacgaagcaacttgccgctgccacgctgcctcctcccacaaagcaagttgccgccgccgacgaagcacgaagcaactcgccgctgcctcccctgaacactcctacgcgaaaaagacaaatttacccttccaccactcgaaattttttggtacctcctcatgggcaaatttgtacctagaggtaccacttattttccaccgtccgatttcgctgattgaatggctgggatttggtaccggacagtcccgatggtacctgctggatgggagcaaaactcttctaagtggttttcttgctttgtctgaaaatgctctctctttcgtgccaaaaatgtagtattgacgtaaaaatgacaagtcagattgatcatagcatagttgagttagccatggaaaactgttcttcaggccatgctgccatgttagaacacctgtaaggattttcttcgaagctacgtaaggctgatcccatgtatgagtgatcgcagtgagacagttcttcaaatcatttcagacttcacgttttcatcacagcgagagtgccagtgacttggggtttttgttcatgccttcacagaatcacatttcctccggtgtaacgcaacgtcgcaacgagtgcttcgccttggttggtgtagttgcggacgagtaaagacggaatgcattttaaaatagacatactctaacgattatggataacagtatgtctgataaatgtacaacaattaatagtatgcccttaacaggtgtcaaatactaaaaatttagtactactagagtattaaattttggtaggagacgtaaatgaatacaggtgttcagaccccttacacctgttctgaagtgaatcgtgagaaaattcatcattccaaaccgggtcgtcaactatttcgatgagagaattgatcagcatatgtgagcgctagagcttgttaccttgagtgggctttcaacaagatatatatatagaaaaaataacaatcgcggtcgttcgagttacccccctcaactctaataccagttatttttaactctaaactttataaaccggatgaattaccccctatgtcgatccagggcagttttgatcctacgtggatgcatacatggcactccagtcagcaaaacaaataaaaaagatatgggacccgcttgtcagccaaaaacaaataaaacatggtgggacccacctctctctttcccctttcccttcctctcaatctctctctctctctctcagatgtcaccgggagcggcgactaggtggccggcgatgggcgaggcgggcggcaggcatggcggagagcgggcgacgggcgcggcgggggcgggtgtggcaagagcgcggcgtcgcggcgaagggagtcgcactcgaggcggagggcgtcctggcgggagcggagggcggtgtcggtggccgcgtccatgacggcgacgcacgagatggagctgcacaggagggccgcggccgccgctcatccctttcccctctccttctcttccgattccctatcctttccagtgcagcgacggtggtcgggctgagaaggcggcgacggcggtctgggcaaagaaggcggcggcgtcggcggtggttcgggcagctgcatgtacatgaggcaggcaggcaggtagcaagtaaggtgttgatgagagagaagaagaagagcatatcatgcaactaggagtaggtaggacgggcagccggctgctcctcgtctttgtagtagttgcaggtgatgaagacgccgccgttgaagcactcggcgagggcgcagccgatcctggtgaagttgagcctaactatgaagacgaagtggccgcacttgtggaagtcgacgccggcggtgcagttgccggtgtccctgtcgtacaagtgctcctcgtacaagtgccgcttaggcaatctctgcctccgccgccggactcccaggcaactgaggcaagctccgcctccgccgctggccacgcgggcgatctccgcctccgcagccggacttccggacgagctccgcctctgccgccggtcgtccgagagtgtgtgcctcctccgttaccagccgtccgagcgcgtgtgcgagacagagagagagaggattgggttgatgaagggttatgacaggtaggccccaacggttactttttttctgactggattgccacgttgacgcaacgtgtacaagttgaagtcaaaaccggtcaaaaacagtgtgaggggggttatatgtctggtatgaatagttgagggtgtaatatgtctggttttatggtttaagggggggggggtaattcatactgtcgcaattgttcagggggtaactcttactttttccatatatatatgaaaaactcctctctgggctcttcaagcaaaaatggcccaatgggcaatgcccaatatggtgttttcttgtgttgtaatatggacttggctatggcaagtctgaccagtttgccattggtactctctctaaaaaaaaaaaaaacttggccattggcatattaaaaccttatcttgtgttgtacacttgtactatgattcagtgaagaatactagcacagtagcaccactatctttctcaaacctccgacgaatgcattcgaaaattttggcaatggactattccttccgttctgaaataaatcaatttagagttggatgggatactatctaactttatattttaattctagattgatttattttagaacgaatggtgtataatgcgatgctctgggttatggtacctttattgcgtcgttaactcgttatcttgaattatccatcacatctgcgtcggctggtgacgtgcttttaatcatgcaaatactaaattatccatgatcatgtacgaaccacaggaaaaagaaatagctctctctatctacaaatataagcactcttgtctcaactaatatggtctagtggcatatctagtggatgtgcgtaatccaactaacatagaaatacttaaaacaacctaagtacataattgatcatgagcttctttcctttttcgcatacttctcttctcaggttttttttcttttttctttacatgcatgggtcttgggctaggtttttttcttccaccgcctaactagccactcagacacgctttgcgcgactataagcactgacataacctgtttgtattattagcgggccatcgagaagagcttgtggttctcttcacaagtggtttcaatagatgggaattagaccagaccttgccgatgtgcgctctagaaaggatgtattgttgtcccacgccagctcatcatatgtggggcagctatgacacaaaatccccaaataaaatcaagtactacctccgtcccaaaataagtatagccgtaaatatctgtgcacaacgtttgaccgtctgtcttatataaaaaatttataaaaaatttaaaaatatttagtcacacataaattactatttatgttttatcatctcatagcaataaaaatactaatcataaaaaattttcaaataagacgaacggtcaaactttgaacgtgaatagtgcaaaactgcacttattttgggacggagggagtagtagtatggctgtgtttagttccaccggtaaaaaaaattgccaggtcacatcagatatacggatacacatttaaagtattaaacgtagactaataacaaaacaaattatataatccgcatgtaaactgcgagacaaatttattaaccctaattaatctgtcattagtaaatgtttactatagcactacattttttagatcatggcgcattaaggcttaaatgattcgtctcgcaatttacactcaaactgtgtaattatttttttttaatatttaatactccgttatatatgttcaaacgttcgatgttgcacaatatgctctgagcacatgctatggcctgtcgctagatagtacagtagtttattggaaatagcacaagttcagaaaaagattatagaccggaagcctgctagagacctctagaggaaaaaaaatcagatggtacggttttgtttgatgacatggcgtaatacgtagtaatttataggtaaattttgctatcggacatcgtaattgtgtggttttagctcagggtctctgaaagtaaagttttgggggaagacatcccataaccgtggacatttgcctatggacaccgtgccatctgtcgtgctgacgtggcggacgggaggcccttttttaatgtggtcggacgtaaatacccctgcgcaagagataataaggttatgtggggcccacttgatagtgtccccctcctcttctttttcttctctctcggcttcttctcctctcgatctctccctctcgtttccctttttccccacgcgcgtgcgcgcctgagcgggatggcaggcgcgcgagccaagagaccggccgtagcggcgcgggccgaggcgacggcggcggcctgacggcgtcgggtggatggggaggcaccgtggcggacggcgacagcatcgggtgacgccggtggcgaacaagccgccgagcaaggccatgggcgaccccgccgtgacgaaggcggacacaggcggcacgtcgcggagtgtgcgccagtcggcactgttgcacttgaagcctgagccgaagccgatctgccagacacggtggccgcgatggacgcgccccttggcctcggcgtaggcaagctcataccagagcgagccgctgctggtgttaattgcatattaggctcaacatcccatgttaattgcacatgcggcataggcacattaggctctctctttgatttcctgcatcaatcaagctaggcttggttaattaatcaactcgcagattattgtatatcactcatcattgtttgtactagatcaaacacttttgtgcgtgcggttacctcgatggcgggagcaagagcaatggcaggcggcggcggcggcgcgagccagatgcagccgccgtcttcgctccaccactcggctaccgcccgaggcagcagctccacttccgccgacaggcgtcgtgcgggccggcttggccgcgcgcggggtcggcgctcgcagcgtggtggtggccccgagcaagacgaagatggcggcggtccgggtggcgattcgtccgggcggagatggaggtcggaggtgctgacaatcgtggtggcgaagcagcagtggcgcgcgggtggtgctcgcgcgggagatgtggccgcgcgtggcggcagcggccaagcgtggcgacggcttggcgcggcggcggagaggtgaaagaggtagttggcggcggtggggagtggcctgacgagaggacttttttttttctgacgtggcataagggtatttacatccgaccacgtcaaaaactggacttccgtccgccacgtcagcacaacaagtatcctttagacgatacagtgtccatcagcaaatatccacgattatgggatgtcttccctcaaaacttcactttcacggtgtccctgagcttaaaccacaaaattgtgatgttctgtagcaaaatttgcctaatttataagaaagctcgctgttttcactattttagatatgctactaatatggtcttccatacactcctttgaccatgactaaatgtaaaattgaattatttcaaataaaataatatcagcatattatgatagtttgtttaacgataaatctatcaacatcatttctatgtcattggttgttatgattttttttctttcaataggtaaagttaaaaatatttgtattattattattctaaaagtgcttatatttatacatagagagagtatctaaaacaatataaacaatataggagtatatgacaaaccccgaggttacgaaatacgaacatacttgaaagtcatgccctaatcgttgaacttctttttgcattataatataaaacgtgatcttacctgagcgtgaaatttgccatgtaatcccaatatccttatgaaatagattcatgtgagacgtgtacagactccacagaattagagtagtacgccagaaacagaaaatgccaaaaagaacaaacgctttagaccggcatcggaggtagcaagatctgtttgcaactttgcactgcgacatgatcgcggtggcagaccaacaagatgccaatctatattctctccgtccttataatcgttgatttttgtttctataacgtttaatcatcatatatcatatttaaaaatgtagtataaagtatgacttaagataatagtttcttcaataataaatcaagtcacaacataataaataatatttatgtaacttttaataaaacgaagggtaaaatcgacaccatcatacgtttatagagggaatatttatctttttatatattttcttagtctcataaaaaaaaagtaaattccggctatgaatttagacataggttacatctaaatttatggctagatgttgattttttataacacggggaagtacatgtcttgtcttggttatatctaaaaatttatggctagatattgattttttatgagacagaggaagtaactgtctttgtctttggttacatctaaaaatttatggctggatattgatttttctatgagacgaaggaagtaccctgtcttgtctaaaggcaatttgactgtgttcggatgtccctttttccaaccctccctcccttatttttcgtgcgcacgcttttcaaactactaaacggtgtattttttaaaaaagtttatatacgaaagttgctttaaaaaaataaattaattcattttttaaaaaaagtagctaatacttaattaatcacgtattaattaatgaatcgcgctattttccgtatgtaccgtagccggttggaaaccagcgtctgcgaacacaccctgaatgaaggaggactgggcggcggtcacaactccagagtccacaccaagcagccccccggcgcgctgctggtcgcacacgacaagggtgcgcgcgcgtgtatcaccggctgcactcggccagtccgccacctcctcctgacctccccactcagaaacgtaggtaagactaacaaagaccagtccaccacctggccggtcttacattctcagtttctcaccacggtcacgccgaacgaacgagacggcggtctcgctcgctcgctcgctcttcgttcggcctcggccgcgcgaggtaggtggcgcgactcggcgcggctcggctaccgatcgcgcgtccccgcaatccttgaccctttccaaatcccaccaacacgagccctcgttttaaatctactcgtgctacgcttacttgcttacacttgacgaaccaacctcactttctccccgtagctggctgggctgtggctcgctgctctctcatccgccacctaccgccaccaccttccccccacggtccagctcctcaccgtcgtcgttcgtcctcgccgagtcctaatttataccaacccatccaccgggcgatcacacgcacgcacgcacatggtcgattggttagctctctttcccattgccatgggccgccgcctctgatccccctcgcctctcgctaccgagttgctggccattggttggttggtggatcgggtttgtctcgccggggcgcggggggggggggggggggggggcccatggcctcaatcaggtcatcctt

SEQ ID NO: 13053 - DNA, 35141 bp, Oryza sativa
aggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggcatggagggggtccggcacggcgccgccgccgtggccagcgtgccggcggcgtcggcgtcggcgttgccggagcgggccaaggtggtggcgctggtggcggccgtgatgctgctctgcaacgccgaccgggtcgtcatgtccgtcgccgtcgtcccgttcgccgcgcagtacggctggtccagctccttcttgggcatcgtccaggtactcggttcggggtcttctttaccttcccagttcatgccatctctttcacttcacttcactattagtagcacatcgcacaggttccaattcatcgaaccttaggcaagaatctctgctctgtcactagcaacaaaatgtccaaaaccataattagttcatcatatagcaacaaagtcaacgaagcatcaacgtcacaatcgcgacaagagaatgaccggaacattacaattagtagcacaaacagacaattatggcagtccagggtattagctcctttctgtgtgcaggtccagtgcaaccgtgtagcaaccaagttatcttaatacgattgttttgagagtggaacctgaaatgaaatttgctatgtgcttcacacatgaatcgtgatgcagttttctatttataagatatatgcttagctttagtggcttccacatagatagtgtagggtaccaatttggaagaaaccaatctgtgcaggcataaaggtcagggagcaacttgaggtggtatcgaataccaatatctcctcatagtggcaatattggaatttgataactggaatactaaaacatgcaacccaactgagttaagcattgcccctcttttttggtgatggagttcagcacttcagatttacttggtgacagaacatgaatgtttcataacaaattaccagctagcttaaataccattgcaacatttgaagtcattcgataacaaaaaattgtttccctcaaataaagaacggcaaaagaatttgtgcatgcttattgtatatacacttgggcaacaatatgtcttgactagatggaggttcacataaagaagtcatcgtaaaaaccaatatgccgtaacactaccggttctatatgaaattgtcaatgtgcataactaactaggccagaacaaacacagcttgctcttttattattatgtcatgcgtgattaatgatttccagatggattgacttgaggttaatcttctcatcacctgtacagtcatcttttctttggggatatgttttctcatccatggttgggggagctttggcagaccgatatggagggaagaaggtgatggcaggtgctgctgccctctggtccttggccactttcctcactccatgggctgcttctcaatccacaattatgttgcttgccatacgtgctctctttggccttgcggaaggtgttgcatttccaacaatgagcactttcttaccaaagtaagttgctctatattattttctggtgatgccaattctagttgttagagattagagattctggacaagaatttattgatgcaatcaaacacaatctcatttcgggctttcaatctcactttgaacacaaaacaggtggttcccaacacatgaacgtgctactgctgttggcatttctatgggaggattccatcttggaaatgtcataagtttcttagcaacaccgatcatcatgtcacatataggcctcgccgggacatttgccttctttgcatcacttggttacttgtggctttctgtatggttgttcaatgttgaaagtgaccctcttgacagtcgtacaataagcaaatctgagctgcaattaatcctagccggaagaagtgcatcaaaaattcagggtagcaaattcccatccttacgagaaattctgtcgaagatcgaaatgtgggccatcattgtagctaatgtggtcaacaactgggtaagattgataaatcagttatctacaaattggtgttgacatatctatctaaattttaacttccgtgagttcgaaatactatgcagggctattttgtactactatcatggatgcctgtctactttaaaacggtatgttgtctaaggtgttcaaattggtcactgtgacaacgctgctattaagctaattcctgactgctatcctacaacaggtttataatgtcaacttaaaacaagcagcatggttcagtgccataccttgggcagtcatggctctgtctggttacgtcgcaggagcttctgcagatttcctgatcaaatctggtttctctgttgcattagttcggaagattatgcaggtaacagcaacacctgaaattagacttgtgcagcacttggaagttactgatagcttagcacagccagaaacataaaacttaccacaattttgttctctattcatgcttggtacagtccatcggttttatcgggccaggcgtttcactgctttgcttaagatttgcccagacgccatcagttgcagcagtcctcatgaccatcgccctgagcttgagttccttcagtcaagctggatacttctgtaatgtacaggtagtgtttcctgcattaccctgctcataccagattccgccttaactcgaacaacctttttttttcttcttgttcaccacctcaattgcaattgtaccctatctgacggaatgtgttcttcttgattgttcgagcaggacattgctcccaaatacgctggatctctgcacggtgagtccacaaactcgatcagctgtacacaagacccacaccaaatgaacgcactccttggatcctgaaatctgacatatcttcttctgcttgaacaggactgacgaacggcatcgggacagtggccgccatagttagcaccataggaacaggctacttcgtgcagtggctaggatccttccaggccttcctcaccctcacggcggtgctttacttcagcgccaccgtcttctacaacacctacgccacaggcgacctaatttttgactgagatgatgacattacccctcgtgtaaaatctcgaagtgtagtacttccaccattgtttctctcctagtcctatggctgagccaggaaaccaataaacagatgttgattgaaattgattgattgactgccatttttggtgtaaaattgagtgcaaccgcggttacttttgaggaagcaaatcgttaatacaggaaaaaggggtggagccgctcatacgcggttcaggtgttcgacgaaattaccgagccacgcgcgcggaaggaagcgccggggaggggcatggagcggcggtacccccatggcgcgcgcgcgcgcgcgggggggatgctggctcgccgccggtggcgccgcgatggaagacccgaagaggcgagcagccgactgcgcggcgtcggcggcgtcgcgcaaatccatggctgcgaatgcaacttttcggccgtggatgtggtatgtgtggtggggggcgcgtgcgtccgttgctctcgggtgagaaacgtgggccggtggattgagtgggattcttcgctttgggctatgtaggccaatccttcgtccggcccagctaaaatttggcctgtacacgtttggctattcaccggatcatcccatatcctcttggtatttcctagctcgaaatcagaatgaccataagctgacagaactttttatctggcaatgacccattttccatagacacacggaaaatatccttacagcaaagagaaaaaactgacagaactggtactctatccacttacacggttacaccaatcattcatgatactgagttttgagtatgaacagtgaagttgcatacgacaagttcacataaaacacgatgaagagcaggacagattcatgccttataaaccttgcagttgcagcgctttcatttctctacctttctctgagttcctccgatatacagaaggggctgctctatgtgctctttattctcttcagatgatttataaaaagattcatacagcagaagggaacccggtcaggactcaggagtcactcctgctaggcttgtttgaaactggaataacctggaaaaggaacacagtagattagtaagtcaccagatgaccatatgcaactcggtattggctagtccacatacatttttactgccataccgtctctgaggatggtatccaatcatttgttgcagggttgctcatgcagcggataatgctgtcagatgagtaggcaacggttgtcacgttgaaggagctaccattgggtctttccactttgataaaccctgtaccagtctgtaaagataacaattaactcaaccatttcatagagtattgtcgttttgttacagaatgcgcatggtggtgaaattagaatcgataatctgttgttcatggaaatgtattctatataaggtacacatgtttttttttttttgcgaggatataaggtacacatgttagtgcccctgatctgaatgatatgagccatcacatgtgacacaagaactccacatcagaactttggaattcctaacaatcatcaaccattagttctctttgcagggcctaaactatatttatgttttccatgccagtaccggagtgagcaatgaactgctagctagatacaagaggcttcggaaatgcacaagatattactggcaagtggcaacaaaatgcacggcaatgagtttaggtatgtaatggttagcatgtaagttgttttgagaggggaagactacactatacttaattttcatgacagactaaagactccagatttgtgtatgcattcgactagacagcagagtctattaagagaaatgcttgtgcaagaaggccagtgttccggaatcgcactgggaaccagaatcgacagatatacagcttatttgagcactttggttgcaatgacggttcgttgcaggcttgcagccagttataacattatttgatagtatttcaagggaaatgctatggtgctcaagtcttttttaaggttctcgtgcaaacaaactttcttctctaacgaatttatgactaacatgcgtcttctcggaaaattctagccattcaattgaagactaggtaacatgttatttatcgacaggtatttgatctcataaaacaaaaaggtcctgaaaaatattactaacaaattctttactggtatatcaaatttctctaaagaactagtatatgcccacatacccacatctacgtgctataaatttggtgcttggtaggcttcataggcagttaggcacaacaatactacaaagcttaccgtgtggtgttgcttgtcgatgcaattgagcccgttgtagtattgcgtctccacatactcctccccgttcacatccccaccgtccagcaccaacttctacagcaacagtcagtaccaattagtaccaaacagcacgctcacatcgatcgattcagcagcaacaaattaacaaaaccagaattccacaaggacgaacagatcgccaacctggggtttggcctcgaggtcgcggagcctccgaagctccggcaggtcggcgtcggcgtcggcctccgccccaccctccccggcgtccgacgggtcgctccgcggcggcttggaagggcgcctgggggccatgctgtcgaagtagccccgcacctcggcctccacccgcgccgcctcctccggcggcaggtgcgggtcgctgcgcgccggccgcgtcgtcgccatggcggctcagctcggtccaagactgggttggcgggcggtggagtcgccggtttccggggggcggttttgcgagcgcgaggatgtccggctgacaggtggggccctggtacgtgggcaaggtggcgatgccgtgaatgtggatgagatgagatggggacgtttgatcgcgattagctggggttgggccgggcgaggtggcccactgttccgtgagccgtgtgaccgcgacgcggcgtgatggattttgcgagacggcgaagtcgagaacagtaacaatcttcatgtgcccgtgcaaatctcgcgtgctagcgacttcccaattgtaggatgtgatgtgtttctatcattgttcaaagtacaagaaattttcctttattttccaagttctctgtttttcactggcattcatgtattcctttttgttcttttatttctgaaatcttacttgacaacatgatatacctttctaaattttagtttggtttacgtcccaaaggatttccaaccgaccaaacgaataccttcgcatgatatcgtgaaagggaaaagtccacttttaactctctcaaataaagatcgaatctaattcatgtatcatcaattgtaaaatcgagtgtaacagctatttcaactattaaaaccagtagaaaattactcctacgacaatattgagaataatattggttgacatggcatattgaccacagtcaaaaacaccgagtcaacaagaaaattgagaatactatatggagcccacatgtcatcctcactattctcctctgtcttcctccttcctctctcccccatctctctcttctccttttacgaaggtagttgttgatggcaaagaggtggatggggaatcggtgatggcccagtcccgcctaatgcgcccacaccactttggcatgtcgtcatctctactacgatagctggactccacaaaagcagcggtaactaacgaacctgtgataaattttgtggtcagtcacgcatccagagcttggcaagcccatgcaacatctttctgatataagtgtgcaggatggaggggcccaccgtatcccatatctaggaggggccggcgatgggggccgaggctgattgacctcccttcacgtcggtttccactgcagtcactagcctgtagcccagcagcctcctctcagaagccgcccacatctctttcttcctcctcttcctctctctgctatggtaagtgataaggcccatgagtcggagatggatcgagcaagggagggacccgaggctagtggttgcaacagggccggtattgtcgaaggggaggtaaagcggtggggcagcgcaaagaggaagatgcttttctgcgagcttgattgcaaaatccattggagaagggatgggcccccgcgagcatgagactgcatcatcgtcgcatagggtggcagccagcaggtcacggctgtagccacagatgatactaccaatgctggaggagaaggcagcatagaggctcatggggagagagcgatggcggcgacggaaccccgacgtggtcggaaggctatgctaggggccgctccccttccttctaccatgccttctccttcgctcctggcccgccaaagccgtcaaccaccattccccaatcgagctcgtcggcgtcatcgctatgtgcccatgtggggaaaggaaaagaggacaaaggaacataaaaggatgagaggagaagaaagagccggtgacactaacatgtgggcctcacatgctgactcaatcaattagacctagtcaataagtcacgtcaatgaaaaccactcttcaaactgctgagggagtcaaaccacaacggtttcgatagtttgtcaaaccactcttcaaaccgcaagatatacgatattgtgtttaggggcacgaattagattggaggtatactcgagggagctaaaatagacttttccatcatgaaaagccaggctaagaaatttgttaggtttccatcatgcgttagtttccagatccaaaataaagccgggcccaaaatatattcctcgatgcaatttgtcatggatcgcgattactgctagcgatatgggcctaccttgatcaagccaccaccgcgtgggttttagccgtcggagctgcgccgccgaatcccgccacacagcccatcatccatcagccccctgatgacgcagcgccgcccctcctgcggccgggcttccgcctccggcgagggccacgtgatgcgcgccttcgtccgtacgccctcgccgtcctcacatcgcatcgtcaaaagcttccgcaacatttcttaggctgtgtttagttcatgtcaaaattagaagtttggttgaaattggaacgatgtgacggaaaagttggaagtttgtgtgtagaaaagttttgatgtgatagaaaagttggaagtttgaagaaaaactttggatctaaacacggccctaattccattccttccaaatttacaagtaaggccgttcacaatgcaaggagctggcattcagcctgagtcctccacgtccgccagcacttaagattccatgccacatttcttgatggcccaccgaaatgaagagaacctgtgaacctgtgaccaaaacctgccactcggtctttgatgatatcaaggcaattgcagtgcgtggggctttgcctcgcctttgctctgcatggatttcgctatgtgactcttgtgtcttttgaaggtcttcatcctacttgtcagttcaggacgagcaaaatgcaaaacgcattgctattgcccttaacaagctacaaattggtagagggggacggtcttagtccttatagattacatcaattggtgtgtaaactacaaagtacaatcttttaatgtgtattcccatcataatctctgcttgtgatttttagaatcgctgtcagcgacacgctcaatacacaccgaaggctttagctgaagatgacacttcacctgtgcgatctacatcttacgtgatgtggcacggaggaacatagctgccgccacaagtgttcagacatcacagaacgctttttctggagtaaatgagaattatacttctactactaggtgtcagtcgctcagaattcagaaacatatcaagaatcaaagatgctgttaggtgcccggtggaacggacgcaggtatgcgtcatttctataagacatgatccctccatcccaactgcacagatcagacaagttgattggtaaatacatatagtgagaactgaacgctgaaagagagttgtaaaattacaccacattggaaaatacaagttgattggtggtgtaattttttttcgttttttcctagctacgacccttcagagttgtaatcttatgattttttttgttttatccatagaacttcgcaccgtttcgtgcgagtcgttcgaaaaaaaagctgaaagagagttgtaaagctccagccagcagggccaagtgttcatatgttccatgtttctgtaagtagccagcctaagattttctcaggtgatctcaccgagcttgaaaattctgcagatggtgatttctgcagccatgaatgattcttaagccttttgcacatcatctttccctctccctgctacgtgctggtttggaaacctttgcgacctcatataacaaagagcagccacaagctttggagaaacctttatgagacctttcagctcaacaatccatattgatctcacagcgtgcagtttcggggtgcggaaaagcgacaggtatagcatccctgattggtgtgtagtgggatgaatcacgctaaaatcagttcattcctcctaccgataatgggcgacgcactgatgaggtgcagaataatacaagattgggcgtcggagatagcctataaaccactctatggatttgacacgcaggcatgtgtgcacatgatccgttggggctaagatcaaggaacacatcaagaagcaagctctttgaccggtgatgtatttcttatacgggagttaagctagtatcactctctaagtatgaatcactgtactgtattaataattcactggcgtatagtagtgctttagatagttagatgatgatctgacaggcaatttgcttgtccatgggcatgagttgggctgagctaagtgtgatgtgagcaaatgtcaacatctgacgatggccgatctcatcttcattcatactctttaatttagtcatgcaaaactgataaaaagagagacaaatcgttcctcgtcactcacttattggaattgatcaagagcaccgttgacaccaaactagtccacaaatttgtatgctcttttttttttccttcatgctgtggcctcaaaagtcatctttttttttttccttttcgtggtcgcgcgcgagttatgattgcattttattcagaaggggtcctaatgagtctggacgtaagagggcggttgcagaggccacttgttgttttgtgtaataaaatttgtgattaggacgtgggggagtttggattagaaacatgtactccctccctgccccatattatatactccctcagtcccaaaataaatccaatcctaaagattcgtatttagaattaaatttattttgagacgggagagtataagttattttggtttataagttaactttgtttaagtttgattaaatttataaaaaatgtgataacgtctacaatataaaatagatatagtactccatttgttacaaattacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatatgagacaacctgatcgtcagatcaatacacactcggcggattcaaatccctaaacaggagtagggtattacctctcattgagagggcctgaacctgtctaaatcctttgtctccacatccatccacttttaggtctcgtgcgctaccccgtttcattattgccgaattcatgtttcgacagttggcgcgccaggtaggggttgcgtcgagttttctatcgacgagtgcgatggaatcaactccacgagtcgccggtattatcttcgcttctgtatcgtgagatccgccgccgtcgacaccacccgccgatcaaatcaatctacagagagattcaatctactatggctgccaccagcttcacttctgtcttccccaggatctttctggacttcatcgctgccgccgaaaatccgaccagccccaattagtcggctaagagatcatacgtggcatagcaatcaacagcgagatacaagactggacagctatggagttttttcttttctcaagatcagccgtggagatacatgcatgaatatgattgaacagcatacaccggagagccacacatgttttgatcggtcttatatcaatctaaccgtacatgtttcctgctttatcgctttggttcttgccacatacaagaccatgtcgatctcgtttggtcgccgttgtattcatcagtttcgtcaaaaaggttgccgtactgccgcagtcatcatctgtatcaatctactcagcgatgcagatcggttcccagctgccaacgcctcttgccgactgatatcaaattatctggcaagattgaattactagttcaaagcggaatcgacatggacacagagacagcgtcattagcaactacacgtggcatagcaatcaaccaggaagtaatgatctacacatgtgtgctcctgatcgtgcatgaattgggccaccgctgcgcactccaaaaccggccgtgggacaacatacgtgcatcaagataaactactatcaggtttatcgttttaaattttcttatgtgaaatagattaattaacagatcactaattattatttgatctattgttttaacgcacgtaccgccggccgccctcgtcgctgccgattggattacacgcctccacggttggtgtgcaccgtcgccgttgctgatggcgacatcctcttcaccgccggcctgcctccgtcgccgccgagtggtgcctccgcctacacggctggtctattatgccgccgctgttgggcgtctacgacttcaccgccggcctgcctccgtcgccgccgattggtgcctctgcctacacggctggtctattatgccgccgctgttgggcgtccacgacttcaccgccggcctgcctccgtcgccgccgagtggtgcctccgcctacacggctggcctattatgccgccgctgttgggcgtccacgacttcaccgccggcctgcctccgtcgccgccgagtggtgcctccgcctacacggctggtctattatgccgccgctgttgggcgtctacgacttcaccgccggcctgcctccgtcgccgccgagtggtgcctccgcctacacggctggtctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctactacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcctccattgagtagtgagtcgggggctacagatattatatcatattttttataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagcgtttaaacgtaataagtcatctgctcggggaaatcaaacttgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggctcgcctcgaccgccgccgactggtgtttccgcctgaacggctggcctattatgccgccgttgttgggcatctacgtcttcaccgaccggccgccttcgccaccgccgactggtgtttccgcctgaacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacggctggcctgttataacgccgactgatgctatcttcttcacggctggctacatcgcagtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactgagcgacttcatctttattatcttcggcactggcaaactctattgctgctacttcgcaagttttgctacttcaccaaccacgacgtatttgtgagcctcgacatctcggcatgcgatgccatgttattttactacaacaagaggctctccaatattcatgatttctacttggacatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcaaacattctacttcaacggttgacctactatgcaaatgctgatgagcgtctttgtcattatcattggttgctacattgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatataagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgtttcattattgccgaattcatgtttcgacaaatgcctaaatatatttaatgttggatttaataaaactaatttggtattgtaaatacattttttataaacttggttaaatttgataaggttaggagcctcttctacagtaattttcttttaagaaaatttaaaagtttgattcaggacaaattaaaatgacttataatatatgaagcggactgggtagcatttcttaattttatctctagaacggaactaacttttcactaatctgccagtatacctctcaacagacttatttttccactccactgtagcacaaagctggtacgggcaaaccgatataaaattaacctgcaagcaagatggcgtgaaacatattctggaaaggaaaaagtagagagcgagtattagtattttgttgcggagaaagacgacaagaacaacacgataatcttgtctgagatagccgccacagcttagtggtgcattgcacactaggctctaggtgattaagtggtgtccttttgctttctgatgttgggtgagtgtgtgtgtgtatggagggggggagccggatcgagctgcgttgtgtgctccattatcccggcgcatgcgaccatccataccctgaaaccgacctgtggcccgacggagagtgacccatacttgaccatgcccgacccactatctatttctttctctgtgtggatgttcgatggtcggcttataaaccaaagcgaaatttaaattttaaattaatatttttagtcttatttttaacagattaagaatataaatataaaagttgtaccataaaatcatcatttctagttgtttcgtttattttccacctcttgtttattgttgtcactgctggagaaaccatcttcactcccggttcgcagcccctcacaaattcacaaaaacctcatagatcatatcgccaccacccactaccgaatcgcgtgcggctcgctgcctgtggcctgccagtgacgcgcctcctcccgctaacgcccacgacgcgcctcctcccgctgacgcccgcgacgcgcctcctcccgccgacgctgccgacctgcctcctcatgccgccacacctccacttgccgccgcacctccacctgccgccgacgacgctggcggccagcctccgcccgccgccgcccgtggcctgcctcctcccgccagccgcgcctccacccaccgctgccgacgcggctccgccctcctctagccaccgctgatgcccgtggccagcctcctcccgccgacgcgcctccgcccgacgcccgctgacggagagagctggtaaagggaggaaggatctgaggagagggggggatgtcacctcggagagggctgggaaggggaggaggctgggatctagaggagggaggaggaggacgaagagataaaagactaaggatgggagcgcgaggagataaggatgaaggaggagaggaggcgcatgcggcagcgttttttttttcaatctttggtcccggttggtataaacaacttggtactaaaaatagtgaggggcctgacacaacttgacaacatgttgaaccgggactaaaaatgatctttagtcctggttggtaacataaagtgtcgtgccgcttttgaaccggggctaaaaatgtttttttgtcccagttcctattcgaaccgggactattgtggattttgcaccacctagcaaagatcagtttttcagtagtgtgtgtttaccttttcgattaagcgccagatcactaccctcggcagtatgcgggttttcataaatgtttatcaaaatttgacatatttcgatcaaaatttggtcaattttaatgttttatatttgagttctcaaaaactattcggaatttcacccggagtatactttcttggggtatcgaaacatcaaaatttcgcgattttcggtcagttttcataaaaatgtgaacatgattattgctcaaccaatgagatatagtttgtgtagtccattgctacatcacattctggtgtttatacgagagttacgatgactatgtatgtgtacatgtacgatagtctcgtgctctcacttaacacgttcagcgcacaaacacaacattattgttcctacatagatcacgcatgcgtacgttcaatctgtttgtgatatatatatgcatctaaaagaaagtgagccattatcacgagatctgcatatatacatgttagtatattgctccgtacgatagtcattggtgcgtgtcaacttcggttttgatcgctcgacgagtcgatgataggcatcaatgcgactttcaggtcccacgccgtggaacattgcctcttacaccaacccgatcaatcatcaatcaaggccagcaattaaccccaaccgaaccctgcaccgtagaacctatcttgccatctgtacacaacatgtacacaagctcacgctcgaatgttcgatatatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccgccgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctcccccggcctccctctggccagacctgggaggggaggggaggggaggaggaggggcccggtggggagaggagaagaagtgttgagggagagagagagagttaagagggaaatgagtggtggaggggtggaaggagaagataagagttaagtggtccgtctgcgaaaatcattttcgcaagcgccgcttaagtgatccgcagcgaacttcaccccaatttatatttttataggtggttatttggctaaagggttatgtccgcctgcgaaaaaaagatcctatgtcaggaaaagtgatttttctagtagtgaaaccaaattgcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcagcttgtatatatacacggcgcgtggcaaccgtagatgccagtagagagagcacgaaaaattccagaagaagaagcgtacgctgctatacaaaaggggccttcacgagaccacgagtttcaaacatgaatttaaaaattccagctctgctgtatgcttcaaatgtcaacgacttgcacgagttgaatcaacggcaattaaacaatttaatcgcacgtttcttgaaccattatgttttgcctatttcaagtcactactacataaacctagataggtaaaactagataggggtcgaatttttcaaccgacacatagaaagcataacatattagaaaaatcaaaggtgctggttacagaaccgacacctttaaggtccaaaaaaaagaaaaaagcggcttaatgcatgggctcgaatcgagccgatgcatcgagcagctccccttcacccgatttcacccaacatttaattcatacaatcaattggcatcaagaattcaagaacattgatccaagaacttcaacaacatcaacacaaacacaaaacacagagaagatggagaggatggacgacggcctccgtgaagaggatggagtggcatacgagcagcacgtcgggtcccatctcgcacagctcgtcggtggtggcgaagaaacagatctagcagcacgtcggaaggcgttgcccgtcgttgccgcctcacctcccaccatcgctagccgcacgccactaccatcgcctccccccccccccccgggtcggatctggcgaaggggagggtgctgcccgtcgttgctgcctctcctcacaccgccgcacgtcgttgcgaccaagagagccgacagagagagagaggggggaccgagagagaggggagaggatgcggtggagattataattaagacggagaggatatggatagatggtgctgtgcggtttggctcagctcgattaaggggtgtcagtttttttaaggaaaaagtacgttttacccccgtactattgcggttgaccgaaacccccccccccccaccgaactcgaaaaccagtcatttcgtaccccgaactattaaaaccggatagttaaccccccttaagcacacaatggggcggttttgactggagtcgtgcgcacgtggcagtccaacgtggcaaggcgggctgagtcagcatagtcgcgcctggtttatagacttgacccagaaaaatttcccctccctccctttctctctctccctcccaaaaatttccccttctctcgaaaaccctagctagcacaggcgatctcgttggcgactcctgcacggcggcgagggtggtgcgctccaaagcaggtgggtgtcgtggtcagaggcgacggggccggagatctccaccacggacgcggcggcgacggtctgcagtacggccacctcgacctcgttggcatgatgacgagctcaggtacgtcccggggctcaaggtcgtcttcttgggctggaggtcgtgaacgaggaaggatgcagccgccagtaccatatagggaggggcctctcgattatgagccgccagtgcggctaggtggatttcgtggagtcccagtaaccccgggagaagatatttcacatgctacaatgcgcgtgtgagtaaatttgtatttatttttgatttggctcatttgtttggtttcaaactcattcgatcttggattatacatttatttgtgtagtctggttggttgcgatttttgggagtggcatgaccctgagtcagatccatattggaagcaattcctgcttgatttgaggaatgctgtgtggactgtaagagaaaaaatcaatgggctaaaggctcatctccaggacagcaggaatgaagccttgaagaacaggtacagttgggacaagcttctatattgcagtgcaaaatagaacagtgaaatggaaatacaaagaaataagagcactagttatagttggtggagcatctggctgaacaactttcgtacagcctgctaggaatccctgtttgcaagcagccaggcaaatatatatccttttgaatataggactaggctggtcagtatctaacttgacaacaactgtactcccaggattactcctcagcaactctaactgatagtcaaagattctaaagtattcacccctggtggactcatatatcttcctgaatacaaatgctttggctctcttgcactgcccaacactaacatttgcaaacatttcctctgaaacagtggactgcatgctctgtatactccaagttggattatctgtgatcatcttctcatacttctgagcaatcctcttgtatgtcactaggtggttatccttccttggtgggcaggtgtgttcatcaactagactagctatttgccagctttctgtcctgctattctttgatagcaaacaagcccacgggcaagttgccaaatcacacttggcccttgttctgtaaccttcatcctttataaaccttatgaacctcttgctgtccagtgcaagctgcaccactgcctctttgaattctttcttgccatcaaatttcattcctagtgcaagcctagcaattggcctattcacattaaatctgggggtatttggacttctttctgaccagctgtccatcactatcctcttcataggaatcatcatctgcactgctattgtcatatgggctagcactgtcatcaccctcaatctgaaccaaagctctactatttgtctgcctagatgacccctcacatataacatcatccaaattccctacctcaccatccttcagtttcttcttgaactctttgtaagccttcctgatttgctgaacctcttcatcttcttctgatgaacatgagtctccaccaacataatcactgtcagagtcagaaatcacaggtttcttcggcctctctttacctactaccactgccttccccttatcactaggttcagctactaccattgctttttctttatcaggtgtacgaaatgctcgcacttgttccagatctctctttgtcttctctggtgtagacactatgacaagaacttccttccctatattcaactcaaacaaatcctcatcttcctcatcatcccattcatcatctgcaggagatatgtcctgcagttcatcttcaaagtcactatcctccttgctgccagactcactggacccctctgccattactgtctccacataaatatcagcaacaccaccttccccaacacagtttgacatataattgtagacctcatcatcaatcaaaaccctcagcccatctgcaagttctttgccaggaaacaaccattgcagaagcatgccagggatcacttcacaatgatctttcaaatgtccaactatctcaggcagagagaccttatcacgtttgatgtaggacatcccctcagatccaccaatataaaaggtttccctcccattgttaatgaaatccccaccaaagtgaaatctaacaggtaaatactctagaggatccattcttaacctaaaaacaacatagtaatggcagtacacaatcaatccttttgcctaaatcaattacaaaaatcaaaggaaaacaaactctcacacatccaactgattccatatgccctagtaaaaaaatcctacacttttctaggatctacatcacatacctgcaaagcctagctgcgtcgctcttacttcatcctcctcgacaagcagctggtgctggccgatgtggagagcgtggccgccacgaccgtgccgcagagatccctcctcgtcgcctttgagcgtgccaccctcgttgccttgggcgcagctcactcgccggcgtggagtgcgccgcccatcctcaccggagtcgccgacgagatcgcctgtgctagctagggttttcgagagaagggaaaatttttgggagggaggggaaatttttctgggtcaagtatataaaccaggcgcgactatgctgactcagcccgccttgccacgttggactgccacgtgcgcacgactccggtcaaaaccgccccaatgcgtgcttaactattcggttttaatagttcggggtacgaaatgaccggttttcgagttcggggggtttttcggtcaaccgcaatagtacaggggtaaaacgtactttttcgtttttttaataggtgcatattttttaaaagaaccgacacctatttttatattataggtgtaggtttttttttcctaaaattgacacctctagtgtttaaaggaaggtgtcggttctgtatatttttcatcgtgtggaggtgggaaaagatctataggtgccggttggtacctatatggccggtccttatgagaatttttgtaatagtgagtttgcaaaagtagtgtactgagtactgtacgtacgtaaaataatgtctaatcaaggccgtatacgaagatctggacggttagtttgatcagtttttctcggccaagagcagcaacggagcaaccaaacctgacttagtcgcaaacggataaataatctcataaatttataacgtacgatcggtgcatggtcttgctcgtctaacgaactcctcgtccctgctactgcaaatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggatcctattcttaggctcccgcggccggacctaaccggggcggttaagcgagggccgcacgttcgcgggaggcaggctatggccacggccgcgacgacgacgtcgtccacggcaaccaccaccaccaccacctgctcgtcaccgtcgtcgaccaccagccccatccacccggccgtcccgcaccggcggcgcctcaacgacatcgagcgcgtcgactacgcgcacggcgccgcggccgacgactgcgcggcctgcggcggcgtcgcgcccgacgccgccctcgcggacgacgacgagtgcggccacgggcaccccgtcgtcggggccgtcacgccctgcggcggcggcgggagggcggcgctgctgttggcgcggaggaagcgcgcgtgggtcgtcggggcgggcgggcaggcgtggatgaggggcgtcgtgctgtgcctgctcggcctcgtcgcggtcgtcgggttcttgggatcgcaccggcgaggcggaagcggcggcggtggcggtggcgcaggctctggcgccgttggcggcggcggcggcgacgacggcgggaggctcgtcaagaaggtggaggtggccgacgccgacgtgatggggtggacggaggagaacctgacggctctcacgcgccgcccgcccgacccgccggtgcgtacgtgcactcgccgttaatcactcgatcaactcttacttcacttgatcgacactcttttattaccaagatcatttagtcggtaataactactccgacataatcacacctgctcttggttttactctgggaattcaatgaactctctgaagtgtgtttcttttctgatcaaatgggactaatgttctaatctaaaagcattttttagtcaatgtctaatcaaaaccatttttttttgttacaaaacattggtccaaagggaaaaaaaagaagaaaaagaagatacagaggtgtgcttgcatctaggccagctgaggattgagtatatgagagaaaggatggatgataacgacaaggatatttgcttgtatttgttgctagcgtgattcattggcataaaaaaaagggaggcagagactatatgacattatgacgttagtttcagagtctagaaacaaagcatcccatttaaggcatttatctctcgactgcttttgtgcaaatgatttccttgttctttccgctgtttatttgtctctgcaaataagacgcatcgctttagttcttttttttctggtcgctgttgggcaattgcggcctcgcaagctagtagtcactcgtaatgagatgttaggacctgactgacctgcggttggtgccgttgaggttgctttcacttgtaattgtcaagtgatgcatttcaaggtgtgaaaaaggttttagtgcataaacagaaagagttttgctggtaaaatattaatcaatatcacatttctgttctctaaactaatgttaagttttattgcacaactgagtttaattgactaaaaagggacgtaattttccatcagacagcttaatattgtaatgctcttcttttggggtttgtgattgatagacttcgtaagattcatatttacccaatcggcggttctcttaggcgatcgttttgagtcagaatatatattgagaaacccttccttacctggtagtggtagggacatcaagatttatggctgtataggtttaggacagagctggcagagactgtccgaaagcaatattgtgcttatgttcagacaagaaatttcattcacgaaagcaagacatccattcaaatgccgtgctgtgcggcctgaatttactcgagtttcctttataacatcgacagatacctgagatatggatgaagccagacagtgagggttatagccaatgcattgaacgcccaaagaaccagcgcagtaatttccctctctatatctttcacttcaatctgttcagctccagttccatgctcatgttctctagttgggtgctcttattgcagggactaacaatgcaactgtcggttatctaattgttgatgcaaacggggggctaaatcagatgagaatgggtgtacgtatctatttaaacggtttaacatgcaacgcttttcagctaacccatactccttcgaaattattcttacagataagtgatatggttgcagtggcaaagatcatgaatgcatcactagtaattcccactctagatcatcagtcattctggactgatccaaggtctgtaccttttctactcaaggatcatccctcatgcccttataaaacatcaagtaaactgaccataagtccttgaatatagtgatttcaaagatatattcaatgttgagcacttcaaggaaatattaaaggaagatattgtaatcgtggattcccttccaccaacttacaaaagggtgaaaccctatatgagagcacctacctcctggtccagggtaggtgttcaaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaaaccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattttctcgatgccggggaggggtcggcagcggcaagccgcgggccgcgggccgcgggcggcggaggtggctggaggaggaggaggcaaagaaggaggttgctggcgagcgcgacagctgtggcgggttatctcctcccgccgctgctcgccgctcatcgctcttgttgacgaggtcgggcgaggattttctagatgccggggagggatcggtagttaggaggatggggggtcggcagcggtggtagaggggtagagatggcggcatcgttgccaagaacgacctccaccgctccaacccggctgacacccaccgaaaatagagctcctcgccggggatggccaggcaccgtgggtgggggttcgatggtgacgggcgaagggagaggtgcgcaacggccgagcgtgtcctcaccgccgggatccaaggccgccgtcgccagtcccccggacgacctcgattcccgcgagctatccgcctgcccgccgccccgttgtcgtcacgcgccgccgctcgccactgctccttgcagactgcagagcaagggagagatagatgggggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggaggctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactaggcgaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacat

SEQ ID NO: 13054 - DNA, 1912 bp, Oryza sativa
cccaccgctctccaccgggtctccgccgcccatcgctctccaccgcgccgccattgcgcctacgccctccctctctttcaggtcgcctcccccgccgattacctcgcgattcccaaccctaacccccgccgccggcgcgtagcgccgccgccgcccctgctgcccaggatccccccgccttttctccttccgcccacctgccaccgacgccgccacccctggcagtgactcctcctccccgccgccaacgccaccgccgtcgacgcctactcctgtggcagtgtggaggactgctgcttccctgtctccatcaggtgtgtgcacgatttgtgtttgttaaaatgcttatgtgaaaaagctgtgggtatacaatgatatgctgcagattatcttttcctgttataggttgatcaataatggtttccttaattcaactttcatattgctgaatcttttggtctacattgatagctgatgcattggggtgtgattatacaaatgatttctgttggtaatgatttttccctaccttgcagacagaggaataccggacagttttttttctttcttttcttctgttggggtgggttcatttcagaaatacccaatttgttaggttgaccacatgtccccattttgatctgcaaggtcacagacaattctcttgtaatgtgtatgtgcattgtttgtcagaaacctgtcgaatgggaggcaccatcataattatatgatctaataatatgaagtaaccatcaactgatctgagtgtggaggtaatttctaaccctcacctctgatgtttgatgaatttcattttctcgtatatactttgtttgaccagatttcctgctatgtaaatacacatatatgattgtgtacatactagctagatctttcctcttagagcatggacaatataatggttcaggcgactattatctacataatctagaccacacaatagaatattttaagcagatttttcataagtgccaaccactgcctatgttttgctattaatatatagtatagttcctttcgagaatttgcacaaagtctatagaaaatcagaatataagtgcgaccacggccttcctgaaagttagaaaaatcttctcaagcatatagcatatagtctgatggtcatttcataaaaatctcttgatatgattttataagtgaacataccaaattagtttgaatgtacattgttcgttttcacgggattccgacatccgttgtcagtgatcgagatcctgttttcactgggcacttttggagtgagcttttccggttggctggtgtcaaactacatatgagctcggcatttcagaacactaggacaaataacatgttgtatacattctgggatgcctgaatatatggttgcttatgatggaatcagaaaatgataagttctgcagtattttcaaatgcggaagctgatttagaatttgagaatgttggctcatgatgacaacaactctgtacatgtacattctgcagatagagaagcttttcttgattgaagcattttaagacttgtactacaccagatgtgcccccttgagaaacaaaggttagtgttctgctatcgagtttttttttagattgtagcaaatagagattttgttaatttttaatcaaatgtgaagctaaacttctcattaatctgggattgttttccataattgtcccggtgtcagagattgacaattgatttcacaaccaaatgaaaggtagtgtttttctgggaatgccatcaggggcgcagatctgagtgtagtcaaaatccttcaatttttcaaatccgtttggtaaaagttaccactttctgaattccatgcaaggactgacttatgaaaattttactgtatattattgctctataatttgtttataaaagtaatgc

SEQ ID NO: 13055 - DNA, 18076 bp, Oryza sativa
  unsure (1)..(18076): unsure at all n locations
acaaactatataaatttctttgtgaaattttaatagtgattcagtgttgcaacgggaaatgctatatacatggccagccatttatattcagtgtttaagtcgatatattgaccacagatttggtttatatcagtaaatggccatgtttttttcccaagttatgtttctaaatatgtagactgtggtacgatatttataaagttcaagttgtctttgtttcccagaaaatcttaggtctagcagacttacttagtttctgtttacaaatgaataatcgggtagtgaatactatacctgtatatttgtactactctcttatttagtaatgtatctaaaataatgtagactgtactacaatatttatttagatgcatatgctcaatttttatataagtatatgctgcttttacattacttttgtttgaatgtacatgctgatatgaaatttggagagctttcttggaatgtacgctgttaagaaaatttagataaattaaatccttatgccttatattgtttcttaaacacacctataagtttgattggagaaggggacattaaccaattgcttgaaaaaggtgttttgttagctcaagatatggtggaatatttacaactgttttagtaactcccagataatctttctctacatacatgcataactaatttctctaggataatgacacatttctgattcgttaagggcaaactttgaagtacatctgttatgcgcgagatattcagtttatatttctaaacttgggtgcactttgaatcaggacgaataggctcagttggatcagttgaatataaagaagtggtgtgcgattagttttttttgtaaatagctcaagttagttttcttccttgtaggatagttacaaaaaaataaggtaaacttgcatttcttgcatgagcaaagttcattacaacctatctaagtataatttcctgaagagtgtttatagctgaagttgtttcttctaattttgctgaggttaaccctcctatggcatgcatccttctaaattttgctgaggtaaaccctcctgaaattagtagggtgcacgaaatactactgtttttttaatttttgtacagtggcattgaacatggttttgctctttgagatatgatgcttccctcatgatcaatgaagatttgcattactttaggtgatctgctcatgtttgggtgtttgggtaaggaggagaagaaatggctggggtgtcggtggtaatgaggttgttgtttcagttatacagttccgcataattgtgtgacgtcctgactaatcctgactaatctgtatgaccttttcttccatttacaaatgcttgtgtctctccagttcacctgtgagggagatatgaaatcaggtatgagtaattcttgtggttttgcttctttttctggacacacttattttcatccattttgcagcaagcaatagttaggtatgagaaagaatgtgccttacaattaactgtcagtggtacacataaaactattcatttactcttctttcctggtcatattgatacaggttagtttatgctcttactcgaaaaaaaaaacaaagtacatggtcttactatttgaccgtttgattaattatataagtttctgagaaagccctgaattcgatgtactagactcgattgttataggcaactaagtaaaaaaaacaaggtgatccaataaagtattaaaacacccatggatcatgttgctaccctgtggtgatgaaaagagacataagtgctagctactattttttgtttaatcatgaaacagaggcttcatgaaaccagatcaagcaagtcaaatgggattgcatcataggtaagatcaaagttttcccctttttgacatcaacagcgtattcttttgtctgtagagattgtatatttgttttcattcatagaggttacatcatatccaagagagtgccaaatctgtcatgtagcatttgtctttttttttttacccggcctctacatccaactggatatatgcaacctttttaaattaagaacttagccctcaaataacccaatctgaaattcgctcctatagcgatttaaattcaggaccttggggtgctactcaggttactgcaaccattaggctacatacccttttacatgttgcatttgtctagattattgcatttataagcagtaaatctttttcggagcaaatagcatttgtgcagtgaccaagggtactatcttcttgatttgcttgcagtctcccattgtttgctgagaccatcaatactcttgcatggatgatggttcaattgaataattaggaactgcaatactggacgaggcttgtttgagttttctttagttctcttcaataagttacctctttaattatatggcttcaaactttttcatattcccgagagcatgtctgtatggcaccaaactgttcacctgagcaaatggtccaataatgaattgtgctttgtcatggtacgttgctaactgtttgggccttctggtgcaattttatcattgagatattttgtgcagtgatgaaatgcatatttgtattgtacgatacttttatattatcaatagtaatttactttaattattttttcaattttaaaagttgacctgttaaatgaggtttcacaggtgcattaaaatttattgtgttacaatgaaacctgttgctacaacaatcctaggatatcaatgtgttacctaggtgcacttcttgggtgatgagttgtgggagttgtccatatcctcctggaaaatgtgttgacaggttatgcgaggttctaggacagagacatggggatatagttctaggacggaaatatggggagagatatgtatatcgttaggcgtgaagttctgatggtaaatttatggagaaaaatttgatattgaccgaatgtatctgtgtgcaaattgtagataaaagaatgtcaaatgttctgttttggagaagacatgaaacaattcgtgttataatattggtgcatataccttttatgcaaatatttaattaatttatattctgtgcatatatagatgcgattaattgctccatctaaatttactactccctttcacaaaaattaaaacatatgattttttgaattattttaatttactactctctttcacaaaaattaaaacatgcgatttttgaattattttatcttggggttttgcgtttgactacaattttatatttcaacaactttataaaatacaataaatttgtgataaaggggagttattattttaatgataaatatgggcagatcatttagcattcggataaagacatgtatatcttgcttggatatttgtattttagacatgttttgaatatgtttcttcaaaagttattttgatttgtattgttaaatattaccgtagcgttagcacgggcagattactagttcgacgaaggcaagagatgagggaggtaaaatagacttattcccactcaaaaagcttaaaatgacataagcccgatactaaactaaaggcccattattagtataaaacactgctggcccaccgcgttcttccgcctttactgtaggagtgttaggtttagggcttccgccgccgcctcctcctccaaaacctcgtcggcgcgccgccgcggccaagccgctgtgctgtacaagaaccggttcggcgacaacgtaagttccgtgcccgacgaggtatttgttcgctgccccctcctcctcctcttcagtgttccttttttttctccgagagcatcggtgatgttacatccatctaaactcatccttgcactatgaggtcaccggtgaagaaaaaattgggggaatatgtagtctgagatgctctgttgatcctctccttggatcattcttttctactgagctgatgacgcggctggagatttcagctgctgtttgttttcgttttctgaagcctgagagcaccagtgatgtttacatccacactcatccttgcactatgaggttattaccagtgaagaaatcattgggggaatatgtagtctgagttgctcctgcttttcctttctcgcgattctgctttaatttgtggatttatggttgattttttttggctttgcctttatgcttcttgattcctctcgtggatttgtggttgatttttggctttgcctttatgcttcttgggttcctctcgtgaatactgatttcagcttctttctgtggcttgatagccaccaggtagatggggaaggcaaagcgtgcgtcgatttttatcaggcttgtttcagcagctggaaccgggtttttctatgtgaagcgcaagaatcctcgtcggatcacagagaagcttgaatttaggaagtatgatccacgagttaacaagcatgttctctttacagaagcaaagatgaagtgagatggtgctgggcaaatcttctccacaatgtgcaaagctgaataacctgcaaaaaaaactcgtgtcaggattcaggaacctgtctactgttaagaatgctatgatcagtttatcaccctgttctggttccagcgttttatgcagacaatttcaacaagtatgagtttgatcttgattagcactggaattctgatgttatgcatgttggttttgttttttggaatgggctgtaagcctgcaaactaggaatgctttgattgttttaccatatccccgttaaagcaaaattctatcatggcaacttgtagataggattcaccatactgaatttgactgtatgtattcctttaaacatgtttgtcaatacctggaagttatcttgaatttggccatgatctgcattgagacaaatgattcagtgtaccttcttttttttaacattggtttggaaaacactacaaaattcctttggaaacattgtaaaattctccgatccaaatggagcctaaacatgtgtgatttgtaagattggcaggacctggtattcttcttgaatatgctgcaacctgtactgtaagttgtaacagaagtagtttagactctacaatctgaacttgtttgacaagaactcaagataaaggacttcagctgctccacaagttttacctgacctggcgatatctgctgttaagcaacactgggacttctccgggcttctcttcatcacacggatcactggacctggcttgctcattgctgcattttgatcatggattttatcgtcgatggttgctgaaagcgtttcagtgttgcaaatttacatttctttttgtgcttacgacctttcagaattgtaatattgtaatttttctcctgctctatcgaaaaaaattacagccgttcgcatctagaatttgtgtgggccgtttgctttaaagctcctgtaccgaaggcttcttgtatcgtcttgggcttgtgggacaacacaaattcgcaattgtttagctcaaaaaccttgttactccaaacaaaatgaaacatttcaatcgatcagttagacagtaacaaagaaacagaagaatttcctggagaataagcattcgtagtggtggaccaaatcgctcgtcagaatgtcagaatctggctctagcgacgggttcctagtttcaaaggagggccaaacttgggcctttccttttgccgggcgtgttacagcctggtaattgggcttggtcttagcttatgctttcttctgcaacagcaaccgctcgtgtgacctggaccactttgcctgactgaaaacacttgaacctctgctacaatttcacccaaaagaaactacaaacttctgcaaagtggatagcacataacagcattcttttgggtaccctaggttgtctttagtcctcgtagtgctcgattgacatctgatatggtagtacagtagttcctcatcttttagtgaatttctccaatggtggttgcctggttggccctggttagatgtttcaaaaatattcagcatgtataatgtattaatccaactaaactgtgggagctcgacaagactaggntgcgtatcacaggtggcgacttgcagaactaatgcctcaccttggttttgtttttgttttgaagaaatgcccatcttgttcctggacatctgaaataccacagttttttttctccgaaacgctaaaaaaattacacgtcatcatattagaagagagcaagattttaatatacaacgtaacaggccatggagacatttgccaggggaatggaagaaaaaaaaaagaacacggaaaggaaacgaaaaaagaactgctaacgaaaaaactgctcctatatagagggaggaaaaaacggtggagccaccctaatgtcccaacaagtcttcaaaacctacggtgccaacaacagaccacaaccagacttcctgaagaatggactccaagaccacaaagaccgagacgaaagagaccacagagactacagttcacaatcagtaaatgatcatatcttgttaaaaggctgcggcattatctacttacattttaacaaatgcaacgcaattatcaccgagacaattgcaacacacgcatgttttcggtagcttatgtattatggattatcacggtgcacttcccaagcttttaaacggtacaccttttgcaaaacctttcttcgttcgtatttcttagagaacttttcaaaattaacttatgaactttacaaaatgcaattccctcgagtaaactcagtttcatttcaccatccactgtttataaagagtacgcgttttctaatttcgcttcaaatccttacaggtaatccccttttaaaatgatgcctacaacaacgatgaacgatgataaattgggtagctgccatatgcacatgccacttcatgacgactattccctccgtcccaaaatataacaacttttggttggatgggatatatcctagtactatgaatctggatatgcctcttgtctagattcgtagtactatgataggttctatccataaaaaaattactatatattgggacagaaggagtacaaagctataggtagctagccctgtatagtgaaataaatctagaggattccatgatcttgcttgcagccctgcgccgtcagtacagttttaatgtaggtcttagcttgatcgtcttcgacatgtctgcctccggtacgttgccatcctgcgttgcaatcatggcgcgatcgagctaacctgcaacctaatccttgccatgattctagtgtctcctcgtctctttgtcacgaaatgttgctcctgtttctatctgctcctactcatcttattcatcatgttttgaggcattaatttctcaccacaacatttggtttgagtgttcgccaattgacgtccatgacgccacaacatatggccctattacaatacatttattctgcgtgattatattgaatcctctatcctgcaaagcctacctatatatcagccatggcattaactcgacctgattcttttcacgctttagtaatgacaatgctgctgctacgacatccacagtgtgcctttgcatcaatacgtgcttgtacacatgtagtactgtcatcgccactaaatgtgctgcaagtacgtacttgctagaaaatctctagccattatagactgtaatatcggttgctagtacacacctcgcctctctccgttaatttatagccttccattggttgctgtctgaatttatggagacgcaagctagctagagttcctacttcctcttataattcggaagattcttctgctctgcacactgatattacatatatggacacaattgttcatacatgcatgtcattgttttccttttgccatcttgcttggctgctttccattaataattggttgcaaagctccagtaattgtctgctatcttatcttttacaatacatatcaagtgcaacaaatgtctgaggaaagtgtggtagaggtcaccaaccaaaccatctttagttactgcacccaaatcactactagcattcactatacatatatgcttctgttggactgattatttgtttgctgtgcatgcagcaggagtgtttcaatactcagtgggagtagaaagactgagcatgcagctaacagcctaggaccaagagagtaggtatcaagcctggctccaaaggcacttgttagctagaaatgacttaacaattaggccctgtttagtttccagaaagtttttttcaaaaacatcccatcgaatctttgaacacatgcataaagcattaaatatagataaaaacaaaaactaattgcacagttaaaggcgaaattgcgagacgaatcttttgagcctaattagtccatgattagccataagtgctacagtaacccacatgtgctaatgacggattaattaggctcaaaagattcgtctcgcggtttccatgcgagtcataaaattagtttttttattcgtgtccgaaaaccccttccgacatccggtcaaacgttcgatgtgacacccaaaaattttcatttcgcgaactaaacggggccttaatcacaccttgcttagaggttacaaagactatctaggacttaattgatgttgttagtatgctagcagtacagtgtatggattgttcctttgttaattattgccattgtgggacggttgacgcctaaccactgctagctaatccccttttctctttcagggcttcaaagttcaaagagagggtagcatcatgcttgctttagtcagaagaaagtcactcacatccctactgttctagctttcagttgagatcaactcaatcaaagatgccatgccttcgaactatacaagcaaatcgcatgcccctgcttatagtcactggacggagggtcctatgatctttgggccccactttcggtgacattatgtacttcagaaggatggagaaattagagaatttattagaagtaggagtattgtatatgtgtctccgggaatggaccatatatggggatatggatagctgaatggaaacagcacgaaaacataaaatattttttgaactttgccgtttggatagtagcagggttggtgatactttgcgtctttggttgttaagcagttagcatgacgttctggtcattttgctgcttctattatttcgctagattccctctactttgcctttgccggttttgccatgcttttaacagtttcctgttgtgcttccatgcatgttactgaactagttagtatcgtctaaatttgatgaacttctttctttttttcccctttttacacgaaaacatgagcttatgttcgttggatagcagcagccagcaagattatagccttggatagctggtacgtcttacgttcttaaataattgattgtttaagtttaagcttgttttatcttcaaaaaaaagtttaagcttgattgtctgtctttttttttcctgaaaaaaaattataaatgctttgttggtgctagatgggatctgcgctccgaactccttgaacttgaacagtagtacagtaccatcaagattttgttggtttaatatacaatagtagttcacaatccccttaactagtttctaaaataataatggatacgtggaacaggaggcaataacgcacacaatgaaaaatatgccactacttcaagttccgaaagcaacctttatgggatggttttagccaattttcgtatttagggcccctttaaatcgcaggattgagaaaacgtagaaataagaaaaacatagaattttgatagaaatgtaagtgtaaaacagaggattgcaaaacacaggaaaaacataggaatgaccgtttgattgaaccgcagaaaaaacaaaggaattggatgagaaagatagactcaaaggaaagttaccaagaggttaaagttcttgctaaatttttccaaaaatctctataagtttatccattccatagaaatttcaaaggattgaatatttcaaagagcttcataggaaattttcctataggattgaacctccaaaatttctatgtttttcctcctaataaaaagggtccttacttttgcagagtagaattctgaatgaattttgagatatttgttcttcaaaattcgtgtgaagttatccatgatccaaacatataaaagggttatgactgcttagcaacaagaggtaccaaaagataccaagaactctacactatcttctcttttttttccttcgagaaactctacactagttaactataggaagtatcaaagagttactgaaagctaagggcccctttgaatcttaggattgagaaaacataggattttgatagaaatgtaagtgtaaaacagaggattgcaaaacgcagaaaaaacacaggaatgaccgtttgattgaaccgcaggaaaagcacatgaattgaatgagacagaaagactcaaaaggaaagttaccaagaggttgagggcccctttgaatcgtagaaatgaaaaaacggaggaatatgaaaaacataggattagtgacaggaatgtaagtgtaaaacagaggattgcaaaacacagaaaaaacacaagaataattgccaaggagtgaacctctctagcgggaggacgtgagaaccccctttgtgagttcggccaggggaataaggcgcgatgatcaagagcgtatcttcgccgtgggattacgctaacgtggtggatggcgatcgagaaggagacagaggatttatccaggttcgggccgctgagaagcgtaacaccctacttctgtatgtggattcaagcttatgctgttgcaagagttctcaaaccctagggagatggtcggctaactttctcctaaggttcaagcttccaagagtcgttgttttgctcggtgggcaaggtcctccttttatagttcaaggggttaccacatgcaccgtctctacacatatcgtccttggaggggggcccacatcaacccgggctgagtagccaaccatgccttaggccggaagtaaggtggcagcttgtcctcaggtgggtcccagcgctatccttcgtctgacacgagggacatcccccgtcattccctcttaaattcatggagactttggcgaatgcatgcacaggagaggcaccaattgtacattggtctccgagcgttgatgggacggggcatacctgcccccacgctgcctgacacaaggcggggcgtgggtgcgctgccgcccatcccatccacctgcggccggtcttagcccggtcaaggacgattgacgcacgtcaatcgattggacgtcgcacgaccagccacgctgtattaaatgcggcggtggtggttgggacgccgcccatcaatgcgcttggcagcgccccttcctccacccactcagctgcgacgtggcagccgagcgtgggccccggggcgacgcagcccctcgggcccgaggggtgcaacgggataccccgagacccctaggcggttacgggcgcctttcggctacttactacctgcgcgcccgacccccccccctctcgatggggcccaggccgcgcagccacgtggctaggggaaaggaccctttccccttagcatgggtacccccgggcccatatcatcgataatgatcgtttgattagactacagaaaaaacataggaatcggatgagagaaatagactcaaaggattcttaccaagaggttggacctcttgctaattttcctccaaaaccaatatgcaataagccattccataggaaatttataggatttggaaaacttcaatcctttaaatcaaagggctacataggaaaatttcctataggatttcaatcctatgaaattccttcgtaatttctttgattcaaaggggccctaaagctctggctaaatttcctccaaaaatctatataggattgtcaatttcacatgaattttaaaggattggataggattcaatcatttgtgtcaaagggcttcataggaaattttcctataggtttaaaatccaccaaaatttctatgtttttcctctaaatcaaagggccctaacctaaacactgttccctgaatgatttcttctatgattacgaatgatctaccagaaactccatgcccctgacagcaacacaccaccagatagcaacatcaaattggattttaggaattaagcaacaagctactctagtatagcaacaagacctgacaagtttagccagggggccagccagcctctcccgacgaacgatcgaagccagctgctgcattattagtgtgcagtgcagagctctgtagcaactgaatcatggcggactccttcctgcctgcctcccttccaaagctagccattgcgtgctggagcgatggatcgagtactactaagtagtactccgttctagtggcgatcgaactgccgatccatcgagcaacgtatgcaactttggggcacataatgatatacgatcatgtactgatgtaccgagtaaaaccatggacaggccagtacttgacaatatgtactccttcctccaaaaaaatacctgcatcttttgttactatcttcaaccctgctaagtacaggggaatctacaattacccatgtttaaatgcatgtgttaagctgcaccctgtgaaatctgtgatgtataataacctacaaaattaggatgcagtcatgcagacaatcaatcaaagtggatgcattttgttaaaaaaaaaattcataaggctggtagcctcattatctgagaaataaggctgtcaattctgcttcgttgtttgctggtttgagtacggattgagcatgcttcactgaaatcatgaactggttcttcccgaaatgagatcatggaaggcttgccattcactcatccacaaccggagcttcttttccatgataacagtatgggtctcataaactatggctctgtgatgtattccttacaaatgagtcccagaattcgacaaacacaattgtaaatgatcttataatggaatggccatgggtcaaacatttgctcctaaaattggtgaatcattgataatctaggagggccaagacatgataggtgtcttcctttaacatctcccctttttctgttgttgcccattccctgctgttctttctcagaaattttaccctaccatgctaccagcagtttatgatttatgcttgatttttacaaaaacacgctatgaaacaaacacttaattttcacctgacaggtaattaacaggtcccatggtatatgaagccatgaacatttctttaatttcttaaaacaaaattgttattaatcgaacctttctgaagcagtcttaagaaaaatagagattttctttaaccaaaacatggacaggaaatcacgatgagatatgttccatccgtctcaaaaagaattaaacgctacgaatgtccagaactccagattcatttctaagatttgaattttttagaatgaaaggagtataaccttctaattgcacacagtatttggtagtaactggcatgagaaattgacagaacatatgattttttttctctgtttcacgaaaaaaaatatcttttttttgtttggttgagtcgttgtttgcctactccacagcatccatcatccacagctgagagatttgataatttaacactcttttcaatgggtttcgattatttgacatcctggcccattttcattcactcagatggtctcatatatcatcctcacaaatgttaattaaagtaattagacaacgaaaaaatgtcaaattattaaatttttctccacagctacaccctcctcctctcccgaaccccaatcaccatggccataagacgatgagctgagagagagagagagttccaaccatctcctctcctctcttctcttctcttctcttctctcttctctctcctctccccgacaagcacagggctcgtcttttcctttcttcccctcactcttttccccttcactcacacacagtcacactgtgcgagcctgtgtgggactgtgggtgttggccattccagtacaatccgttctctttattcctccctctcctgcttgtctcgttgcgtggccgtggccttgtgcggttttatggatcaagaaacctcacgagaaccccgacgcttcggccgtctggtggcgcggcgctagccatctctttggatcgctcctcgcgatcgcattgcggccgcgttctttgatttttggttttttttttgtccggtcaaaggttggttcttggtggtgtagattcggagtggcgtgtcgtggcggcggttttttgttgttgttgttgttgttggtagatactggttcggattgtttcttggaggaggaggaatttcgcgtcttggtgagttgggatttgatctttgggccggctgaaattgggattttgttttgttttgattgagttgcggtttgttttgtctggattaggagcaatggcgggcggcggcgggcagtcggcgatcgccgctgaggacgacgacctcgagcgcggcgcggagcgcgacgaggaggaggaggaggggagccaatacttcaccgacgcggaggaccaccagtcgtgggcgtcgcactcgcgccacaactccaccgcctacgaggactacatctccacctgcgcctccgtccgcgcgagctcctacgacggcgaggcggaggaggaggaggatgccggcggcggcggcggcggcgtcgagcaccaccgcaggaagtcgtcgtgcgtgtcggagtgctcgctggacgacgtcgacctggaggccgggctggccgaggtcatcaagggcagccccgagaaggcggagaggtgctgccgcatttgccaccttggcctcgagaccgcggcggcggagtccggcgccggcatcacgctcggctgctcctgcaagggcgacctctcctactcccacaagcagtgcgccgagacatggttcaagattagaggcaacaagtaagctccagactcactcatctaatccactctcaattactatttgattagatgcaatgttcgaagtcgaactccatatgttagctcggataaatcgatgaatcaattagtttattattattggataaggcatcacgcatcagcgtaagagcgaagtaacacaagatttatttcagatatatatatatactagggcatatgggtgtatgaacacatggttaaggaatcttgataggtgtctgtttttttttccctttgctttctttgggcggacaaaggtaaaggagcagatggggaggaaaaggcgaagtagtggattaattagtagtgttgtaggaatcgggaaggttgagatcattggagaggataaaggtaggattcgttctttcaatctgcttttctcacagattctccgtggcatctgattgttcctctggagtgttgtgttgaccaagtttgtttgttgatagattgacatggtctgatactatgatgcgccagtctatgtgacatgcctttttttttccttcgatttgatggtgcgagggaggtgtgattgtgtcatcttccattctgaaagtgtttgtttcaacacaattgtagttaggtgatccactgagtctcagtcacaaccataatgtgctccacttagccttgatccacttaataaaattgttgttaagagaatcaaccatagtgtgctccacatagtctcagactctgaagtgataaccgcttccagcgtaggaaaatggcctattatagacaggggatggttatagacaaaattggttttaaattttaataatcatggcttagttgctagtcagtgtaaaaaaggtgttgggcaatacaaactagtctgcaagtctaatttttttagtggttggtgttttctttctcataaaaatcggtagcgcaaaccgacacacaagtacctgttttgttcttgatattattttttactttatttttgcttatatattgttgccacagcttgatcactgtaagatttgctcaaactactaacaagaacatttgctgactaatgcagtttaggctaatgagattagttcaacaatataattacactaaagtttgaaccacagatattgtaattggaaactgtgaaccacggcaactcttactttataaaattatttcgattctatttctagagccaaatttctcaaatgagtctgaaatttcagaccttggtggtaataatgatttacttatgtgacatcagcttcagcaatattcattgcaccgattattgttttcacactatgagatgtaatagtgagccctgaaattcctatgctgctcccatgctgagaagaatagactgaattctgatcactgtgtttgtctgcacttggatctttttggacaattagtaatttttaagttttagctcctaccttttttccgtttgcagtacaaggctataggaaaacactgcggtaattcttgcaaatatatctatatttactgaggcttttatccttactcgcccaataatcaatgttagagtatatggtggttagagcaataatgttgttagattgatttatatcgtagtcttccttttctgtagatccctccttatctccacaccttttgtactcttaacaatcaaaattgcatcaatcatacttgtactgcttaaatcatttttttacactgcttaaatcatacttgataagttgatatccccaacattttacactcatttaatgacataacctgtcaatcaccttatcaaatttcagtaaaatagaattgaatggccctcaataatttcaatcttacttcaagtgcgaaggtgataggttttgagtacatttaaactaaatgatctatccttctgtttgccaggatatgtgaaatctgtagctctaccgcatgcaatgtggtaggcattggtgattcagaatccgttgagcaatggaatgaatcgaacagcacagcacctgcacaagcaccaccagctgaaactcagagattttggcaagggcatcggttcctgaactttcttcttgcttgcatggttttcgcctttgttatctcatggctctttcatttcaacgtcccgggctaagttttgaaacacatggtcctcaataaaagctccaatgccattactacacacctgtgggttggatttagtaaatctgaagaacaggctgaggtgaaggaaagttatgaagtggtacaaaaatgttgggtggggcatgttgatcttaactgtgtcaatggcaattgcctcctttcacaacgaccaagattccattagacaagaagctggaaggacaatttcctcctgtttcccttgtctggatggagatgaaaacaaagaatggagaatgtgtttgttccgtcaatagtgctgtcatggttttcaggaagagattgtgctgtatccattccctatcttctcaggcaatttatcatttattctgctgatttggtgtaagtgttatcttccaggagaaaaatgtgctgagttcggaagcatgtcgccagaaagaataaacaatattgtgaagttcctgggcatatcgccgcacatgaaattgtcgattttgtggagataatcctgtaatggtcctttcgacgtttgtgactccgtgttcggttgtttgttggatggagtacatgatgaaatgtcactctttgttggacgttagtactctttgttggatggagtactacagaatagtactagtagaatttttttatccatgctcattctaaacaatatatcatttcatcagtctttttcgtggtactaatgtggatatgtttgaccacgaagagaactgttgagttgaagaaattactgacttgtggcccaactctctctgtccttaaaaaagccggcctcgtactgtacgtgatacatatattatttctagattcgttatactaaaatatatcacattttaatacaggattggtttcttatattttaatacaaggttggtttcttttgggagagacagagggagtagcgggggaaacccatttggtccatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13056 - DNA, 865 bp, Oryza sativa
gactagtcgggcagagcgtttaaacgtaataagtcatctgctcggggaaatcaaacttgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggctcgcctcgaccgccgccgactggtgtttccgcctgcacggctggcctattatgccgccgttgttgggcatctacgtcttcaccgaccggcttgccttcgccaccgccgactggtgtttccgcctgcacggctggcctttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccaactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgccgactggtgtttccgcctgcacggctggcttttatgccgccgttgttgggcgtctac

SEQ ID NO: 13057 - DNA, 15673 bp, Oryza sativa
  unsure (1)..(15673): unsure at all n locations
cgattccattgagaagaaaatgtgcccagcactacacctagaatcttgacagcattagacacggagagatgtgaatgtgcatagcctgtgtatatctttccgacagtaacgtcttaggcgaccaaaccctaaaatctcccataaaaccgtggctaaaaacattgcacaggaacagtgacaggtaccactctaggcctgaaactgaagtgccaaactgttcaggtaaagaaacgtatcaacttttatcgaccctctgattttcaaagccactggtaagttcagaattacagaagaagcatgatattgtcttaactcctagtccatggtaatatcttctgaactggaattatacaaggaaacgtatgcacttcatctcaaactttttctcactatagatgcaattggtaaggttgttgctggttttttcagatctgccgaatgaaactgggtattattatgctatctaagttgaagcataaaaaaagccgcatgatggagagtatatgtaagattgaaccttttctttgtcacaactaagacttggaacaattctgtctgaagacttgaaaaattctgtctgaagctttgttaatgtatgtctgaaaactcaggagttgacagggaaaaccaggcgaacaaaccgcggtatgattcagatgtcgcttcacatcgaattcagatcagcgcgcaattcattcaaaattaagtttgtaatgcgacatggatggaacagccgtgatgtagacatcattagttagtattagccttaataacaatcatggaccagttagtactacgtagttactgttggtcaaacgaaaaaaaaataacagatcactcctgcacgaaccaacggccgtgcgttttgtagtagatggtagcagttgtttggacggcaattctttttatgtttggagagatgacactgccgtcatcatgtctggctacacttgaacagttttgcttgcactcatagtcctctaattaaatactactacatacatggaaaaagaaaagaagtcttcttaattaaatgacattagtttgttagtttgagatgtgccattcgcatgtttgatcttatttgattagtggtaatggggcacacccaatgaaaatgaagtttcttcatctgttgggtgatgcagctctgaacaccactcattttgcaaggtagcttaaccagagaagattggataacctgagggtttatgtgggccaattagttcctgataacgtagtatcatctgcagatttgtggctggaattaaaatttgcagtagtactgaaggcagcaagcatgtgtgtgtgttaaattactttctttattttgctctccacaaaaacaaagattttatttgatggtaccactgttctgaagctgtactgtgaaatttacttttggtgtttggcaggagcagagaggatttggagtactaagtcggtgcaaccaattaatcaggatcatgcaccgacctagcttgttttgttcatctggcaccatatcatgagcaattaaatttgcaactcttttcacttttctttgcaagcaagctagtagaacatttcacactctggcacataagtttgctttttgtactacatgaacagtaaacatcactaggtagttttaaaactctaggatcctttttccttttttgactctggcaagttctttaattttcttgaccctgngaaacgtgttgttaagctttttaaacggtcttctcattttcaaatacattatcactacatttggtcgggtagcaatcagtggatgggcaatgcttttgtttcaccctatctcattgagattaactgcatattcaaaccttgaggtagaatcttctttccccaaaaaacaaaacacacacaaaaaaaatcagagaagtgaatcagtcctgagatcttatcttctcctgcctgaaggctgaagcagagtgtagttttctttgatgtaagcatggtataagaatcacacttttcttgttgtaacatttgaaatagttgatgacactttacaatttcttcccctcaaagaaacactgccctgcatcttgcatgtcagtgttgcaatgtaccgttgcattttaatgtatgatgttattgactatcgaacttatgtttgataatttgtcttattaaaagattacgtaattattatttattttgttgtgatttattttttttattgtatgtactttaagcatgagttatatttttatatatttgtacaacatctttaaataaagcaaacaatcaaaacgtatctttaaagttaacaatatcatacattaaaaaccgaagagggagagagaggatatactactgttgtgcaggattggttacaagtcagcagctagaaaagcttccctcctctcagtgggcaacaggtcacacaaatgctccatccactagggcaaagaagatcgaaccgatgcaaaagaggcctaacatgcacacaactgcctagtgcttagcacttagcagcagtaagtaggtcgcgacccagtgcagtgcagtgcaaaccatcacggcatcgatcacaattcacaaacctcctccctatggccgatcgatcgattcttcgctagtggcgtacgacgtcgatcgcgcgcgttgcgagcttgcaacaccagcaatttttgagcacttttctttgttgcagaaaagagaccgtcttgtggttcttggatggatagggctggattctagcttgattggtgcaagggatggaggagaatggaggaggaggagaccccagctgatgaacagcggactgactgatgcctgcccgcgtgccaaccggccaaaatgatgaataaaaacatacatatcgtcgtcgtttttcgtaccccagatctgtgacagatcaatcgatgcttatgcagttagagcaagtacaatagcaggctatacgctagctataaatatattttaaaaagaataagaagaagagagagaaaagcagcgggctacataactgtagctagttgtagcacggactcacaagacgtaatgtgtgtatgatatgtgggaccaatattaatattataataagcagctattgtatgaattgcctataaatgatttgaagttagtagtgggctacactattaaacttgctcttatactgtatgtgattttacgtgaaaaggtacaattcagatatagatggacgtgtaacgtataccggtttgacaccggtaacataatttcatcgtctgcttattagcttattattggcgacaactaaaacttaaaattcaaaacttaatttagttcgagcattaattttaaaggtttttttatcgcagtctatttttcactatcagcttttaaagtttattacaaacgacacgtggattttcgcaggatggacatgtgggaaaagggttgacaagtggtgctgcgtgtgtgccctacacacgggcccccggctcggccaggcaaagcgagaggagtcgagtcgtcggtcgttggaggagatgagagacgagaggccgagatggcgcgcccccgcggcggagtcgattggcgggcgagatctcgttgcagattgggtttttttttttcgcccacgcgacgcgatgaggcgcgcggccgcggcttatcgacaattttctccgtaatccgtcgcgcgatccacacacgagcacgatggacgggttgggctccacgttttggccgccacggccgctcctttttttttctttcccacggtggtcactcgcttctccgttccacatcggccgcgtacgtgcgtttttttgcgtatgcgtgtgcgtacgtgcggatggtgcgaggggaacaggaacagcaatggttttttgttttgttccttggcctgcaattgggcatgtgatagcaactcgcagttattgctgtagttttgtgcagtttttttttccgcagacattttttcgatagacagagaaagaaaaacagctttggaaaatactactccatccatctacaaaagttacacatattacttgtgtcaccaagatcaaggagaaattaaatcatcttctgttacaaaaatcaagaagtgaatacaaacatgcaaccaataaaatatttagatgactccttgagttgtaatcaaacatttaatttatctcttcatgtaagtcttgaatgcataaagactataaataagaacaacttatttggaacaactcaaatgtgaaatatatctaacttttgtggatagagggagtacgagtgcagtagtagtacgtacatggtccatgcttgattagtcgtctacagacagagaaaagagtaacgagagagagagagaggaggtcatctggtcagccggggcatagtaacagtaactcggcctcgtcgtgcagtgcagtgcagcgcatcggaatcaattcgatctcctttcgccgggacactactgctccatagcatggcagtgcaggccgtggcgcccatccagtagtagtaataaatcgaatgaatgcgagctgcgaaaaataaatatggggcgagccggcgagtcagtcgggcggacggaataaagaaggcgcggtcagaatccccgcacgcaaacggggtgagaagaacccgaggcgcgacacatggaaatcagtcgtatcgatcaatcgttctcccccacccgcgcacgccgcgagccgcgagaggcgcgacgtacgcgagagaccgcgaccgcgaaccccaaacccaaccacaaaccaggcggcaaccactctcccaacgccaacaccaacgccaccgccaacgccaacgccgccccgcatcatctatcaaccgccggccgaggtggaggtgagttcacccaatgcgccgcgctatgcgtcgtaggcgcgtcgtggtggatgcggcagcggctgacctgcctcgccgctaagtttttctttcgcttgtcgtcgtcgccgccgctgggttgggttggtggtgcatgtggggtacgtacgggtgggagtcgagcgccgaatctacgacttgcgcgcttactatcacgtgccgcgcgtcaccagaaactggagacttgttcacgttcaaggcgatttcttcatctcaaagactatatatcatcgttcgatcgggtatggtttcagagggagtgactaatgtagctaattaagatcgatcggccccaaggtaggtagacaaacacatgcccacacatcatgggtgcatcgtttgtttgtttgttgatcaggttggacgatgaacttgagtcaaaccacttcaagtatttttcttggattcattgactactccaaggtcgtaacaaattcaacttgcaccaaattttgccaaattcacaaatacggtctatttgtctttatgttgcttagagaaataaccagccagcctcgtagttccctgctctaattaaccacctagttcctcatatcttcatatttgtaaattgtaatcagacttattgcttctttgattacctgatgtaagctctgtcgaggggagcttttgtcaattacaacttctctagctttctaaacagtccagattattatcggattctaagaatacgttattaagaatttaaaaaataaattagaagccaaaagctaataatcccatcttttttcatattttcaccatctagctactcactagccgctttatcaaaatcttagggcctgtttggggagcttctagctgctgcaacttcttccagaattagaagctccccactgaaataagaattgtgtcccataaaactccaataccccctttagccctttttattagatatcttttgtcagaatttttaacagttcacttaaatctgtcttaaacgctttttttcgcgaacatgcaaaaagatcacacgtcaatatattagaaaaaaaaaggtttagttacacaaagcaacatgacagaaccgaccactgctgggttacaaggaaaatgaatgcgggggtgaagaaaaaaaaatgtaaaattgaagctgaagctactgctcctatataaaggtagagaggtggtgaaggaaccccctatatatccggagatttttttttgttggaatacacaataaaacatcactggtatgtttgtgttaactataaattgtgatacagttgctctcaaatagatatgttgctaggtacaatcaaactattctagtgttaattatcaatttttttaacatatgcctggacaagaatatttcttcatgtaacattatgccattctgttatatatacaataaatctgtactcccaacacgcaaaagattcgagtgtcaaccattttcatccaaaattatgtcacgtgaggcctggtgccaattttttatatgacctggatatttatgcaaatatatttctggtcctaccaatattgagactacccagtagctggaagtgttaattatacttggaaataaacgcattgcataaaaacagctagtattaccactaacctttccatctccaaaatcagtttaacatcgcctaatccacgtcggtttaccgccatatccgtttaacagttccctccgaccttttagtacagtttagaacaatcaataacgatgcgatatgtaccaagtactaccatccatccacaatatcgttactgaacaacgtaaaagccgtactacacgatcaatacgaaagtgaacctgtccttatattttctagtagtatttttttttcttccaaaaaaaagctgcctttcaaaagcccagcacccggtgtttccccctcaaaactaggttattactcttactccctctatttcaggttatacgatgttttaactttggttaaaatcaaagttttttttaaattttttttaatccgagataaatttattgtaaaaatatatttaattattaatttaataaattgattttgtgatgtaaatattactatatttgactataaacttaattaaagttaaagcagtttgactttgatcaaatttaaaaacatcttataaactgaaacgaatggaatatttactatttgcattattcggcaggagaccaggagaaagacaataacaaaaccgactagataaaaacacgatataaaaaaaagaacagtattccattctgggtcactgacatcgtgggcccacactctgactctctccgcatcggttatactacgcgcccaacctcctatataaaagagtctccgcttagctatctctttaacacaaagccattacccaaacccgcgctccgctcgctctccaccgctcgccgcgcacgcctcaccggagaccagcccgacggcggcggcggcggcgtcggcggcagcagcgggagcttggactgagatgaggacgaggagtggatctctctaccgcagcggcggcggcggcggggagacggccatggttgggcagaagaggaagaggtcgtcgttgccgccgcagtacgccaccgccggtgactgctgcggcggaggaggccgccggaagaggctggccggtggtggcccggattacctcgacgagctccccgacgacctcgtcctcgccgtgctctccaagctcgccgcctccgcctcctccccttccgacctcctctccgttcacctcacgtacgctcgccgcctccttgtctcgatcgattttgcctttgcccggaaaacaccttcgtcttccttcgaattacaaacgagtccttccgctcctctcaatgctgtggaaagagggaccgatttgcaatttgtgggaagttgtggggggtgaatgggggataaggcgaatgaatgaatgaatgatgatggccactaaccgaggcgtctcgtctccctatctttttgacgacggcttgcaggtgcaagaggctgaatgggctggggcgccatgacatggtcttcgcaaaggcctcgccggcgtcgctcgccgtcaaggcggcgtcgtggtcggagcccgtgcagcgattcctcaagctctgcgccgacgccggcaacctcgaggcctgctacattctcggcatggtacggcgccgagaaccctagattagacgtgtggttgagctgtgccgatgagatgttcgatcgaggtgctgatgggtgttttgtggctgtggttgcagattcggttctactgtcttggcaaccggagcgacggcgcggcgctgctggcgagggcggcggtcggcgggcacgcggcggcgctctactcgctggcggttatccagttcaacgggagcggcggcgccaagtcggaccgcgacctccgcgccggggcggcgctgtgcgcgcgcgccgccgcgctggggcacgtcgacgcgctccgcgagctcgggcactgcctccaggacggctacggcgtgcgccgcgaccccgccgagggccgccgcttcctcgtcgccgccaacgcgcgggagctcacgctcgcgctccccgccgcggggtcgcaccgccccttcgccgccctccccctcgccggcggcgccgccgccggcgccatgggttgcccgctccttttccatttcggtgggaccttcccgaaggcggacccccacccggccaactctttatggccgactgtgggcctcccggcgggtggcagccaaggccaagaaaccccggctcgaggctcccgctgccgccaccggcgacagcgacggcggcggcgagctccgcctctgctcccacgtgcggtgcggccggagggagacccgccgccacgagttccggcggtgctccgtctgcggcgcggccaactactgctcccgcgcgtgccaggcgctggactggaagcgcgcgcacaaggcgcagtgcgtgcccatggaccggtggctcctcgccgccggcgaggcccagtgactcgccgccgccgccaactactcccttagaccaatcggtccaccggtttaacgctggaccgggtgtagccaaggcaagtggcagagagaaaaaattgaggaagctttttttttctttttttttcttttttaccgtttccatcgatgtcgtcttgtcagatgtacgtattccactagggaagaagagggtagagatgctacggatgctttttactcgcattattccttttttttttctcattccgagtaaactaaactctaaattaaattaaattataattataattataattccaacccctttaaaagacacagggggtttaaaactaaatcaaagaacttaatttttttgtcgtcttgtggtttggatttatgctgctgtgtggagggtacggacaaaggcagttcgggctgatgctgttcattaactcttaatgagggtgattaaccaatcttgattagatttttagattagcggcagccatggatgggaagccgtgcaggctgatgctgctgcagccgtttttaattttaatttaaaatttaaaattttctttctcgagggttgagacaggttggagttttctccatggctggttgtgtagttggacttggagagaggatcggaaggtggtggtagccaggtggtagccatctaggctaccgctaaagtgacatcaagcttttgtttttatttctaatttaattttgtttcctaggtcatggaaagaatacaagatggaggtgtcctcttttttatcgacataattaccacgtatatttgtatattacgtagtatatactaaggacagatatatacgttgtaactacttcctacctggtcgttcgttcgaacgatcaaaatagatggttatacaaaatacaactataaataataagtagatggtttacttctacggtgccttgaagatgagccttcttgtgcagagttggagtcaaagctgaagagagtagtatgtgattatccatggattaattaatttaactaataatatgaggataattgtagtagatggtgtttggttgtagtcaaggccggcctgatccgacggctggggtccaacactagatccgatctaagctaccacgcggagtggctcggagtagagtactcgtcgccgactcgccagcagctcaactgaatttaaacatggcaaatcttgcatcgcctcatgatcaatgcttgcttctcctgtgtgcttttatacactttgaatgctgatatcgtcaatttctacgtatttttctgtcctctgtgttctaaatcgtacgtttttcatattcatgctcgaagactcgctaaagcagggatggataccgtatttttcctatttctatattttttcgagccgcttagccgtgctactattatttttaagataataaaataacattttgccctttactcaacgagctacagtgattattacaaagtctatatataaagaaattcagcacacactgacatgatataaagaaaacacaaactaaacgagataacccaagatgaaagaatcttgaattactggattctatcattgatggagctttttggatggagtttgttttcgtgggggcatcgtgcgacgatggtggcgccgtttttattaagttgtagcgtgttccaattagcaagacaaggtgtgtgcatgaatcatatgggggctcttggctaatcggatgtgttcatgtgtagtacaactacatgtacatggtcccatgctgaattcagaggttagtttgcccggctgaatttattagtggatattgtgcaggagaagcaagctgaactctattattttgatcacaaattgatcgcaatcccagctgcattattcacaggaaaaaaacaaaagaaaagttggtgatgtccctgcatggggcaaacccttgaaatttccaactggggcagaagctgagactgaccggtagtacattgtgtctatagttgacacttgacactgcctctgctcaatttttcttccttttctcccatgcatgatgcgctcatcactgctagcttcgagtcaagagcccccaaagggacagattaattaacatctttgatactatcagcatccgataattactattttgtttgcactaatggtcaatggctaccaagggacagcatctcttgagaagtgtgtgtgccggttgccgtctgtctagttcttgcagctgcaaattaacctctccccaaaacaaatctgatgaaatgcgaccggaagcaaccaaacatgtagtttagattttgcaggagctgcacattaattgtgcctaccaaactgaagattttgtatctacatggacagggtttctacgagggaatcttcagagaaatggagcgcatctgcgtatgtgtatttgcaatggttgggccgtacagcagctacggttggtacctgcacaaaatgcttactgaatttcctcccccaacagtgtctcattagtcctaattaaccaacttggagtagtacttatcagaaattcagaaaattcagaatgggacacatggaacaggaaacccactgttttcttgcagtattagcttccaaaatgtcaatggtttggagaaaaacaggagaatcatatattcatatcacatgaggtggtgtggttgatagtatcgtatcatttttgtgagagatgatgagcaagaagtggatgcaaattggagcatgttgaggggtttgaccaacaccactcatgtagggtcaccttctccatgaccatgatccatacatatatactccatggcttatcattgctcagctgcagctttggcttctctcttccctcaccggcctctgtactttttgatgacacacttgcatgttattagtagcagttagttccctcatcacccatcaaggatcaagaatacttccattaatttcatgttagagttataccctaatggcttaattacaagctgtaaaatcttcaacctagtgagttgagaaaaatactttgagatccgtagggtaaattaatgcgatatgatcatcattagttcgtgcgatgaagctgggaaaagagaaaagagagatggggatgcaaagaaagaacaagaagcagctgcatacactggaataaagctgaaaagaaagaggctatatgctcatgctcctactactgctactcctctcgcctttctttctctccttttcaagctctgatttctacctctctctctctctctctctctctctctctctctctctctctctctctctctctctctctcttctttttcttcccccatgattcctgtgcatttgcaggtttgttgcaggcaaaagctcgcgtccgcagcgtgtgcgtggctgactgtttttgtgctgatcaacgatgctaaagcccgggaatccaatccaaacggcggtgtcggtatgtactctatccgtcgcaaaatgtaaaaacctagtaatacctaataaaacatatcaaattaggtttatctaaattcttaataaacttttttttatctaaattcatagcatttaatattaggtttttatattttatgagttgggacggggttagtagctcagtataggagtagctagatacagtcatttgaatttgtgatagatgcttagggttgaaaacggttcacggaaatttcggatggaccgagcatcgtttcggtaggtaaaagtcgaaccgttctcaatttttttcatatatagaatttgtatttttaatttctttcagtgtcgtacctgtacaatcgctataaaattgttaaattggtaaaaattgatcaattcgttccggaacattttcacccccgtcagccaacttgccatgccctggccggccgacatgtaacattattgccgagtttatttgctgtacgaacagatggatcgccatggcagaagtgcagaagacggttgatgaagtagacgttggagtgcaggcagcaagaggagttcgttcaactaccccagtggtagtatttatgacagcgatcgatgcacagttactatacctgatcacgggttcatatcctctacggtaacaacactcacgcaaaataatactaagataatataatccacgtattagtgactgtaacaatagtgataatatgatagaggattctcaacccccgatcaccactgacagcatcaggcatgacactgttattacttctagctaggtgactactatatattttatggaatctattgaagtttataataataataacatgtttttctcgtggtttagatgtgttaataatccatgacgatggaaaaaggtttgaaacagtgggcatactgagattcaagaagggtggtggtgtcgtgtgtcgtgtggcagaggcatttaactttggaaatgacgggtttttcgaaagggccagaaaccgtagattttgcagaatctaacctctagtcagatcagaacagcggcgacgactacgacgacaaccaagcgtgacacagacgcgcgggcaatgcacaaaatcaacggccacttttaatactccatctgctacataatctctcaaagaaaacctcacgaaaagagcacgattacgcacgaaaagacgagggaaaaaacacaggaggcttcttgcacatgctctctgaataattttctctgaatattgtttccgtcagagctcgcacgaagctgcacgagaggcgtgatacgctttaatttgggcactgattaaataaatatactatactctatagattagtgtggccttttcactgtttcaggtagtaattaattagctcagctatgaccatgagggtaatgagcgtgagtgctagctagcttagcttagcttttgatatcttttggcaacaagtgcactcgatttcttctcttgatgaataaaacgaagaaattaatggaattacctttgcgtcgcggttaagtcgagcactgagatttgcaaaaaaaaaaaaaaaaaaagggcccggtcaaaaagggacaaggcgaaaatgagcaccaatctgacagtaacaacaacgaacaacaggagtcagttatcatctagtgcaccctttgacaaaaatgactcctgttgcagtgtacatactcatggttcaatctcttggcaatgatgaatctgcacaagatttgcagtggctgacaggtcttgcaaaatcatctactgtcaagccattgcatatcaaagaaaaaagtagtgctagtttttttctttttttaaaaaaagaagaagaaaaagaatcagaaatactagtgggaggagtacaaggaatccaaggctgaaaagaggccaagaaaagcatcataaaatgctagctatatttcagctcacactatcttctgcacacttcccctttgaaaccaagcaggaaaaaaagcttgtcagaaaggaaacgggtagaaagaaattaaagaagtttgagagagtgatgaaaggatcaatttggtaaaaataaaaagagaaagacatttcagattcgattccaacatgacacaatgggtagagcaaaaggccaaaagaaaaggcaggagtagtagtagaaagacagcaaaaaaaaaaattcttggattcagcaaagagataaggcaatgggggtgagaaagaaagaaagaaaaggagaagaaaaggccattgcaccacatatctccccttcttttttcttcttctctttatctggatttccatcccactagttctcagagagcatcatctgctcaaattagtggagtcacattagtggagttgtgacgattgcaatggtggtgttactggtaacattacttgctcctcttgtcattgcacgtgcaagagtgtgtggcttaagcctaagctgctttcacaatccacaagctattgatctcatctaaggagaaagtttctttaatttgttatgtaataaaactatatcaattcaccacttaagtttggttttggaagtatctttttttctatttcagatagaagatctttatgtcattgaataagagaagaaaataaggtagtcagaattgcaaatggaactgaacatgctgaattttcacagttgcaaaagcatgatcagctactgcctcttaaccaaccaaccaaccaactagatatatactagtacaacatgtggtgatgttgatttatccaagtaaaatggattgtaatttgtcaccaaagaaagaacaagaaaaggaacatgctgaattatacacataatggcttgtagcttagcttgtcttggttgcaattgctgctgcagatgatgagatctgttgcaatggaaagagatgacaccaccctctgatgtaccaacaagcgtgttgtgaaagccacaatgctctaaaaaggtttgtaagtgggcgtttactcaggtttggatgatggagaggcagcacagcagcaatgcaatgcaagctgattagtaggaccacttaccactgacctgctagacctaacagtgaaaaggagattaattaagccatccacaagaagcatttgaaactttggagcgagctaatttaaggaggcgtcgccatcagcagccttcggttgattgctgcaacgagcttgagattttggagtaccagcaggagagtaacatgacgtgattaatgctctaatctctctttctctctctctgccttcaattagggagctagctagctacccggccagccaaagtaatgctgctcttgttaatggcaacatactatatgggttcagagattcagagtaggatgctaataggtttgtaattgtgtagtacctcagcacttgaatgctactgccctagatttttatgtttgcatgtacagaatgctggtacatccgattttttttcttttgaatgacctaatctcttaccatttattaccaccaaagaa

SEQ ID NO: 13058 - DNA, 5237 bp, Oryza sativa
gagtactactactagtaaaaagtagcagtactgaaacagcgagaaagaaaaccctagtgctctgcctgcttgctagctatcaatggcgtgtgtgtgcttgtgtaccaaaaggctgcaaactccttttaaccacaccacaccaacacacaccagcttctgctgcatctgcataatatgcactagttgatgagttagcaaatcatcaagcaaccacacatctatcaacacatgcaaatgcaatctcaatccatggatccatctgcttgttttgttagcattgcacagcttcagggttcatgctgctgctgctgctgtttctctgaacttgtatctgaatctgactgaccacatgaggttggggccactgcaatgtatgcgtcgcatgaaaaactccaaagctagggttggattagaacgcacgaaaccggccatttcgccatcacgagcgagctggctggcaggcctgttttaagggtactactgtttggtgttaaattggacgacgttttagcgagcgattgagctgattgatgatgatggtcctgatcgatctctgcaaataagttttttgttttctcgggcctcacctgtttagcctaattaatgccacttaaggagcaaaaacatacatgctcaaatagtgatcaaattaaaccaaaaggttaaatgttcttttattgattctctgtctcgctaattaaggacagattggtaacaaccaagccgaatttgacttcatcatctcaagtagcgatcaaattaatccaaaagctaatcgaaaacttcagaaagatgtacgtaggtaaccaaattaaaatgccctgcctgcatgcatgtgaggcagcagacatgcatcaagtccaaaagtggtgagaagaggggggttggttgagcttttgtaccaccttaataattttgagaaattttttttttcagtcctatgatggatgagggcccaagcaaactgatcaagtcaagaacatgttgtacctgtttgctgtgagtccaattaatcagcttccttgctatctcagccaaagtgcatgcattaattcatgaaatgcaaatgcaatgggtgtgtgtgtgcgcgcgcgcgcgcgcaaagaaagggagcagggcaacccatgctggccaggccaccaacatgccataactgcttacttacaagtgcaaaaatgcacacagattgtactaattaaaggacatgcatgcagctaagctaaccagctcccaaatgattacccacaaaagttcatcagtctcacacccaagctagctagctactaaaaagacagatgatcgatagtgatacatatacatcatccgtcctaaaatatataagatatataggttaattattcggtgataggatcaaaacagtagttgtgtgttccaatttcaactcttggctgacagaatggctggtgagtcatctgatattcagggatgggctaaatgcaatataaaatactactatgcatgcatgatgcatgccatgcattgggttgctgtcttgctgatctgatgatcacaagctgagattgctgttcatctggatttatttgattggtactgcaggacatctcacatctgctgccactaaacaacaatgcaccagttcagtttgatgcatgaacacagatcatcacaacacactggggtcactggctgactgacacatagacacatgctagctcatgtatgcaagtatgagaagtatggctacagaggttgttggttgtgggtgcagtgcactatggcttagctgtggctggctgccactatcattgtttgaattagggttcatgcaggtacagagagagaggcggcgttgctgtcgatccatccatcgacctgcacgtcttgtagctaattaaggtctctactactctctactgatagagtgagtcctgtgtgttattccaaatgtccatgctggctgtttggttgttgactgttgggtcaacacatggtgcgttgcaccaagcaaattgaaaatcgatcggatcaaatgtaatcggtgcaagtgcaatgcatgcgaacacacggagttgtttgtatcattttcatgagtacacattaagctccgttttaatccaaaacagtatttttttatagttttatgggaattaatatttttaaaatcttacaggaattaattgaattgattcccgtgttactttagacgagtgattgaggtttttctgtgaagtttcacgagaattgaactgattcttatgttacatacttacactagatgatcaagtgagtttttttctcctaaatttcacgggaattgaacagattgccatgttacattacacaccctccatcttagaaaaaaaaaacatctagccatatatctgaacatggactatgtataaatacatattgagaaattggtttttgtgtgggagggaggaagtacgagtgagaaggcttccaggttactcaagaatgagggcgacacggacatgggacggcgattcggggtgatgactgatgaagtgatgagtgatacaagaggcatccatccacgagtctagtagcaagcagcatgcatgtcgcggcgggtccggccggccggccgggggcggcggctactgtagcttagctgctcatcactctcacacgcatgcatgcagaggcgtgaggaggaaggaaggaaggcgttcgtctccgtgttccccacaccggcgtcagctgctacacctcccccactttaaggctgttttgtcctcaacaccccagcagctaatctaagctcgccgtttcgttgcgtttgcgtgcaatgggatcgagtgaatcatggatggaggagaccggccggtaccggcagttactacggctttgtttggaggagctttacgaagagtttaaggttggttctaactttttctttttcgattggaggagctttacgaagagtttaaggttggttctaactttttttttttcgattacatggcagacacacacactattacacacgtaacaccgtacttatccatccacgaatacattcgtaatacacgttaaaataacagaaaccaacggtacattcacgatctcaccaagctcatattaaaattttacatacacgtgagaaatattcgtgggcactaggatttaaattagatttggtggttaaagtcatacaccaataatcctattaccacatcactgcaaattctagaaaaatgaattatgggtttgtgtggatgagtttctgacagagtttagattgattataagaatatgtagttacataatttagggagtttttgaggaaggaaaataagaatattgagaagatacgtaaattagttgagtattaattatattaaacttaaaatatattaatatgacttttcaaagcaatgttctatagaattttttttaaaatatatcatttaacaatttaggatgcatggaaggaaaataaggaactaatcctctctattaacgaacacactcttataaaacaaactagtgctggtatgtagaaatcggatattttttgtttctctatattctaatcggctgtttctcataatatctactacctccgaaatatgattggttgagagtagatgatacgtcgagaaagtgtgtatagaaagttatatttggttgaggaaaaaaaagatcgaataagttgttatattttataacaaatttggatgttaaatgttttttttgacaggaaaaagagaatttggatgttaaatgttatatacatactttaggactactacccctcactacctcactagttctgacataggtacggccgggccatcacaaacacgggcccggaggctgagacggggatccatgatggatggatcggatggatggggccgaaacggatggactgttgttagcttttcttcatctcgcaggaaacgccgcccgcacacgcgcacacaagacacatcgtaccgctgctattactgctgcctgccttctacaacgtggtcgtggtcgtggtggtggtggtggtggacgggttttcagatgcaagcaaccgttgccaatcacttgcacaacaaaggagacctccaacagtaactgctgccgatgtttccccacacttttttcgcgaacgcgcaaaaaaattgcacgtcaatgtattagaaaaatagagttttttacatgacgcacttagccagaccagtttacgctaaggaaggaagaaaaacagacaaaaaaaacaagaaaaggaaaaaaaactcgatacgacggcagctctactccaaacagcgggaggaggcagagccactctacactcccaacaattccctaaagaaagcgacggccgctaacgaccacagccggccctccgaaaagatggactctaggaccactgagaccgaagagagcaaagagtcaaagaccctgaagttacgtctaccccacaccccactggcacactgatgtgttcctcttcctccctgcaaaattcatgctggattatcgtactccatctgtccagaaatacaatactacgagaagatggattaagttcatctgtccttgaatataagccgtttttgacaggtatccaaatgcagtactaccgaaacatattacgaatgattattccatatatatcctatttatagcttaattaccagtcaagaagcagcttaattcaagtaatcaaaataaggctccgttagtccgatcggaattttgcttgtaagctaaggctgatgattttacatgttccatcaagactgggagaattgttataagcagggcccaagttaaaccagtgcgctcatggagcggcatagggtgcagctgtgaggcacgccaggtctaccagagtagatcctggcaattcttttggagtgcaggtaagatggcagccctacatcgtgcctgccaacaggattccgacaaactccgaaaagagatgacatgataatagatcgcacatatttttggcgtaaaacaatcaggggtaatgattcaaggaaaacgatgttcccaacaaaaccacaaccagacagtgtgctgattacacaggttcaattctgggattcagacaacagctgagcattatgtgcttaataaaagaaaggatgccgttcaccatacaatagcacccagtgtggcagtatatataatgcagatagcattgataaaacgatcaaaacatagtaataatagtttttgcctcaaaacaataccgggataaacaagtatcaattagtgttgatttatga

SEQ ID NO: 13059 - DNA, 47679 bp, Oryza sativa
  unsure (1)..(47679): unsure at all n locations
aaccatgccaaccccaagaaccacccacccgaagacatcataccagaagtcgctatccttcttcttcttccttgattgctgcaaaccaccacgttatcagtttggataagggaaagataaggggatcaggcaacagttatacatgctacagaataacgttaaaaatcaaagtcagctagcagttttcatcagaaaatatactcatatacccaaaggatttcagaatcacgagcctgacttgggtatgggttctttgcagggatggaaaatgtaggatcattgtctacatatattttaaaatctaccatgtgaaaattatgccaaatcttctgggatcagatcaatacaatcaaatcaatgtaagtaagataatattacttgggagtatattgaaccaaactactatatcaacttatggctaaaactgaaaacgcttagagtcaaagctttatgctccgagtacacaattgattatgcaggttgtcagaatagagcccagggactaattttcaactttctagcaaatgactacaatgagatgtgtataggccaacaactcaacaaggtagtaagtaccaacacagatatatccaacacaaagagttactgagatccttgcagatagattggctcaattgctcagaacagtaatgacgcgccaaatcaatttgtactgcctccctactactgttaccttattctactagttaataataaccatagtatatccagttcacaattgtatgtggggtgggctgctctattttccacaatacagattatcatctttgttatttgagaaatagtaacaaagccaatatatgctcaggaagaaaatctccaacttacattcatctctaaagagcacataccaatgtaagtgtagccaacccaaaacaggtacattaggaagtaaaaataataatttactaatttgcctactgaaaaatgcttaataagaagatgcatgcaagattcgaaaataggcagcaaacataacaaaaattgatagccatataaattttggaagaaaaaagagtagctgtgcaattcttatttctgacaggtaagagagtaaagtcctgcaatgttaagacagaatacccttgtattcgaggttgaggatgcagcttgtgaagcctgagatgccatttgcctatgaatctccatgtgcagttctggcgcctgagatttgaaacaaatagtgtaagtacagtatgatacaagcacttcttaacataacatctgcatgtattatagggcgtcaatctgtcatgactggagggagtacaaggttaagatgtgaagcagttaggattatgaaatcctttgaaaggtgtagtcagaacttgctgtaatcagagttgttaactagagacctcaaatgttctatttgcagcgtataaaccaatggtagcattattgtaacaaagatcgcacaaatagtgctaaacataaagtgttgtcagcaccttggatgacaaatccaatgacttcctgtaaagatcattcgcaggttcctacaagaaacaggactgtacattagtttccagataaaaaaaggcacttattttacagcaaaagaacatcaggaggctcctgtgacggttttaggccacacaacttcaggactgcaggtcagcctccaccatggaacaaggaaatgtgtttgcggaagcatactagcaaactacacataccacatcaacagccttctggaaacactgggttgccttttcaaagaattcattggccttgacagtgtctgaagtgaagaatccatgagaggtctgtgcatttcccaagcaccaaagcgcatccgccttcatgggatcaattttcagtgcttcctccagcttggattccgcatctataaataaaattaactggatcagtatacttcaatttgaacaaattgagtaacttctactgacatcaaaatacacaaattaatgtgcaacaaaactcataacacatgtgcatgttaagccaccaacaaagtactgttacttcaattgaacagcccagacggcacaagaacaatcaattgctttccattccaatacttgattatgcacccaccatattatcctacttcctagctaaaatgtgatcatactcttaactttaacaaagaatcaacaaaatacatcaagcaaacgaacagctcccagcatttacatataacttgataaaattatgtcagtaggcccaggaaaaactattcagtctgaacaattgggtgaagaatagcattcttctcattaatcatctgatgtgtagtgcactgctggattattgaatgattttgatgaatcccgtcatcatcttctttttttcatcccaaataataccttaaaaaggaaaacatcaaacatgcaaagttgtctaaactcatgaatggatagacaagcaccatcagaaaacagtagcggttcctaaactgcatataatgaaattgaatgcaccacctacgagtgccctaaatgtttgaggtactgaaatgaaaaaccacataaccgtgggtagaacagttatccagtcactaaactaggcagaacaagttgtgattaccttcccatgtcataccagcaggattttatccttttcttattgttaataaaacagcatgacaaattttcctttaagaacattgtaccttttactttaagcaaacaatatattaggtttgagcttttcaattatcatgagaacaaaagtcaatctaattgctaaggattagcttgacttgtagaacacgatttgcaaagatttggcccttccagaccaaccgaatccattaatgctgaataacacacacagaaatctcaatcccattggttacaatagcccctaggaagcatcaactccaacatctctacaagtaaacagtccaaatcaccgaataatccgcacaaccaagtttcgagatctcacggtataccttctaggcacttgaggctctcggggccgttccgcatctgcgagagctcgagcagcgcgcctccccaccgcgtgagattctgcgacgaagaacaacaaagacaaacccaccatcagatcggatcgcgtcgcgtcgcatccaatcagaagcaacccaaaccatcaggaaaagcaagcaagcaatcaagcagagtctcaaaaaggctcgaggcgaggaaggggcttacgtcggcgtcgtgcgggttctgttcgtaggtgaccttggcgttctggcatgccaggtcgaagaagaacatcctctcaggatcgctcatcgctcccatgtccatggcgtcgcgggcgtcgtcgtcggcggcggcggcggcggcggcttccgacgagattcgattcgggggttagggttttagacctctctctctctctctctcgatgttcgatttggggagagagaggaggacggaggaggaggaggaggtgggcgtggagattggtagttgtgggggggggggggatcgcaccgctctaccggagacgctgacacgtgggcccgggtcgatccggccccacctgtcagtgaagtgtaaacccgacgcgtgttacttgcgaaagggtccaggaggaaaatatctcccggcccagcccaccggtggaattgagcccatctggaaagcaatcgtcgtctccggcgagtgcgagagcgagagtcccggcgcgcgaaacacttgtcgcgcgcgaagccattggagaggaaggacatagctgagatcgcggtggcgcctcggaagaagaaggaagcattgcgcgtgtgtggaggaggaggaggtatcagggatgcaggcgaggagggaggtgaggacgaaggaggagcaatggcggggggaggagagggtggtggagagcccgctggggagcgcacggtggagcccggaggcggagatcgggatgagggtggaggacatctgggacagcctggaccagccgcagctgagcgaccgggaccggctcaacagctgcttcgacgccatcccggtggcgtcgttcccgcacacgttcgacggcgcgcaggtggtcgagatcccctccgacgccacgctcgccgaggccgtcgacatcctgtcgcgccaccggatcatcaccgcccccgtccgcaacgtcgacgcccccgacgacgccagctggatcgaccgctacatcggcgtcgtcgagttcgccggcatcgccgtctggctgctccaccagtccgaggccgccgccgccagggccgacgacctcggcgccgacgagctggcggccaagctcggcaccgtcgcgcttgagggcgccgccgccgcgagggcgcccgaccagcagcagtcggcggagggggcggtcgcggaggcgttcggcgcgctgccgtcgtcggacctgttcaacaagacgaaggtgaaggacatctccgggtcgttccggtgggcgccattcctggcgctgcagagctcggacacgttcctgacgatgctgctgctgctgtccaagtaccggatgaagagcctccccgtggtggacatcggcgagggcaccatcagcaacgtcatcacgcaggccgccgtggtgcacatgctcgccgagtgcgcggggctccactggttcgaggactggggcgccaagtcgctcaccgagctcggcctccccatgatacgccccagccgcctcgtcaaggtccgccacgacgagccggcgctcaaggcattccgcctcatgcgcaagcgcggcgtcggcggcatccccgtcgtcgaccacgccggcaagcccaccggcagcatcatgatcaaggacgtcaagcatctcctcgcctcctctgacgccaacagggactacaggtcaaaaaccaaaccccccctcaaaaacatctgcatctcctcgttttcggagtctcgtctttatggtgttgtcgtaggctcggcggcgaccggtcacgcatagcagaagccgttttggtgctagacttcactctcagtgatttttgcttgtgtggttaacgcatggttcttggatgtgctttttgtcgtgttttttttttttacttttatctatcttatacatttggatggtctccttcggtcttcttggggaaaaaaatgttgacagaatcaatcgaattgcaaatttgcaggacgctgacggcgcaagagttcatcgcgaatgcgaggcagagttcaggcgagaagcagatgaacatcgtgacctgcaagaaggaggagagcataaaggagatcatcttcaagctggatgcagagaagaggcagaggatctacgtcgtggacgagcaaggcaacctggatgggctcatcactctcagagacataatcgccaagctggtgtacgagccgcctggctactttggggacttcttcaatggcgttttccctctacctcagaacagcagggtctgaaaaccaaaacattttcattagtccaaattaaatcaggtttcttttttatcacttcattctttcgatccggtccttttgtgtagtatgtgatgtttctttctttgcaatttcctccttttaccctctagaaagatcaccttagtttgtttgtgttacaatgtgactaatgcatagctagcttatcataatgcttccacatgtggaacaccaaggttctattcatgttttaaaaagacgcacctggaaatctggaatgagactctgacaatgccagcaaaattcctgctcatttgtatcatgaaggcaacagaagacaagataccaataataattgatgaaaactgcacccgattacatcagttcatgaattgatggattaggagtcgtagcagaaggtataatgaaattgcaacaccacttcatgatcagagattgacaagtacatgatgataggagcaatgtagtaatttactatggtctccttttttatcagcaacaaactatactgcacataacaaatggctgtattgatataactactggtatgaattgtacataaaaaatgccaagcaccaaccattctttcgatgtcaaacaagtcacgagatgttacaatcaacaaaagatgagaaaaaaaaatgtaagaattacacagctcatggtagtgtccagtgtcctaaatttcatgtcgaaccttgatatagtcagcaccttgatagatcaaaagctaggtatccaattccgattgcttcgcaataccaaaaaattctgtttgcttgcagttcacactgcttcttctacaggcaaaactgatttttctttccatcttcggattatcaaaggtctttgcagatcaagctaccaatatagcgccaccaatgaaattcatgagggagttgtaactaaaatcattgatataaacatccctaaacagaaaagtgatcaggttggtgagcatatttttcaaggaaaaaaaaacatgcctataaaagtttctcctacaaattggcaagcaaaaactaacaaaattggaatattttttttctgctactattaacatgtcaacaatttgcctataaaggacaacatagcatgttaaagccaacccacggtgttagatatcttaaactctggttttcagttaaaatcatattctccaaaaaaactgtatatggaatctatacttctggttcaaaaaaggttgttgtttaagagccattttaaatatgtttatgatgatatacagttatataaatcaaggttgcagattaagaagcataaccaaccatggttcacatgagacattaaaaagcccatcattcagattggtagttcaagagttcctcagatcaatagatcattgcttgattaaattaactaaaaagataacacatatgcctgcagtaattcaatcgttaacaatatgaggacaagatctcatcgaacatttcaagttgtagcagcatacatcccaaaggctaatttgatgtgcagtgcatcactatgttcttgcaaaactaactcccagattaactttaacaacatacaagcaaaaagatcttgactgcaacaccttatagtaatctataaaactctatggaagtgcaatcaggggtttagtactcaccttaaccatcaaacatgactaatcgatcaagcatttggtcttctgccttcaaaaaaatctgagacctgattctccaaatcttcagggttgtactttatataccttgcggaattccttccaccctctagctgacctcggaaccttccaacaaaagaacgatatgctggaaggactttctctgagattgaaatcttcaactcctctcttaattgagggtccacaaccttccatgttgtctgtgtcttgtataactcctcgaatgccaagttaaagttcttgaacctttccttgagtgaagccttgagtgcacttgatgaacccattgtctgtggcaatccatcatctctcagacaagctaataccctcgtccatgaggacctaaggtaccctgtagagtaccgtcttatctgaccacgacgctggcggatccaattatcgccaagcaaggtcttcagctctgaatccttcaccttctgtacaatgtacagcagattgttcatcaaaaatatgttctgaagtgcctcatcctcatacagctttgatttctcctcgatcttggcctgtagatgtgtgatcagtatgagcacacactgccccagtggagtcatattcacgttgtcacctccattttctagctcagtatcccagtccttgagaagttggttcagtgagcggctatagtctgcaagcagtcggacatagttcatgacataccgcgtgagtgggtgaatctccccaccgggcaacgctctccgagatgtctccccctgtattgcatttgcaaactctgcaacggtgccacgcaccgcatccccaagcctcatgagtatccccacagcctcttccttgatgaaatcccttgcatcacctgagaacaagccctcgagctccggcaacacctcatccagcgcctcatacatgccaagaatgcggaacagcttctcggacgatctcttcccgattgcaattgcgtcaccaaagttgagcagctgcaggacacaccccttggctgcctcagtgaagcaatcctcctcggcttcggcatcggcggcaaagatctggttgcagatgcggcgctcctcagcaacaagccccctgacgacgaccttgagcgcctggatccacttcttcatcttgccgtcgaggacgccccattccacgcgctgcacctcctccaggctcatcttgtcgacgccaagcacggcgaggcactccatgagcgtgtcgcggcgcatctcgccgtagacctggcacagctccggcccgtagcctgcgcgcagcatgacgtccgcgatgcccctgagggcgccgacggtgtccggggagatgaggtacggggagatctcttcgtcggagacggaggccctgccgcccgcgccgccggactcgtccccgtcgccggtgtggctggcgaaggaggggcaatcgaggtcagaggcggaggaggcgaaggacggcaccgtgagcgagaggcggcggaggagggaggcgtgcaggtcctccccggcgagcggcgacatcccgcgggccagcaggtggcggaactcgtcctccagccgcgccatcgccgcctgcagcgccgcctccgcgcgcgcgccgcgcgcccccacgaggacggcggccgcgcccaggtaatcccccgcgtccttcgccgaatcgaacaccagcctatccccctcctccggagaatcccaccgctccaccaactccgccgcctcctccacctcgtcctcccgcgcgtcatcggggccggcctcctcctcctccacgacggagggctccctcacggcggcggcggcgggagggggaggcgggaagaggtcggacatgaaggtgaggcggtcgtcgaacccggagagtatccggatcatgtcgtcggcggcgttcttggagttggcgagcgacttgacgatgtgctgcgccgccgcgatcaccttctcctgccctcccggcggcgccgccgccatcctcctctccggttgggatcgagcccgagcgcgacgtcgaggaggttgctgctaccgctgcgaagaagaggaagcgaaggggaaggagaaggggaaggggagaggaggaggcgaaatggacttagtgttagagtcgctaatccgctgagctggagggggtggttttgaatgagtcgctgggtggttttgatgatgccttaatgctcccactaatcctcgctttatcgtacggtccggatttgctcggccggcactccatctccactctctaaggtttatttcccaaacaaaaaaattttcatcttttacatcgaatatttggacacatgagtattaaatatagaaaaaaaaactaattacacagattgtgtgtaaattgcgagacgaatcttttaagtctaattgcaccatgatttgataatatggtgctacagtaaatatttgctaataacggattaattagacttaataaattcgtctcgcaatttacatgtggaatatataatttgttttattatcataatacgtttaatacttcaaatatgtgtccatatattcgatgtgacacataacaacttttcacccctgaactaagcagggccttgagtacaaaggagatggatgatcatgatctcctgtatggattctcttgtcaatgtgttacaaaattttgtcaatatctgtgataacaaatcagttacggatgaaaaaaggtggaatttgagtaaattatgtgagaaaaattgaatagttttaaagaacttagactcatctgtcaagcggtttctcgattcatagaggctcaagaagtctgataactgcgataactgaagcggttaaggttgtatttgttgaccttggtctcctctcctattgtcttgttggtgcttacattttgttctggtcagggtgtgttctttcatgtcaaagaattgaaattaaactaaaacaggtcaggtggacacttggtttgaaattatgttgatgtcattatgttcattgcactaaaaccagccaaagtttggaaggcgagcacatggcctcgtgatcgtattgttcgtttgtcctttggatggactaatcacttacattattccctaaaaacggatcaagactcaagagccaaccaccggtcgcttgaaagaaattgacagaaaaggagtactttgctgtgctgtcttgttctgcatggattccagtagtgaactggtgattgtatgcatcagctctaatccggccatccaggcaatgtcacgctcatgtcaggtttgtgcctttgtgttgatcttgcattattatagttgtaaatgcttggatttgcatgagctggtgtactgcttgctgctcatcagcatagctggagaagtggaaagttggactctgccagtgccagggttagacattctttttttttttttgagatattttgttcatctctgtgatgtggcaaatggtatctgatgttcttcttgatggtcaaccaagaaatgcacatagacagagcagcaaaagtcagtggtttgttgggattatcttttaggtcacgacctcccatgcatttccatatcatagttctttctttgctcaaaaccgcaagaaactgggacaaaaaagaccagtattataataaaagattttggtataatcagcagaacgattatcgatatcttggtctctactggtactaaaaatgatctaagatcttcccctttaagttttgcgcatgcttagtacatagatcaattttgcagtagattaatggaattacagtgcaagctaaaaatatatattaggtatgttccagcaagtcgatccatgtgataagcagataaacaactaaacaaggatggtctgactcggaggaacgttcctttcaccccattttttcaacaacctttacccaccttctaaagtaaactaaaccagaacatcagattagatttgatacttaagtttgtttaaacacaagtgtacctgtgtatgaccccgacaacctgacaaaagtttcatcagaactttccgcaggagttctcatcagaagtcgaaaaccagcaaaatgattaagctatgagacgaaatatttacacataacgaaacttcctagaactaaaaggtacacaaaagtatcaatcacagagaggagtggtatctaatgggaatacattgcaacatccgatagaccgatatgtaacataggtgctttgtgtctttgtattgtcagatgaaaatctgctctacaacattaatacaacttatttgcttccactatatcgtaaaaatcagaggaaaaaaatagttaggatgtcatagaaggaacaaaaaaggggacaaaaatgttagtgcgtcagtaaacctgcgtggaatgagactcggacccattttgattttgatggtgcacaaggaatgaccagcatgacttcatcatatacatcccaaaaaatgtcacttcagccgtcgccccatcgatatgataatatatacacaattcaccaaggttcatccccaccagtctggaatttttaatctcctattcctgtgaatcgcaagattaactgcagggactttgtgcttcacctgcctccatatcatgttcacagcatcacgcttcctgggtggattctggaattcatagtgatgagagacattttttagctttgaccagatctcaacccacttcgttttctggatctgtctgagctggttgagcaaataatcaggtcttagagcttcttccactgagaagaaaagggagaactcactgtaatcaatctcatctttgaaagggagctcaatccgactgctgacaaattccaggaacccatgactgacaattgcatcaaacagtcggcacgaggaaggagtatccccagcaggatggagacaaaactttgatgatcgcatgccttccgtagactgttaggagtaaaccatttttaaatgtcatgccctcttatgaaaacctcaacaggaaagactttagatcaccttagcacgttcaaaccatagcagaaggcactatacgtttagatgacattagaaaagtaaggtgcaaatgacaaaggccttactgttttaatgccttcacctgttgcaaggctatcctcaaagcgcacaccatccttcccttttagaatcttggcaagtttagcacggatcttcccttcctgaaaaaaaaaaggagccccaaaaaaggtcatgttcttgaaacacaaaagttaggtatttatttatgtcgagagcagttccaacaaaaatagcactgagctaaataggcagattatgatagatcacagagaagggaataattaagttgcatacatctttcctgactgtacgccctcgaaagaaaagcagtgtaggacgatcatcaaatggatcaggtggatcatcgttaaggaaggaatctacaacatgcacatatggagctacaacatctttcctcaaggaagccaattcttttgtgtatcttccaaagtctgcaactataagaatagatgcattcaccatatcacgcaaaaacctaaaagcatttgggtgatgcatgggaatcacatgatcacggcctgcagatcgttgccaatatttagatttccataaaatctccataagctcaacctacaagaaaataaactaaaacaaatcagtgtaattataatgccatgaagttagtttatattatgtagaactagggcacattgacactattatatggcagcatactgcacaccagcaacatgaaaaagtctaaggaggtgatcaaagcataccaattcgtcataaatgatcatcatatataaaacaaccaaattcctgatactcaccataactcagggtagctaattgtcaaacatcatagaaataaatcgatatattgtcatgacagaaaaggaaatgccgcaccacacaacagattactgagcaaagaagagtagacggcatttttctatggtttatcagaatttggagaaaccattattgctaatagcgaggttgatggtgatgtaacaccaactaaatgagagcatttttccaaagctatacagtttatcgcatccacatgtcatctttggtgtgctcgtcttctttgtttaatgattacttgatttttttcccccagtacaattcgcctgttctattgaatgatgtagcatagttttatgagaagcagataaatttggctgctttcagcagtctctcaatccacagtgcataccaaaatgactccaaaaaattaagacatgacagaacaacacaaaatttcgtaggcatgactctgcatttccacaagaacataggccatgccattgcaaacaggattaccagctgaattgaaaggaaaaagtgtgagatttactgcacctggaggaggcgggtcgggctcggtctctggatcggtcatgttgcggccgtggacgttgaagctgagcgacgagaagaagggcacgaagaaggcctccgccgcgtcgggatccgtcacccgcaccgcctccctcccctcctccgacgacgacccgttccccccacctcccccgccctgcagcgacgccatcatccagtactccacgctgtgctgccgcctgatcccgcccgccgacggcggccacgcggggaaccccgaggcggaggcgtccatcatgccgacgtggaaccgccgtggcaggtcgtacatgaagaccctgagcggcggggcggcggcggcggcgggcgcgcaccgggcgccgaacggcttgaggttgaggaggaggctcggggaggaggcggcgggggcggaggtgaggtagaggaaggtggttgggacggcgaagacgaggagcaggaggagcgcgccgccgacggccaccgcgcggctgctcggcgacgccatgacgatgccccccaccgccggcgccgccgtaggcggatttggtgaccaaggcggcggcggccgcggccgtggccccagctattattagtggagatgggaatttggtagcgtcgcaacagcagcttgtgcttcggtggttgcgacgccgtccggcatgtgtggtgcgatggtgacgggtctccgcctccctctctctccttgttttttctctttaaaaataaaatcgatcgtcccaaaatataagaacttagtacagaatgtctagatttgaatctagagtatgtttagttcacgctaaaattggaagtttggttgaaattgaaacgatgtgacggaaaagttggaagtttatgtgtgtaggaaaattttgatgtgatggaaaagttggaagtttgaaaaaaaaagttaggaactaaaccaggccctagacaaatgcaaatgccccatccggtcccaagatataagaattgttgtgtttagtttctaaaattagggagatgtttgggggaaagttggtagtttggaaaaaaaaagtagggagtttatgtgagtaggaaagttttgtatgtgatgtgatgtgatggaaagttaggagtttggagaaagtttgctgtaaactaaacaggaccttataatctgagatattttttagtattacgaatttgaacatactataccaaaaatataagaacctaggatcgagtgagacattttctaatactacgaatatgtacagactatgcagattcaaatctggacaaatgtctcatctgttcttaggtcatctgttcttactcgagtccatctagcataatgaatctagacaactatattgttcaggtagactccacctagtttagtttttatcgggacagatggtagggattgagtttgtcgtattagcagtatccgttttcatgacagaagatcgtgctgttactgctgcagtacgatcacgataatcttccggtactttgcttgcattagagagtgagatcatatgcttgcagaagtagcaagcaaagttcactcgaaggctcaggcaaatattgatccacgagaaccatgacagatttgggtagtcatctcttcttcatggcagaaacggtaagaactgtattagtgccgagctattactccattagccgtagatggaccttacaggttacagctccctgaatccccgtgatcaagtttcttttcttaacataaaaattgtttaacacaaggccaacgctacagactgcagcaagaagccaacaacgcgtagacatgggcagattacgttagaatttcattacctctcgattctagtgcatactttgctcctccaaagggatctcaaagccccaaaaaaaatgtttatcgagacactagttacagaatctaggataaatgttatcattagctacgtaactactgtctcaagaaggcacaaaccatatatgcagcacggagtaatcaccggttattgttcaaaacccccacgatcaaagtttttccgagggtttttctttggggtcaaaatcgagctaaatcatgttcaggtcttccattccaaatttccaattgggatttgttgtgttgtttctctgttggaatattcgcttacctatgtagggtcgggtaggactcgcccatgataagaacaacaagcgaagtccatccagtaaaggacctcgcacccttaccctttcctttgttcttctggtcatagttttcccagaagaacccagtttcatggtaattcttcacgatgttcctgtaagaagcacaaaagtagcaacagcaatctattaaagaggctgcaatttaactattttattcagcttagggaagagagagggatatacctgatcaggtttgatcttagctcatcatacagttcctttgccctgtccttgtatggaccatcctcttcagagcagaacaatgttattagatcatcgtgcaaacagtaaaatttacagaagggtaaaagctgaatagttgtttagcagcatctgttatagagtttaccatgtgcatagtggtgtagtcctgaaagaatcatgtagttcatgtttatccaaatggcacctctccaatatgggggatcatgctcagtgttgcgcttcatatatattgaactggaccatggacaacagataattcagatcagagtaaccaaaagaccaaacaataatgctatgtatacattgttatgttgattttaattcattaacaagctcaaacgataaacatttaggtgttgggggcaatgcagacttatacccacttcatcccccgggacaagtcttaccaattgagtattggatcctctaaagaaattacacttttcaaataaataaatgaaatgaaatatctcatttattccagaagtatcagcttcataactaatcgtcttgatgcaagtttaggttgctggagatcaagtaggaaattttgcccatgattcaggttaaatgagttattatctttatatacttgttcgagaaagtgaccgaagtccgtaatttgtccacaggatagagctatttgatataagatcaagctgcttttcaagaacccatgattcttgaacagagttgaatggtagttaatactttaggggatgagcatcactggattggtaaaagtgagaaccaagtatatgtaggtaaagagcatccaggtggaatggcccccatcatgaaagggaacatgttgacataccggacatgaggtcctaattgcagctgagggggttgtaatgtttcacgcaaaagctctcgtctcataacatcattctctctaacttcataccatttcaatcgaacctgtaagaataatattgtcatcagagtttgaaagttatgaatcatgtccgaaaggcaagatggcaagatagaggaactgcaagagagaccttttctgtgtggttaccatagtcgaaataggcaccggttttatcatccaagtgcatctgtaaaaatgccaatactttcaaattactataggataaatgtgaccatcaaaacccttcctgtgacacaaaatgattggcggcaattgataaaaaccattttagttgctatatgatctttgaacgtttgatcaaaagtaagacttcctgacacagcaggcgtttatgcaaagtttattatctttatggcatatataagtatgtaaccataatattgcaatgatcacgaacagaaaaccaagcacaaaacaaaaactattagcttcgtctagtatgtaaaatgttaatataagaaaccattattgttataggcgcaagtgttagtgttggagtatcaagccattaattatatccaaaatgtagcagccattggtggattgatatgcagattaagtatctatctgacctaaaaaggacaaaagctcagaacaagaagaaacagtcagaactctcagagcaataccttgttaagtatcccaaaatctgaaagttgatttgacatcttgtagtaatcctgtagaagttcaagacagatttttttcaagagaaccaaaggctgagacaaagcataaggcacagtccattcactctgcagtaccttctcaagagagctgtctgttttaagaaactctgcaattgagcacatacaattcgtagctaaaagcatccaacaccggaggtcaacatggcgctcttcatcattaggatgagatgcccgtggatagtcatccaaaccagatgtcaaagtctgtagagtagtcagcaacatcaggagtgaacggttagtagaaatgacatagaaagacaaggcaagaaactgtagcgtaggcatgacaaaagctcaaaaacataaactgtaatgtaggcatgacaaaagctcaaaaacaaatttcttttgctattatttgggaccaattagtctgtggaagaaagcaactatgaagtgttccaaaaccttcggattcaactccctggtggccatgctgtctcttccatgccaataaaaggtgccttcgtatttccctaaaaaaaacaagtttgaaagtcaaagaagctatataggatagataagtcgaaggtgaaaaaagttggcatgacaaacaaaaatattggttattccacacatggaaagtacagccaatgttcattgacataacaatcaacaatgtccgccaaaaaggaaaaaaacaatcaacaaggtgatggaaaaggtaaagataacagtaattgcataatttctagctatgtggaatggtggctatagtttgcaatgacactaagctaaattttgcttagcacaggagcagaaggttattcccttcgctaagtaagtttgaacatctcaattgcatggttcctcttgggtggcagtgaattaaagttactttctaaagagtcaggaatttgggttcataactctctcgtccaggaacagtaaatgagtgaaacaacgactactgaataagttgacgatcaaaattattatttcatatagcatgcactgccttgagtgtatgtaaaatatagagtgccagggatatctgaagactaacatcatccaaaactgatgcaaaaactagtagcttctgcaagacaaaacggccagaaaattttgctggtcacaatcctattcacaaatcacaaatatgatagtacacttaaaaaatgataaaactataatttatgatagtactcttttatccaatcaaaccattcataaaatgtgaacatgtcatatttgtatatccaatcaaaatatttataaagctataaatagatacactgactgcatgcatccccaaaatatcacccttttttttactgaaaagtaagatattaatggctcatcatgttcatgtgttcaggcatgtattttctgaacattaattaacataataataggcctaaattaaagtgaagatccaatccatacaaattccatacttgccagaaagagggcaggttattctgtctgcagttattcacaagcaatcaagcatcattggttaccaagttcctaataaatagtatggaccataaaatgtcataacttaactcacctgtttgtgtgctattgaaccactgaaaccaagagttcagccttacataagcccttttaaggaaagtggatatcttttcagattcctcatctgaaaactggtttgcatgtattccacttgccaaatctgtaccaaaaagtggcaagttaaactcaataggatgttcgatcacagtttatgcacttccatacagtagcaaccttgttgtgctaaaccaaaatcgcagacagcgtgaaaattctcaatattataaatttgagacaaacgcactgaaaacagtgcaaaataatgtttttgtggtaacttgattttctgagatatactcaagtcagataatttagatactttgattctcaacagtactgctatactgcatttaatgtgtcatgacagtgaagagcaaggaagaaagcattgtctcaccacgcagtgcaagaaataaggttgggggatttccattggaagggtactgcagaacaaattcctcaggaactttactgcagaaatgtaaaaacagattatataagaactgacactctaaactcatagctagatatgacaatggttcattgctcgccaggggaaccaccttaaagcttcagctcctaatatttgctcccgaggaatccatccatccgcatttattagatctaaccagtgaccaattatatccatcgatatatgcacatcccagcgcctatacatcaccatcaaggatgtgttaaacaagcagcaataataccagcacagattcaaaaaaaaagcgagtgatgatatagtggcagaagccctgcgctacacatcaagatcgatgaaatgcttaccaaatgactaactgatggaagccctcatcccatagaaatccccttgggaagaatgagcgactaggcacagctgtatatagtgcagctggccaatatgggatatatttatccccatttttttgctgcaaggaaactcttgaagcattagattttgtttgagtgtgatgtgtaatcgcctaggatttatatcagatctacaaaagatagcacagtaataagaagggggggggggactaaatcagatagcataaagttcagctgcaatagctattaggaaaaggatctaattatcaggtaacactctaaaacttactgtaaaaccttttggaagtgcaatttttgactgcccatagaaatagccaattccaccaagaagatttgataaagcagcaacaccaacagataattctttgggattaatctgcatcagtgaaacaataatatcaactgctccatcacaaactttcttctgattatgcagccagtcacactacttatcttccaggggaaaaatagcttttaaaggttctttcaactatgaaaagtgtacagacttgaacaaaatggcaaggacactatcatttatacgcaatagcaattttatataatcataggaacaggagcataatgagaagaaaacaactgtatagactgctaaaagaagattgtcaaaactacaaagctcatccaagagatcacaccttattatttgcattgaaaatttggtcatatctcttttcaaaatccttctgttttgattcaagacgagtgctcagaacaggacctggcaacattagtgatataaaatcaacaagcaagatgaaatattgctttcaacatctctgaatttcaggttcaacagaaggaaaagatgcaggcaaggaaaaaaaaggaatggataccaaatgcaaggcagcaaaagaaaaggtcaagagcctatgcataccaaattatggaggacatggtatctatggcatgattgccatcccaaaatgaatagaacaaaaggaaaatcacatatcctatctccatgcagtatgagctatgcagtagagtcacctgttagcctgttaatgcgctcttcaatcattgggttttctgaggcggcccctgacaagaagactatgtcgacttcggcagaacgtttcatggaaacctgtgaagatgagagagagcatagatcacaatgcggaagagaacactatttaaatctgggtgtacgttgactcattggattctcatattgacagaataactttctttttcatctttgacgcacctgatatactattacatttgaagaatcttctgccatgtctggaaggttaaggttcccactttgcattgcctagaaaggtacacaggagcagctaaatggcaacttgagttcataaaaaaaaactgagacttgtttttgaccccccccccaaaaaaaaaggtaaatgtaaggagctaagacatacattagtcgcaagggcttgctgtactaggtcacttagattgtgcatactaattgatttgaatccagctctgtgaatttccaaattttcctgcgagaaaaacacagttctgtacatgtcaatattaacatcagtttatatggaattgtaatgctatataccagtagcgagtaaaatagaaaaataaaaaaatagtagcaacaatgtgacgagcatactgaaatatgctacctcagatctcaaatagactttccaatcaccaatctcctcacgggatccagatgccaaaagaacatgacctcttgacgaaggtatatgcgaatccatagtgattgagttccctgcttcatccgcgatgtagaaaaacaggtgtgtggtgctttcttggtcttcacttaaacttggcctaaattaagtataactacatggaataaatttcttttggttcctttggtaactttatataggtagcaaataaatgattgttaatatcatcctggtttgtgaatagggaatgaaaaagtcaatccagtaaaatttattggtcttttcaccttgtacttaaaactggaaaattgtttacatctcttcagtaaaaaaaacttttcagttttgtaactgacaaatatacacttacccatcagtcttcgcattcaatcgaactgcccaatctccaccataaccgctaccctctcctttctctttcaggaaactcgtggtcaacaacaagccatgatcaaccaacacttgatgtccataatccctcccattgtgatctgtccacccatatgtgctaagctcatcagaatcttggcaaacatgacgaagaaagtattgcccattctttgcaccaatccacattatcccagcaattagagacaacggggttctgaaatagaaatactattagcaagaagttgagagtgccaccatatcatcatcatacagcaatagaattccaactatgaggtggtaaggtggcaacattctaaaccagaaacaaaaacaatacgcattcaaggaatcaagcaggaaatataacaacatctttgttctcgacacatatggactaagcaaatgggaacaaaactccatagaagtgtttaaagcataaaaaacatatgatgctagcaatatgaacttccctgcatatttctagcatgccatggtggactaagagaactgaattgcttaaattagcacgctataagaatcaaggggaagatcaaagttaagcaccttgcacgaattccaagatatacattcggcctgtaggtaccccaatacaagctttccttgtgatctccttggaactgtaaacagtcaactatgagccatcagaaagctaaccataattaccatccaaactcaacagtatggaataacatgatgttacgtataaatcaatcagaactagcttacaggaggatatttaacagaaactggtacattttaggtcgtctgtcctagctcagatgacatttgcggctatgcacaattcatattcattttacctatgacaaaccagtcgtatccactatgtggttcaaacataaagcagcccttgtaaaatccaaacaagcagtggtcgattccgttattctcctagcatttttacacaattcaattaagttcttaactactactgttgcagcagattaagcagaagcgcactaatagactacaaccgcgcgagattgtaatctaaagctatttcacagagcattggaggcttgaagaaacaatgcgacgaacttaatggtcatcacctgaggcagatccatcatcctgggcgcgtcaagcggcgtgacggagcgcacggccctgcgcagaggcgtctcgacctccccatccgccttaccctgccacacgccggtatacaccacgaaggcgacggcgaggagggcgacggaagcagtccctacaaggaggaggttccgtgggctcacctccatgagccgcagggggccatggtcgccgcggccacggcgccgcgctgctgctgcggcggcggcggcggcggcggcggccgccggcggcgcgtgggggtgtggacctggacccctcctggcgnnggctccgggtccccggacactgctgctgccgccgcccccgttcatcggataaaaatcccggccatctcctcgtctctggtcggtctggtccgaggactcctcaccacttgcggagacccagacgaggggtttgggttgtttctacactagtcccgtctttccgttcgataggcctaactatcaaaatacgccttccggtgatggatacgagtagttccagcttgaaatgtaatttgggattacgccttccacgcatcgggtgagggaaaattgaccatgttcagccgttcgggcctcgttttaatgggcctcagtatctcggcccatccacatgtggcctcaatccttcttggggcaccacgtggataggccttaatggtcttatctaagcgaggccttcactgctgagtactactagtttcttttttttttttgcggggtgctgactgctgagtactagtttctgttcactatattcgatgattttttttagaaaaaatgaatcgctgttaaaatgaagattctcaatgcttgttatcaatgtgcatccatcatgtttcatcctacttcttccgtttcacaatgtaagtaattctagcattttccacatttatattgatgttaataaatctagatagatatatatatctacatccattaacatctactaggaagaaagcccgcgcagttgcgcgggcaatttatttattgtttaaaaaaaacctaaaaaagcattatctcaccatattcactataagaaataaaccataaattttgacatactaaattataataatgtccatcatatccaaacaaaaatctttttgccctcatctatcaccactacttattatcgttgtcttgaaatatagatattttttaatagttagaactgcatctctatccacaaataaacccaatacataattaataccatataaaattcatatgtacttcatacgcaagtactcataccttacaggtatccgaatctatatgtaaatatttaaaaataccacatctaataattaattaatatgataaaatcattaacttatatatgaatatccctttaataaccagtgaagccgactatagccgctaagccttttttctccaatgccttgattcatgtgtcccttattgatatagttgtgctcctcaagacaagcttggagcactattttataaaggattgcatcggtaagtaggctagttgagctctattatcaatggtgacctcttactcggaccacttctgctcaataatgcgtactcttgccgtagttactataatgtagccagttgaggtccatgcttggcgccctttagggtatgagtaagagaaaatacaggtgatgaaaatattttttaaatgttttgaatcaatttattttatagagtatacataatttatttatggtgttaatcgatactactaaattttaaattttagtggtacatatataattttctcttttaaagattagcagagttgatcattggactctactttgaaaaatccaatagtttcagtggtgatgaccactaaaaaaatatttggtcaaattgtgatcttttgctaacatacaagttaatataggttttgattttttttcttctattatacatctaatttacctatgcatattcatgggactaacattcaatgaaatttgttaaaattatttgtgctaattgttaacactatttgtagagaaagacataaaaagagatataatgtagttacatctatgtttttttttctagagaacagtagtctctcgtgtggatgtttatttttccttttttttttctttttggatgattatttgtcaatcataggaatatgatgtacatttttctattcatagtgtgcatctgcatggatttatatgagctcatgtgatcgccttttacattgttagtaaataatactttaaaaagtttgacaggaagagggtggagcaacgggtggcatgaggtggtgtcatggtgtggcttattttaccaccttgctagaagtggtcacaacatctatgctcaatttagaaaataaaccttatagtcagaacgaatgagaaaactaccatatgggacagccatatacgcactcttctttttttattatttttatatatatctagcgtatgtatgtacatagaagttgtgtatgtacgtaaggagagattagacggtttttagatagagagattattgtcatagatctaatttaatggttgaaaataatggaatcgctaattttgaggtgtaaatagatgaatagttgtttttcttttattttatagttttcctagatactctctaattagagcgtcacataacatcttagaagcgtttgaaggagtatagaaattctattacccatagtcacaatctacttgtagtcaactattgtttatggtggattatgcaacctctacttgcctatcatttgttgatcgttgcacacttagtattgtcctttatcttcggtgcttgacgacatacatgctcattagatatcagttaactgttaggtgcattgtatacgaatatcttgtaagtgatatgacttagtgattagtaaagagtgacctatatataaaacttacatatatggggataagtgatgacatgcgattgatattttaggctaggatattgaccaattatattgcgtactacatattaagtttttaatacctaagtaataaatttaaggcagtgttgtaaagtgcttataggattaactactccctatttatagcgagtacgtttgtcaaactactatacggtgtattacacagtacgtgttttacaaactttttatataaaagttttttaataaatcaaatagattcatttgtattttttaatatttaatacccaattaatcctatgctaatgacatgtatcatcttgcacgtcctggataagcacacctaatgagctaaatcgatttaaaccacctaatgagctaaatcgatttaaacctaagtaggagataaaagacatcgacacgatttgaaaagaatatatttgatccttaatttctaatgatatataaaaaaagataactcacaatacgtgaaaatatattaatgataaatttagtaatattattttgatatatcaattatttttatagtagggagtgagtaattttgggaaagagtaattttgggaaatgttactcacaactgaagttgttttatttttaaaaatgtaagtctaatttcactatacaacatacaattatataatgcatattattcatttatttagatttttatggatgttttgatgacgtgcgtattgtagaatttaactcaaaatagcatatatttttacaactattagttgaaattattaatttggtttttatctcatgagagagaaaaaaaagaaaataaaaaaataagggaagggggtgggcacgtatgaggtatgtacgtacgtgcacgtacaggttcgggagggattgttatggacgtgcagctttttaaagataaatctatttggtattttagatctaaccgttaaaaatatggacccaccgaattaaatgaaaatcaatggctagatgttttttcaaaactttataatttattaaagtgccacttggtggcttaggagcgtttgtagagacgtcatgtggcggtttaggagtgtttgtaggaagtttaatggacttttaagtatataatagatatgaatgtgggaaatgttagaatgacttacactgtgaaacggaggaagtacatgttctgcaatgcaatatttcgtttgctaacttggttaaaagttcaggtaatcgagcacccatgacaaaagcaaacacaaaatgagattatcctaatccacacaacgccaaagctaattaaaacataggaaataaatcatcagactaataatgtgtatgcgtagtataatgattttttttcaaaacacgaaataaaagtaaacgctcatatacaaacgcgtatactcattctataaatcatttattttataggacagaaggagtatcactgtatcacacactctgtatgaatggctccagtctccagagagtgtcatattgattattggcgaaatcacccccatgtgcaaactatagtacatcaatttaatgtgttcagaactaatactactccctgagatatgaacaaacagagatgaaattgaacgaacaacatggggagaggcttcttccttccatccatcgatcctccaccgtccgtcccacatgccatcccaattctccagggcaatcaaacctcgagcacgattcaagtataaccccgagcaatattaaaatctacgacctctatttcagattataagacttcaaattaaccgagtttataaaaaaaatagtaatattttcgatccaagataaatttattataaaaatatatttaattattaatttaatgaaactaatttgataatgaaatatttctatatttatctatatatttagttaagcctgtagcagtttgactttaacgaaggtttaacccatcttataacctgaaacggagcgattatttagcttagctttgtcagcacgaatcagtgtatgcacttgccgccctcgaacgtccagccgatcttgcccatctgccgctcccaccgcggccgcgccacgtacctcctccagtcccggatcacgttcctcaggtcgtgcagcttgttctccagcccgatgcagcacgtcatgtgcacggtcgcgatgcggttcaggtcccgccccagctggcagaacccgctcaccgccgccgtgtcgatgaacctgatcctcacgccgacgccgccgccctcgcctgcgccggcggcgagctcccgcttgatctcgttgaagacgaactggtcgtgctccccggggaaccggcgccgcgccgcgtgccagtacgccatggcgcgcgcgttgcgcggcgtggccttgaagtagatgaacccggtgttcgggtagttccccaggtcgtccgggtcgccgaagtagaagtcgctcgacgtcgtgatgtccgccgccgccgtgatgtgcaccatcgggttcctgaaccacgccaggtcaacgtcctgccaatgccaacgcgcgtcgtgttcctcgtcgtcaacgcctcgtgtttctcccacaatcatggacgcctactagaattgacgaaaagatttatgtatgggtggagcttgccgtgaagaggaggttgtagccgagctcgaggacgcgctgctgcagcttgagcttgctccagacgaggtcgaggtagtccttggtcatgtagctcttggcgccggagaggtcgaggccggcgacctccgggagcagcaggtagcagtgcgggtggatggcgcggcaccgccggagcgcgccctcgtccatggccaccaccacgatgtgctcgacgaaatgcgagatgttctcccccaccctgaagctctccaggaacgagtccatcagcgaccccggcgccgcccacgcctcgttcaccgacgtcatgatcaccgtcctgtcctccatcgccgcccgccgcaccatcctcgcgaactcgtcgtcgtcgtccccaccgccggtctgcgtgcgaaatcatcacaattcacaaattagttcatcagttcttggactcggctggttaacaatggcgcatatcaagaacagcttacctgattagttcttgctgctctgcgcgtctctgaatctatccctttcgcccgtggagcgcaagccacggcggcagccttcttctcctgccttgtcgccggagttgcctccggcgtcggccacgcgggactcgcggtcgaggtgaagacgaagacgatcagcgcggtggccgacgccgcgccgaggaggaagacgaccaccggagataggccattcttggagctcgccatgcctgcacttcctcgcatgagcaaaaactctgtaatccgggaggtcgcaatctgtatttgtacactgctctgttgcaagagcttgacttttcatggaaactgacagctgccagttcgtggacgccctccaactcccatgtctcctgcaccatcaccgccgtctcctagccgtcgatcaagcgatggaccgttcagatttcgtgagaaaaaacagacgaggattgagatcatgagctgatgtgcgtgatcaaattattctcatcattgaggcctagagatcctcttttaatttgtagctgcagaagcttcagaggatatgccacccgaaaatattcagacatcgacatgcacgcatggttgttgggcatttttgtatgccaagaactcataaagaacagagatcaaagagatgtttatgtcttgatagccgttgcaccatcctactactattgattgttgcaagaggaatgcacataagtatttgtgtggacacaagtgaaaaatgcatagagatcttccggctagctctataagatgatgggctagacgccttgggttcaaagcctcatttttgtaattatttgatataagtttattccctaatattcacgtctttttatttgtgtggacacaagtaacacaaccgacacagcaagggacagatcctctatccccattgaccattgataggcagtgtgaattttgggtgacctcacaactgaacttttctctgtatatgaacagacgacactgctcaaaccacatagagtaacaggctgcagttctgcacatggtgggataaggcaaaagggcaagttggtcactaagaaaaccgaattgacctgtgtaattgaagagcaggcgaatcatggaagaacaaatcatttcagtgcacatattagaaggccaactgaactgtcagatggtccctctgaaagtcactggaattgaagcgtaagaaaatacagctgggttgagaaattgatcgagccatttcttattatttttccagcctcacatcacactcgagattctggagataacgcaaaataatttagtcgagcattttctattcattttgtttcttcacgtcacattcatcagttcagaggaagtaaaatgaggttgagttgggccttttgtattattgtacgtttcttcacgtcacaatcatcgatccggagaagaaagcaacacaagagacagagttgacagaagcttgattaccagcctatttgatttcctggcatccatttaattggcaacaggtccctggaactggaagaatcggaagatgacccattattcaaaactgtaccttttttgcctccataaaatgattaaagtagccagcaccactatcagaattcagaatctgtttcttttggaaaaaagatagtagtacatgccttcacagacttcaatccaaacataaaatacacatgcatcttctctctccaaaaaaaaacttaacctacgcctcttctaatacaatgaattcggataaacctcattcgtagtattaggagggattacattcctcgtaggttgaggttttttttgaaatggagggagtatagttcaatactagcacaagtacatcagaggcatcatagtttcccttcatctgaacaacctctcatttattcagatttattccagaatagctcagttcttacattgtcctagtgttaattcaattgataattaaggttcattgtcgattgacatatagttcatacaacaacagaatgctgcaatttcagtgacatcaaattagcttcaaccattaattctcttgacaatttagggatgaacaggtttacgccatccaatcgaattccggcaccgggtggggtacgtccacttgaaaccccccttcttcctctcctccggcgacatgcccgtgtagttcttccagtcggcggcgatgtcggtgaggtcgtgcaccttggtgtcgaggccgacgcagcagtcggcgtgcatggtgacggcgcgggcgaggtcgtcgtggtactcgcagaagccgccgaagtagagcgtgtcgagcggctcgatcctggcccgcagcttggcgacgagctcgtgcttgatgtggccgaacaccgcctggtcgtgcgcgccggggaaccgcggccgcgccgcctgccagtagcggagcatctccacgctctggctcgtcgccttcacgtagtagagccccgtgttgagcgggttgtccagcggcgcccgcgccgcggagtagtcgtccgacgacgtgctcatgtcggcgtacaccgcgatgtgccggaacgggtcacggaacaacaccatgtcacagtcctaattaacatggtacagaatcaattcagcaaatcgatcgccattgatgatctccagagctcaatgatttgctagatttggaagtggatttttgtccatcgaagaaacatcctctcattttgtacattgcgttcaaaaagttattaaaaaaactgaaaaaaattatcaagatatatcaatatatgatatatctttttgcaaacatacaagttaaaattcgacttatacaattcaaaacaaaaaacaagaagtttgaccgtgttaaaattgcgtgttcttttcatagtcaaatttgttaattttatttttattggtataagttgaatttgaatatgtatgtttgtgaagtggcatatcatatattgatctatcatactattttttttaattttttgatgactttataagtgacatgcaaaaacgagggataccccttagaggatgaatagttttttccattagatttgtacattaccgtgaagaggaagttgtagccgagctcgaggacgcgctgctggagggagagcttggtccagacgagctcgaggtactccctggacatgaagcgggtggcggaggtgaggttgatggacttgacgtggaggaggtagcagtgggggtggacggccttgcagcggcggaagccggcggggtcgacggcgacgacgaggacatggtcgaggaggtgggcgatcccctcgccgttcttgaagctgtcgcggtagaggtcgaggagggaccccggcgccgcccacgcctcgttcaccgacgtgatgatcaccgtcctgtcctccatcgccaccttcggcagcaactccggcaagcccgggaatttctcctgcacagggtgccatggcccatgggctcgttcaatctacatgggctgaacaaaatctgcctctggatgatgggctcaacagctagacaaaaaaagcccactagaaccagcagtttgaggtcgggataaattggcccgttactgcacggtgcaatctgccgacatatcctacgtactacgtacgtgctcaacaacgtcacgttataacaacgtacatatccgaaagactttcatctgaaaaaaattcatatgagaactaacaatttcatacgatatgaaacttgttgtagcaaaagaacaacgtataaactctctccagaattagccaagccataaatcaccaaattaaggggttttgcccgggcacaagggcgaagatagattcgggtgaaaatacacaaaaggaaaaggtgatcgcgcatgcatgtaactaatgaagctggactaatccatcaatttaatttgttagtttcttacctgttgagcaggaggaggagcagcgtcgccaccggcgcctctgagatcatgatccgccgccgccgccgacgatgatccaccactcccccagctcgacacgatcgccagcttctcgctcaccctgtcggacgcgaggaagaagagcagcaacgtcggcagcgcggcgccggcgaggaacgacacgacgtggttccggttgatcatcgccatgccgccgccgcctcccaaccccaaccccatctcgctctccctgctgctctctagagtacttgtgaaaggctaagagaggaattatgaagagcttagcagcagagctgtacttagctagctaagctaactactgtttcattgccacgtactcctactacttaaactacgtacggttctcgattcaacgatggatatatgagaatctattttgtcaaaaggatcgacagtgggattggccaatagctaggacgatcaagagagcccatcggaggaaaaaacaaaacgatatgtttacaaataaaaaataatttgtaaatacaaattttatatacatattcttaactatcaaaaaaatattaaaaaataaactacgataaaaaaaagtcaaaaatcaactttaaatttaaaattcaaagtataaacgaaaagataagggggtaacactaactaattaactcgatggctttgacgtcaaaatcatcatggctacgatgtctggatttgcgtgtattttctcactttcttcctcctcgtgcccgcccgcggtaattaaacgactcagcgcgctctgccttttgagtgttgattaggtcatgtggaatttgttttcacctctgtcaagagtcaatggtgtaggtgatcaatgtgaagacttctcttaatccgtttaagtcgtacacgacgaagagtatacaccaatgcagcctccggtttggacttgtatttgcgcagatcacctgcgctatatagagattcaactggatgcacgagggcgacgagtacaatcacgcatagatgaacaaaaatgacaaagggaatgtttggagatctttagattctaattaagctgccggtgaaaacccagcttgtgagaatcaagagaaagcataaagattaatttctactccgtagttcattttttgattgttcaatgacaatttctcaaaattttaaaaactgaactatttggatgaatattttttattttatgagaagcagtataatgcattcgtcctaaattagtgtcgctttgattttttttaacgtttgaccattcgttttattgataaattagtacaaatgtaaaaaagataagtcatacttaaagtgcttttgataataaagcaagtcaaaaaaataaataataatttcatgattttttaataagacaaatgatcaaaagttacaaactaaaaacttaaagcgacaagtattttgggacggaggtagtagcaacaagactaaagattgggttggagtgaaaaaacaacaattgacctccggtgaaaattaatcagtctgttaattacaaccattgactcagtagtattatatttaaccaattaaccagtttgttagctaagctagttgccggaattcatgcagaattacagatgcagtaagagtagagatatcacggaagtggatttttgtctctcccggaggcacccgtcgttttgtgtataacatttaaaaattattcaaaaaaaattaaaaatttatcaagattgtcgacgtttgatgtcacaattccggtatttgcatagtatggggatcgttggtactaggatatacgtgagactgagataaaagagatggagacatggatttttatacaatgttcgggcccctgaattgtcaggtaataaccctacatcccgttggccgaagccggtattgctcttattcaccataatcacaccagtacaatatttggggtagcctatctaactgttgtcggcatggcggtctgaaggtctgactcgtggtcgacaacagggtagtcttccttctcgaatccgtgcccggcgagatcagagacatcgctagatccctacggccggcctctgaaggtaccagatagggtcgatctaggcatatctctgatgtcgatatccggcgacttgtcttggcgtatgttggcttgtatgttgtggcttatgttgttccgtgtatgttatggtgggtgttgattgtcccccatctcatcgtatagggccttgtatttatacccataggtgttcccttgtacaagtagaactagagaaacaaatatggatacaatctaagtagtccttatcgtttccatgtagaactctagttgtcttttcttatccggaactcctcctatatccgcaggttgtttccgtataattcctttgattcaaaggggccctaaaaggattcttaacatgaggtagaacctcatgttaaatttcctccaaaacttgcatgggaataggtattccataggaattttatgggattacataggattcattcatttgattcaaagggatatataggaaaaatacctataggaataaaatcctttaaaattcctatgaatttcctttcaatcaaagaggcctaaatatttaaacattaatgtttagaataagattcgattaaaacgttagatcgatttagtcaaagaacaaacaaaaatgataaagtaattgctaatcattgtattagtaaattactaatttacccataataatactggtagaaagcagcggagcatcactcttttcataaataagtaagtttaaatttcacctccacacattgtaaaaaaattactacgaatatacacatgctattagttgaaatttaatttattcgtcttgtcataatttgtagatattgaatgtgagttatatttatgaagtgatatatggtatattaatctattttgttataaaatattataactatttaagtgatatgaaaagagaaggtggtgtcgtctcgagagaaggtgatatgaaaagagaagtttccattctcggagcgattccgagcgaatgagagctaaaatagctggtcgatcattcaacctccattttgccaactaaatctagctagctgatcgttcgtttcttctgtttattttccccaacacaatccatccgtacttataatcgtacgtgcagccatacacaacgtggactatataccaaccttggcaacgcataatgaagagcttgcgagccatcaagtaaaattaaaggcgatcgatatgtccacgcatcatgcacgtgcatatatatgcatccatcagcaagaatacgtttttttttttttgttcttgttgttacctgttgcagttcgtgatcagtaagggcagcaccgtcgttgtaccccccatctggacacgatcgccagctgctcgcccaccctgtcggaggcgaggaagaagagcagcaacgccggcagagcggcgccggcgaggaacgacacgacgtggctccggttgatcgtcatgatgctgcctcccaatctcaaccccatatatatctcgatctctctttgaaactctaaccaaatgtggctggctgatcgatcgtgatgaacagataagagagagagagagagagagagagagagagagagagagagagagagagagagagagagagagagagagagagagagagagagagagagggcgcaataagaagcttggcaattgtctccctgcaaatatgtttcgtctctgtttcgtgcatggtagctgggttgattgaccaggccatggattactttgtcaaaagatttttgtgattgatcaacaaggcgactccatcatcctgcatgccgtttcgctagctaggcggcacgttacgcaactgcgtcagcgtgtgcatgtatttcttcattacaatatatatacccgtcattaacccaagcaaggccgcacacatttcctatccctttttttttctaaaatgctggagttctatttattcgaactgtccaagatttgtaacatcactcccttattttctaaaaatgcacatagtttaccagcttaattataaactacatattgtgaaagtatttcttacacgtgaacctaagaatataaattttatgacgttaaactatataagtttctaaatttatcctggaagcaaaagaaaaaattatagtagttccttttagagtaaacaatatatatatgagttggagtactattttctgcacgtgtattttggtctgtttataccatcagaagaacagtggcggaggccccccctcccaataaactattagaatcccctttaagacatcctaaaatttaaatccatatatctattgtaggggggttaaaatagactttatctgagattgttataaggcccaaaaggctgaggagcccccactataactttatcctggctccgccactgagaagaagaaacaagtagcttccggttcagacttgtgctaaatattattttgacaaaaaaaatataaatgttgggaaagtacgcgtacataaagagtcaaaacctgcaactgtgacacattcaaccacattgacagattggagcaaaacccttgataatccacggctaattattaacctatgtatagaataattaatctttgaccattcccggacttcatggtcagtgccgtttcaacgacgccttgcacttggccgggaacgtccacctgaacttgttggcacccttcttctccggcgacgtcaggccggccgtgtagttcttccagtcggcgagcacgttcttgaggtcgagcaccttgttctccagcccgacgcagcagttggcgtgcaccgtgcacaccctgccggcgtcggggcggtactcgcagaagccggcgaagaccgccgtgtccaggaacgtcgaggaggtagcagtgggggtggacggccttgcagcggcggaagccgccggcgtcgacggcgacgacgaggacgtggtcgaggaggtgggcgatgccgtcgccgttgtggaagctgtcacggaagaggtcgaggagggagcccggcgccgcccacgcgtcgttcaccgacgtgatgatcaccgtcttgtcctccatggccacctccggcagcagctccgccaggccggggaatttctcctgcgcatgtcgcagatttgccacgacgacacgtagcgcacggatggtcaagttgggtcaacgcaatatggagaatttttttcctttagaaaataaccgaaatcccgagtagcggcccagttgtggccctataaacctagagcctacactgccgaagaaacctggactaaatgcaaggcccgcacaaactctctgcttgttcaattacaacacaaaaaagatcggtttcccccctttttttttgacaagtaggaataaacattttttttgcgaggggaataaacattttctacttgggttgaaaagaattggattttacaaataaccatatttatagttggtatttggtacccactaactctaagctcaatatacaggtatggcatattatcacccactaataattattatctattgtattttaaatctcatataaatatgacatattatttataattttcttgtatttttagaactcaacattatgtaatagaataaaatcccggtctttgctcaacgaggtacaaccaaattcacgcaaactagcgcacataaacaagtcttaaaaaacccaccagcaaaagcttaaggaaacacgagctaataatcgctcacacgtgtagtttttattagtttaatgttctcatcacacattcctagtttagcccataaccaaagctatgtcaaatcatcatctctacattgttttcatgaaatatatacgttctattttgcaggacacacattcattcacatatcttgcaggaaataaagcgcgaagtatgaaatgcttttatacaacacgggtgtaaagtgcaaacggtgtagcaaaggatgattatattgcccgtaaggccgtaactccgtaagtgtaacatgttaacatcaataatgttaaaaagaatgaaatcacaaaattccagcaacaatactaatctgcacagagcttttttccccactgtaacagcagagataaaatcgatcaaaccttttctgctggggcaggtgctgagccatcgacgcctgtgaggtcaccaccttctcgagcagtagcacggccaccgatcacgagagctccattgcccaagctcgatatggtgggcagccgctcgctcacccggtcggaggcgaggaagaagagcagcacggtgggcagaacagctcctaggaggaaggaggtcaggtgatggtaataatggccactcatgttgccaagcgccaacaacccaggagggaagtacatggggaacagagctccaatatatacggaagcaaatgctattattcatctgatatctctgttctaaaattttagagaattttgatcatctagttacagggtcaaaatctcctatgtttttttttaaaaaatctcttatgttttcctatattttttaaataaaaagcctcttatattcgaagacagagtgtagtacttattagatatacaagtacatcaatattaattttaaagtatggcgtttgatcatttgttttaattaaatttattaaatgaagtattatttatcttgttatgatttattttattattaaagatactttaaacatgacttagaatttctttcatatctgtacattcagaatttctttcatatttatacattacttttctataaaacggatgaattgtcaaatataacgtccaaaggtcaatatcgctgtataattaaaaacagagcagggttccttccaaacgacgaccagatcggggacttaatttctcgagtgcacatttgacttggaaattttgcctttgagtgaagtgtcaatctgttttctccagaatgaacagtatctttgagtgctgatcccgtaacacggctcggtatttttcaatggtggtctcgacttactctgaaaccggttatacaattatctgacacgtggccctggattcgccaacaaacgcttcgaagctaagcgtgaaagaaaaaaaatgagtagtttacatgtatatacagcgtcgatctcccggatcacgggcgtagttctggagcctagcgcttgaagcgtaagatctccttaagaaaaaaaaatagtgcccaagtatgtacatgtagactgtagtattatccggaacgcgcacgtcaatatattatcctccattttcaaataaatgttagtagtaactcctaaatgatcaaactaagacgaacaaaagttccatataggatggaataaactttaacaatacactagtataattttgtagttttatttttttgcggaaaaagagtgatagaattttagaaataatcaatgttcggcgtaagttatttaaaaacagaggagggcatgggtctacttaaaaaaagttgttttgtttttattaaaaatattagtatattttttttataaacttgatggaacttaaaaaagcttaattaagaaaaaaaatcaaatgaattataatatgaactgattgagtaatttaaaatggaggagggcatgggcggacttacctttcatatttgaaagatctatcaaatgacaaatcaatttatcagcaaattagctgcatcatatgtcatcttttcaatactacaaacagcgcaacagctatcaattccttctcgtttgctagtctccctgaattacaggcgccgccgcggcggcgcgccacaccggccgccggcccggactcatcccctcttgtccggcgtcccgcacttggccgggacgctccacccggcgcggcggtcgccgccaccgccgccgctcttcttcttcctcccctccggcggcgcagggctcgtgtagttcgcccactggtcgagcgcgctcctcaggtcatggagcttgttgccgaggccgacgcagcagttggcgtgcatggtgcacgccctcgccatgtcgttgcggaagagctggcagaagccgccgaacacggcggtgtcgaggaagcggacgcgcacgccgaggccggcggcgagctcgtgcttgatgtagttgaagatgttctgctcgtggttcggcgggtacctcgcccgcgccggccgccaccgccgcagcatctccactgtccggttcgtcgacttcacgtggtaaaacccggtgttgggccagttgctcaggtcgtcgccatcgccgttgaacacgtcgcacgacgtcgtcatgtcggcgtacaccccgatgtgccggaacgggtccctgaaccacaagatatccacgtcctacaacacgaaatcatcatcgcaccattagctgaatcgatcgatctttgagttcctgattagaagaggaaactgatacatcttgctaatttttcacgaacacgtaaaatgattgcatgtcaatatattagaagaaaagagttataattatacaacgcaattagccaaaccggcttatgccaggggaaaggagaaaaagtaaaataaaaagttgaagcttagaaaacgatacatcttagcgaggttgatttgatcattaccgtgaagaggaagttgtagccgagctcgaggacgcgttgctggagggagagcttggtccagacgagctcgacgtaggcctcgctcatgaagttgttggccgagctgaggttcatggtgtccaccttgaggtggtagcagtgagggtgcacagcgcggcagtggtggaacgcggcggggtcgacggcgacgacgaggacgtggtcgaggaggtgggcgatcttctcgccggcggcgaagctctcgcggaagaggacgaggagggagtttggccgcgcgaacgcctcgttcaccgacgtgatgatcaccgtcctgtcgtcggttgccaccttgggcagaagctcagctaaatctgcaaaacttgactggaatattgaaatccaaattaagggtgtcgattggagatgtaaaaaaggataaattcttttgaagtgtagctattcacttcctaaatgagaactgcagtacaatttttgaatcaatatttgagtgttcagagtttcttcagaacagtacttgtgtgttcagattatataggcatcatgtctacgtggagcaagatactgttttgctggatcggagtaaatctctatttgttttcttgataatggattatataaccccacctcttcatcctaaatgaatgtacacggctaacagttcatttctaggaagtaggatcatgactgttttaatgagctagctaactgtgttttgtgaagggaagtactgtactgaatcttttcagcactatttgagaggtggcatattcacatatatatgatgaaagcatcattattcttattaagcacaaaaaaatgactatttgaagtggtttccgtacgttcctgcaaaactgaactgaaatcaacctcactttatacttatttatacagtattatataagctctaaaagaaggtaaggactaaatatgtacgttgatcttttctttttctgtgattttgtcacatgtgaatgttgtctgtggaataaaatctggatctttaatggtaatcggaataacatcattgttttccctttttgtcaatgcacataaatgttgcattactcctttctcctactcaacaattgtcacatatgccatttgtttttctatttttctgctaattatcaaatacgcaatacctatctcgagaaaaaacgatgatgcgcctcttgttttaacaggcctagattataataatatgtgttaactatagtcgtatcagaaatatgatcaatagaccatgattataatcataccgatcatgagacataaacaatacagctacgctctataatatagccgtacgattgcgcgggcttttccgttacttttgaagatataatacaattttctaaccgttagatgtgatcaaagattcgtgtttcccttcttaaagaaagcctttcttttgccgcgcaaatctaatggttcgaaaaattgtacttatggttcctcttcataaataaacattttttctgcttaagcaaagacaagatataagatttaatcatttggggctgtaagaaacatggtatatgaaactgaagattgcagattgctactgtcatgaactaacacagaagtacagaaccatacaacagagcacaaaattaaacagaacaaagaaaaagaaaaaaaacatcaccatacatatcgagatcgagtacaaaagcattattacctcgttggaattaccgctggtaccagtaacttcttctgatatgcgagaagaagcgattccaatctgactgcagttgcagacttccgccgccgccggcatctccggcgatccccccgtgttggcgagcacgcatagcaggaccaggacaagggtggccgcgagccacagctcgaagaggaagacgaagaagcggcggagattgcccttgatctccatggcgacgcgccgcggagagcaaaactcttcagcaaaaaagagttggagaaagggcagaatagacgcgcaaagcctgggattttttttatagggcgtttttatgaacttggcagaatacagctaatgatgatacaggttaattatatatatgggatagaaacttacaactatcttctatggtttgtagtaacgtatgtcccatattgtgaatcaagctggcttttaaatgcttatcgatcaggattttttttcttcaatgcattgtatatttacacctttcctcgatgaaaagttgaaaaccgttgttctctataacattattttctgctaattatcaagtgcgtgacacctatcattcttttaggaaaattactgtgtgatacctatcattagtccaagaaaaatctaagacgactactctgattattctgatgcccctatattataacggcatgaacaaactatagaaaaaaggttatctagttttcagacacctaaaaatatttacaaatttaaagctttttgacaatatagatcacgactaaagtatattaacctaatattcttcttttcctttttccatggtcgcagcgcacgtctccgaccactagatcttgagctcgcgcatgaggccacctccctaccttgcagtgcctcttccatgtgcctcgccctacgccagggccgatgaggcccgctagatgacccactcttcctccttccccactattcccgaagccaaagtggtggtgaggtgcccccgccttcttcctcatctttggtggctcatgccgccgcgaccacctttacctccacatccacctccactcataagttctaaccacttttgatctcatgtcacaaccgccgaccttgccctccctctccctgccttctccgatgctatggctttggctctaccggctcccctaccatccctctaagcccaacccccttcgcctcctcccttcaacccccttcgatttttgggataaccaaaaaataaatctcattggcttagctatggcggtcgtttattgccatcgattagggttgcatgcactatgtcacgccccgaactagtcccgaccgaaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtatgggagtactcagtaagccaagggaagtaagtgtttaatgcaggcttcaaagaaaggctgttgtttttgcaattgattttatttgagctcttttctaaaaacaactaagtgagtgcttctcaaacgacacgggtgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgtagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccaggaagcccaggggtcctccccgacaccaccccggcgaatccacatgtctctcggcatcaaggctcccctgataagttagttactcagccaggggtgtcccattccacccatgtggtcgtacttgtcttatgtttggatgaaattacaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactgaacaaacggcgaaaataaagccctattaatgacctctaagcgtgccattagatagatctcgagatttgagaaattttggaatttgaacggagtcaaacggatttacggttgggaagatattgaatttctaagattattggatttttggtctaaaggttggaaaagaaaagaaaagaaaaagggagagggagggaatatagacttccctcgggcggctagggcgcggcccgatagaaagggcagctagggcgcggcccgagagaaagggcggctcggccgagcttaacgggccggccggcccaagaaggtggcccaaggcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcacgggcgggggagggacgcggtgcacgcgcacggttcgcggtggacgcggatgcggcgggcccacgcgcagcctcacggctcgcggtggaacgcgcgcacggggagggactgaccggggtcggctcgacccggtctaggctaagctggctccgacgtggcgcctacgtggctgccacgcgggccggcgggaggtagacgacgacccggccgcgaatggacggtgggcggcggcggcgagcggtggagcgaaccacggcgatacgggcaaaagctagcacaccgggcggttgttcgtgatgaggggagacgagccaacggctcggatttgccggaggaagcttgacggcggcgaatcgcggcggcgacaaccggtggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgacggcggcgagcacacggcgagcgacggcaacggtcggggcggcgccggctaactacggggagtctactcgagctactaccgaaagctagggggaggagatggagcgaggaggaagaatggagggaggcatcaccgagatgaggaggggcgctgtgacgagaggccgacggcgcgggagtaatctctccggcctcgggctggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccaacttagggcggtcaaggcgcgagctggcgctcggcggtcgcgaccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgatgacggcgatgacgacgggcggtttggagcggcgcgacgacacgggcgacagacgcgtgcagaggctgacggcggcggcgaccgggcggtcggccactcggcacgcgcgcgcggcttgcaacgggcgg

SEQ ID NO: 13060 - DNA, 14429 bp, Oryza sativa
agggggagatgggccgggaggaaatcggcccatcgacccccgggggaggcaaaatagacttttgcggaggaattgatttggaaggattggattcggaattggacccgacgatagatcagggattgagatcttgagatgacacggacactagacaacaagcaaagaaacaaatttcgcaattagggtttttaagagataattttcccgctaggcgccacgacggaacgggcgctacacactagcacccgtccacaggtatgtcttaaaaaaggaagtaaattacaaggacgcctctaaaagatcgctacaagatatgagtcatgcccgtggtcatcacaaaaatgtctgaaaagatatatcattcgttatttggactcatgaattgaggctagctcacttgattgggtatggatatacacctaaaacacccaaatttaagccctcatcaagaagggtttttatggccttttcttttcctaatatatacaaagccaccgagtctcataagttttcatatgttatatgaatgattgagctaaagtggcgatgtaactttttaaggttgatcttaaattctctagcttgcgctaaggggccacaaccattctttcgtgtgacatgaaccctaagttgaattatggagttctaaaagatgagagagaataattagaggtagaaaatagaggcaacagtatgaaataaaaaaatagctgttaaaaaggaaaaaggctatatataccaaacggttacagtgcaagctcataaagagtcttcaataagaaacttctaaaaataagaattttcgcacttcaatacttaccttttcttttctggcgggccatttaatacatactatatttgttgctttgttcagtagcggacaaaatgtgcacagctatctactccttcaccaaaagtcttatgcatatttggttttctggtctttctaaatgagatgggtatattggtagcctctatgcacccaagacttcttatctgtggtgctagattgaatcgttgatcagaacttgagcatccatcttaatacttactggttacatacatgtgtatagttccttaatttttgttgtacgcgggatgagttgattgcttcttttttttggtgataaaagaaaatacgtccgagacatttggatggaaggagaaatgctggcttttcccgacaaacagtttcaatctctcaacatggattttaattatgggtacccgaaaaaacaattggaatatatatctcagctcagttatacacctggccaggcaaacaattgataatgcaacaccgaactaatttaagaacacgtatagaccccccgcccctcctcttttccatccgtcttcctcacagcacgcgtggcagtgaatatacacgtacaatctttttacgtgttcgtgaaaaacacccatctacactaacaagctaaccgccttttgtttttttcttcagtgaatgcagatgccggggaccttccagcgcacgggcccctggcggcgctgctcgtcgggcatccgccggtacgcgcgccactcctcgagaaggttgcggaggtcgtgcagcttggcgccgaggccgacgcagcagttggcgtgcatggtgtagagcgtggcgaagtcgcgcgtgttgctgcagaacccggcgacgtgcgccgtgtccaggaactggatccgcacgccgggccgctccaccagctcccgcttgatctcgttcagcacctgctgctcgtgcctccccgggtacgacgcccgcgcggcgcgccacgcctccatcacccccaccgcgcggcggctcgaccgcacgtacaggaaccccgtgttggggaagttggccgggttgtaggcgccgccgacgaagaagtccgacgaggtcaccatgtgcgccgccatcgacatctgctcgaacgggtcacggaaccacaggatgtccacgtcctgcgtgtatattgcgatatttgcatatttaaggggtgcgttatcgataaattacccaatgtttaaccattatatatttagtgagttgaattaaaaaggcactatttgaaatacatactactacaaattagtactttaaatttcaaagaaatttttgcaacgtttagaagcttagtaattaagcacgtatatggtgataattcgtaatattacataatctattactccatctgttccaaaatgttacaatctaatatgagtctttcagtacaatgaatctagatagatgttctatctagattcattgtccgttgtaatattttggcgtggagggagtatgcatctagaatatgctttagaaggatgcttttagaaaatgtgcttatgtacgtggaggacctttttgtgaaatgaaattagtagtacgaatttttgttttgtccttttgtgaatttataagatgtagtagtactgttccaactgctacgtagcgtgttgtaacgtaccgtgaagaggaagttgtatccgagctcgaggatccgctgctgcagcttgaccttgctccagaccaggtcaaggtagtcctcgctcatgaacaccttctcgtcggtgaagttgcggccggcgacggcgaggcggtagcagtgcgggtgcacgtcccggcaccgccggaaggcgccgtcgtcgagcgccacgatgaggaggtggtcgacgaagcgcgcgatcccctcgccggcgcggaacccctccaggaacaggtccagcagcgaccccggcgccgcccacgcctcgttcaccgacgtcatgatgatgttcttgtgctcgtcggccaccgccgccagcagcttctccagctccttctcctcctcctccttcgccgcctccgccgccgccgcctgcacggtcaaaattttcaagtcaacttttgccaagccaagaaaatttcagacaaattaaacacacagaaaactacagttttgtatactaatctgaattccagacctggctgttcgtcaggttagccttctcctcgacatgagcagcggtgctcgtcaggttggtctccttggccgtcgccgctacagtcccattcgcccagctcgacaagtccgtcgtcgtcgaccagccgccgccggccgacgagaagaagaagatcaacacggccgccgccgaaaccccgaggagaaacgacaccagctggttgagcgcgctctgctggccacccatcatcattggctggccactgccaagaaacggagcaaattaaaggattcaaggagaagagggagaagaagcgtgcgagggaaactgctcggcgtgttacttaacacttcggttttttggacgttgatctcttcaaaataagtcgccagtagccaatgagaccaattctacttggtcacacgttgctagagcattggtgcatgatatgaccgcagtttctcctctccctctcggcatgtgcgtctctagctacttctcttgtacaaagtcaatccctcttggggtttttgatatggaaatgggaatgtgctcttcagaagcagggttgcatgcatttgtaaactgttggggccatgtgtatatcagagaatcttcttattgtgtgcttattgtacacagtttacatggtcagcattgataattttcttcagattctctgactgtaaacatgttctgtgcaagtacattccttcttatggtaatcatctgtgtatgattctctgattttttttccattttttttcacagatggacacatcaatgatcaattgtcctgtacaagtatacagtgtggccgatgcaactgtttttttgaatgcttaacaggagaaaacttgttgtcatgacagtacatggctacatgccatcgttgaaccattgccagttgctttcgccaacaactctcaaaatgatatcacgtgggccttgctcatgaaagcgcacaaaatatttcaaaataattcgtcttccaatgggcgagatggatccagtatttttccaaattgattttcaattcagatgacaatcatagctgccacctgtccatgttttgacgaagttagtagattacttgtcccgtccgtaatccacaagtgttttttcccctcataggtcagtaatctgacagggaagtgagacaagtgccagtagaaaaaaagaaaagcaagaaaacgaaatgccactccacagttatattgaggtgactactcaaaactcaaaatggaaattttggccttgattcatcaaacgctctgaatggagaaaagagccatgaacttttgaacaacaaaacagaggtgcccaactaaggccctggcccgtcaaaaactttcctgaaactcgagcagtttaggcccaacacgtgctcatcacggcccagtataagattttgcatcagctgggctatcttggcccagaaccatgagacgaagtacagtagtgcaacattagcgcgttgagcacagtcattccaactccaaacggggttgccgccgtgacggacgtcgccgtcacgctgtttccgaggccactaatctccaaattatcgttgtcgcctccctcaatgcaggtgggccagcccagctgtccacgtcagccatggcccttctggtggggccacgccaagtcaatggtttcactggtccgcggggactgagacgaactcgactccaaagcggacggctcagatcgtcaccgctcatgatcggacggtcaggatttcgcctttcgacgcaaatagtcaaatccccgcgcggcacgagtaagaaagtcgtcgtcgccggacgggttgcctacgagaccccgttttacccgatccaaactacagttttattattgctcaagctatttttacagcacatatccgattatttcctacatccttgaaatcaaatgcggttgatatgataaagatgaattataatgcactaaacgagaaaacttctttacacatgattaattaattattgactattataaaatttaaaaataactttatttatttatttaaacaacatctatcacaccatttaacggtttgatgaaaataagaaatttaaaatttagagtcaagaaaaagaattgggcctagtcctaacggaataaaccaatgaacttttactactgatgatgaatttacagtgacttcttgtcgatcaagaaagaaagaaagaaacactctggtataaaacagtagaggcacaatcgggcatcgattctgttgttttcatgcccgaaaagaaagaaagaaagaagcatcaagcagcacgttcttcttgttccctaggccaagaaggttgggggggggggggggggggttataaaggtcaattcctcctctctctcccacctctgaatcctcctctccttcccctcgacacctcccgattcaaatcgatacccaaaaaaaaaaaaaaattcacgcgagagctctcgatctagggatccctcgtgttgccgcagagtcgccgcctccgccgcacaaaaccctaggtctagcggcggagccccctcctccaccccttcgctcccatggaggacggcatctactcgtcctccgcgccgccgtcgacggcgacggcggccgcggcggcggcggcggtggggtcgtcggtgatcccgatcgtgaacaagctgcaggacatcttctcgcagctggggagcagctccacgatcgacctgccgcaggtcgccgtcgtggggagccagagcagcggcaagtccagcgtcctcgaggcgctcgtcggccgcgacttcctgccccggggctccgacatatgcacgcggcgacccctcgtgctgcagctcgtgcaccagccccgccgccccgccgacgccgaggcggatgagtggggcgagttcctccacctccccggccgccgcttctatgacttccgcgaaatccgccgcgagatccaggttcccctcccccctcgcattctctatcttctatcgatgttgatttaggcgttctgatggttgattaactgatagaggtactagtttggaaccttcgcttgtgctcttagcgtattctactgctcgagagttcactggtaatgttgtgttatgactgcttgctagggtttcgaatagtttgtggtgatttggatgaataattagtattgtactgctcgtgagtctactggtaatgtactaatgttgttgtgtaatggcagcttgctagggattcgagtagttctaccaggtttggatggatcattagtaatttgttcggttttatgatgtatgtgatgccggttaggctctataggtttagtgcaattgggtacattctaacactaccaggttggattgggggataacccttttgggttatattccatcttcagatttaggggtggcgatattttctcatagttgcttttatggtgacttgtgctgatgtccatttgtgtttcttcaaaggtgtgggtgtattgccttatctaaaatctctttgatttgttcattgcctttgagatgtttgtactttcagcctttggtatattgtcagtagtttaaacttagtgatttgcttgaatgtggagattgtatatgcctgtgtatttggtgacgcttatcctattctgattaattaccattgcttttatttgtccggaatgaactggtcgctgagtttagtggttatgtaaaatctgttattggagaagtgtgcacaatagtacctttgatttaatttttttttcagtatatgctagaaaaattgtaccatttgttgtgttatgcttttattgattcagttatgctggtttgtttagttatgccaatgcctgcaagtgttgaacaaactgtaccatagggcatagagcactattaatcattcccccaatcaatgcaggccgaaacagacagagaggcgggtggtaacaaaggtgtgtcagataagcagatacgactgaagatctactcaccaaatgttctaaacattacgttggttgacttgcctgggataactaaggtgccagttggtgaccaaccaactgacattgaggccagaataaggaccatgatattgtcgtatatcaagcacaagacatgtatcatcttggctgtttcgccagcaaatgcagacttatcgaattctgatgctcttcaaattgctcgaaatgctgaccctgatggtattcactacagactcaatccattagataattcatgttaatatattttgtttcttattaataattgattcattgttcttgtaggttctcgaacaattggtgttataacaaaggtttgaccctggtcttgagttttttgtctggattaaataagcattgtgttcataccagtgacccagtttgatcttggcttcacttctattatcttccagctggacataatggacaggggcacagatgctcgtaactttctgttgggaaatgtgattccattacgactaggctatgttggtgtggtaaaccgcagtcaacaggtactgcattctggtcattctcatgacttcgtgagcgaactcattctgtatgtctgtatgataaccatagcttccagatggtgtagttgtctagcatcagcctgctgattgttcataaaataatgggtaacaaatagagatgtgtatactaccttgtgattacaaacttgtcctagtagtttgtagcataccaaggatgtaatcctccataacctggacaaatgcttttccattgtagtgctaagtttagtgttattagatttctattatatagttttctcggcgatgcaggatatcaaatcagatctcagtatcaaggaagctctggcgcgcgaagaaagtttcttccgtaatcatccagtaggctgcaatgaattttgttattactttagtgcttattttcttcttacatgtttgtgaaatgcactttccttgactttttaggcgtataatggtcttgctcagtactgtggtataccacaattagcaaagaagttaaaccaggtatttatgtaattaaattatcagttgtaatcaatctgataactttcatatttctgttgtgatttaaacgaaaatacatctgtatgtttcagattttggtccagcatataaagactgttctgccaggattgaagtcacgtataagttctcaattgacaactactgctaaggagctttccttttatggtgatccagtcgagtccaaggtggggtttgaattaaaaaagaaattttgtccaagtgttagaagcataaaatttgtttgaaatgtttttcaacaatattacctgactttttttatttagggcttaatgaaatcaggccaattcatctgtgttctcagctaattttttgtcctctttgttgatggtccatctgtgtttctttactgcaggctggtcaaggtgctaagcttttgaacattctggcaaagtactgtgaaggtaatttttgaatcatgactaactgtgctggcaatttttaaataatggtcaattgtgccatttaatactgtgtatgattaaaagtcctgtgttattttttgtataagtcttatcatatactacctctgtttcatattataagtcgttttgactttttttctagtcaaactcttttaagtttgaccaagtttataaaaatatatagcaatatttccaacacaaaacaaacatattatcaaaatatattgaatgctacatttaatgaaactaatttggtgttatcaatgttgctattgttttatgaacttggtcaaacctaaagaaatttgactaagaaaaaaaagccaaagcgacttataatatgaaacggagggagtgtgtctattcttttgtttaagctgtatgtgataaattgtgccattttaagttgaaacatttttatgttatagctttctcctcaatggtggagggaaaaaatgaggacatatcaacaattgagctttgtggtggagcaaggatccattatatttttcaatctatatatgtaaaaagcttagaggttcgtgattttgttgcatgttcaattacaaccttttcattatgttgtaccacatcattgttctataatgaagttatagaactttttacacaggatgttgacccttgtgaagatgttaccgatgaagacatccgtatggctatacagaacgcaactggtcctaggagtgctttgttcgtacctgaggtataccatcccactttaggaagaacgattgtaagagtaattcatggatgatggccagttaagctgacaatttttccttcgctaacatttctcaggtaccttttgaggtccttgtacgcaggcagatcagcagattgcttgatccaagccttcagtgtgcaggtttcatatacgatgagctagtcaaggttagacctgacacctttttttgccacttgtctggcattgccgtatgctaatgcctagtatatctttgtggatatgctttttcttaatatgccacttgcacttttgatgcatctatctggttcacctcacagcatcaactaacattctgatgtattgttgctctgttacttcttgaactgacaatttaagtttttgtgtagatgagccatcgctgtcttgctgttgagctgcagcagtttcctctgctccgtaggagcatggatgaagtcatcgggaggtttttacgggatgggcttaagcctgcgcaggatatgatagcacatatcattgagatggaggtaataattcctcatcatgttggatattaatggttaacaaatttcctggtagccattggagtttagaaatatgccactagcaatatttgaatatagtcttccataaatagtgctgattactgacccccagacccacaatttatgaagtatgtagaaaccaagctatttcatctaagctagtgtttgggccattgatagctgatgttttttttcccctgatttactcttgactttgcatagatatgctataatctttttcattgtcataacctgcaactctattttggttcaggcggattacataaacacatctcatccaaatttcatcggcggcagcaaggctgttgagcaagcacagcagcaagttaggtcttctagactggcagctgtggctagaagagtatgtatacatcatatgcaccattaccttttccttttcgttctgattttctaaaaacaatttaataacaatatggtagaatcactgccaagtacattgtgtttgtggcaattgcatattgtcaaacaagaacaatatttaatgaatgatgtacagatgaactatcttttcataagtgacatgtgcttctacttaattgcatgaggattgccacaatttgaggaccattggaactaagagctacgtgagcagtacatgtaattctataataaatgtttagcagctaaaaatagtacctctccatgacttttaacatatttcatgataaccgctggtatgcccataccataatggatatccatttgtttgtattcaaccattcttttttcatttagtaagaggcatggctaaataaactcatggtgtacaccatgttaggacttgtgctatacttgctgcacactactttggtaatttggataatctttacagatactttaattctgtaatttgcattatcattttttttgcacatttagatatttgttctcttggaaaataggtggtgtgacttaggaattcatatccttcacctgcaatttccgctcttgattcctcatattatcaactatcttaagtatctaacgtactatactgcaggagggagtagatgctgataagtcacaagcttctgataaaactcaaaagccgcgtgcgcttttgggtagaactggtgtaaatggagtagtcacagatcatctccaggtttttgtcattaccattttttttacccttgcaatgtctataattgttaggcacttacacctggcatttcttcttttgattttgtcatccactatcagggtttacggcctgctgctgaggctgagaggccaggatcttcaggtttgaattttgctacaaatgtcatatcttaagtctgttgtgctaacatatgtgaatgctaatagtatacccttctctagtgttgctcttactgctttgattctttctttttggggggaaactataaagcgatttgatgtaagcccagtttattggccatcttttaggtagtggaagcacatctttctggggatcaatatcaatattttcttctactagtgatgatcgtacacattcttctgcaaaagacaactcatcgaacaaatcttatacagcttctacttcccacctggagcattcactctctacgatacagttgagagaggtgagctatcttatcaatgccttaatattttctcatcagtgttatttgaatttgttgagtgattgattgaggtaattgtcaaacagccaccagttgtcttgaaaccttcagaaagccagtctgagcaggaggcgcttgaaatagcaataactaagttgctactgaagtcatattacaatatagtgcggaaaaatgttgaggacttcgttccaaaggcaatcatgcattttctggtccgtgatcgttgtctcacttttctcattattactcgctttgcataggatggtgatttatttggcacattatttcgattataactaatgtttctggacatgtaacatgactttctatgtactatttttagtgtcatggtaagcatagatgacagtaaacaaatattaagacataacattttttggggcaatgtatcctgtgcacacaagctttccatgtacacaccgtgcacatcaactaacaaatttcaccaaaaaatctagaaaacattgtacatgtacttccaatagcattacagttttaagggtataaatcagtcagaattttgtcttttttggtgctccacatatatataatgaatttgaagatgagactttacacttaaatgtgatactactaaaagtacatgtacaattttttctagaatttttggggaagattgttagttggtgtgtacacgagaaggcttgtgtgcctaggacactttctcaatttttttaccaccattgtcaagcattgcttcttaaaaagcaagtgcaagtggatcactaatttactattagtgtggttgtgtgttttgcttgagtattgattatatttcctcctttttgcgtagcatttttatgttgatgcgactcgttgattttcattgcattggatggatcactaattataaatggttccttattcttttctggccacattagtatattcaaataaatatgcctatatcttctccagttatgattcagtttcatgcatatttctagtggcagggaagctgaccagaaatcctaattatccatgtctgtaaatttcctcttggggttgctgttgcatgttctttaaggatttgtttcgcttgcaggttaaccacacaaaacgggagctgcataattaccttataactaagctttataggtgagggaagccttttctactcatatacattataatgtttcaaacgctggatgtttccctataaatccgttataacatttcaaacgctggatgtttttgtatgtatcgttgcagagacgacctctttgcggacatgctcagagaacccgatgaaataaccataaagaggaggcaaatacgtgacaccctcaaggtccttcagcaagcatacaaggtatgttttgtcagaactaagttttccattttaatagcatttcatactgattgatctaacattaaattatttattggccttgtgacatgcttcagactttggatgagataccacttgaagcggacacagttgagagaggctattccctggatgccgatgcaacaggtctaccaagggctcatgggctttcttcatccttccaagatggaagctcgccatattcgaccccaaagcaaccaaggtcaaggaaatctagccactcaggggagcagctgccattcaatcccgatgcaagcggtaacggattttgatctcgccattcacgaccgtcacccgaacgaaccagtggttgaaccaggcgatgtaccgtggttgcacgcattctgcattcagtttgtttgcaccagatagatgtatgcttttctagttctactactattcttttcactcagtgttgcgccccaatgaagccatgacatggagcgagttttgcccgtttgccccctttgtacagtatatttcgctgcccaatcgtttcatcataaaatgatatatcagtgatgggtatagttttagtttaagcccagggaagagtctatggttgctcggtgttagtatcgagcgtccgaatgcctgtatcctaaaagacggttttgccttgcaaaatctgacaaggttggttggtaaggatacgcaaaacaaatttgtgttgcataaagttggtggtctgtaccagtataagtttggtgatttcagtcgatcactggtgatttgcaaagagaagctctgttcatttatttgttcttttaccatgcaatatcctggaaagttaaaaatgctatttttctttggttgatcatgaaaaatgctatttttctttggttaattatgaggggtttcctcgtactgtggcaatccctcgcgatagtttcacaatgcaataacccgatcataagatgaatacatgtatgtacagtaatctctatatttctgaacaaactagcagaacagctcatattcaatcgagtggtatcgctacgctgcttggagtgtgcatattgagcgcctcactggaatgccccttgtttacacaaagggagtgttcatcttgagctcctcctagcatatgccccctgtttacacaaagttttgagtgctagcaacatcactaataccaatttataggcattttaaggccctaaacaacatgcattaacttcctcatgggtcatgagtataaagatagggtacctgcaaactatcgccttttggtctagttttcatccttcaactttaaaactggacaacttacatccatcaactaccacaactttaaaactccagtttacatcctcactccagtttaaaggtcgttttatcctacttagcatatatgtggcgctgacatgacaatctaattaacaaaatattattttttttcaaaaaaaacactagcctctaaccatgtactacacgggctatttttacgattatattaagattattttttaatcatatgattaatatatggttattttttcaattaaacaaattgctcatatcatttgcatctttttaattatgtatttccaaattcaaaattaaatcaacaaaatactaagttgttcatggtataaatttaggaagaagggagtatgaggctgatataagagatgcattttttaaaagaaaaatgatgacgggagtactggacagatgtgtcacccccatgtcaggcaaaaccgccttcaaacagggacaagggtgtacagtagtactagaaggtattaatagttgaagaa

SEQ ID NO: 13061 - DNA, 20286 bp, Oryza sativa
  unsure (1)..(20286): unsure at all n locations
cggtttcaaagatggaggatgaaaactagaccaatgttcagggatgtttgtaggcatgttgcatgttttggtgaattttcattcgtcctgtcaactaacaacattaattgggaggtttgcaaccttagagatatgaaccttggaccttttctcttctatactatagaagcacagaatggaaggtccagatactgagacaaactaaaccagataattgggcaagttctttgaattacatgaatcttccgggtattaaattgatgcctggttggagggtgttaaattcttcaggacccacgttaattacacaggtaaacgtataccagatcttgtcacttccagccttccagatctagcaaaattgtttctgtaaggttagcttttcgggtgtctacttggctttcttcttcttagctttcttctttttcttttgaactgcttccgattctcgtttgaagattgccagcacttcgatgctgcgtcagtaattccattcaatcaatgtgatcaagggcatatcaagcagataacacaaatcactcatcttgataagtaatgtactaaaaccaagagtggatcaaatggggccaaacaaaaggggcggcatacataaagttctttacgcaagtcattgaatcaagatagcttagggcaggttagttaatagcttatggcaagctaattattttgatcatttaaaccaacttgatgatcagacacagaatgcaaatgagaaatcacaccaattatgtcttgattgctgaaaagaatgtatagtaatgtttcatttcccctatctgagtatcagagtatgccaaacttgaaaataaattcatgttaaaaaaacccaggtgaggtggtgtcaggaaagatttttatgttcctgagatgcctacaacttttaaataccaagggacccctaacagattttcaaaggatcatccttccaaataggatagtccagggaaataatttaaggtttagagcccagaatacctatcagtgccagggaagaaattaaaagcatgagcattctgcaaatgccaagccttactggacatcaagcttttgcagtcctgttgaagaaatggttataaacgacataataatcgcaccaggatagccagcagccaaggtacatattttggagagagctcataattcaggttcggcgaactagctgagtgcgtgatatatatgtactacctccgtcccaaaatataacaacttttggccatttatctggacaaaaatatgtccagatacatagccaaaagttataatttgggatggagggagtaacttttaccttcttaaaactgtcccatccgcagctaatgtatataagagtttctggccacgtttcactacttccttccaatggtgtactatcaacctgaacagctgcctctcttgctcttaggatccatggcctcttctcatctttgacctttgtaagtgtactgtgtccatgtaccaaatatcactatcaataaatttaccataacggacacgaaattctcaaattaagaagactcagatggatcatataataaaagcatgagagcacagaactgggaatgatatttccaactatctctaccttttcgccttatatgccttgcgttcggacaaagcaactttctgtaaagcacagataacagaggggtgcaatcctttcctgggtggatccacaataacaacacttgacccttcgagccaatgaacaggttcctggtatgatgatgaaggttccaaatgaatcctcataatatgagatgtaaccatagtagaaaatacaagtttagttacatacaactgaagcatcagtgttgtgccaagttatggtacaacccaggtttgggggaagtcggcttgctgatttttcaaaagacatttttgacaatttgttaatctcaacacatttcacagacctggaagtaaaaaaaaaatcatgaaatacctgaataaaagaagcatggcacctagaaggctatgctaaaagtaaacatggacacgcacaacccagaaatacctgaataagagaagcatggcacctagaaggctatgctaaaagtaaacatggacacgcacaacccagactgacccaaaaatatttttcaaggcttgagacaactgggctactgaaccaggcccacatgttctaataaatatcttagaatttttttaaaataaatatttctagtgaaaacacatttgtttgaatttcccaggctgagtttggagcttgttttggttgagacagaccaggcacgtaaacctagcattttcaggtcaccccaatataaggtttggtcaggtcaagcagaaacaacacaatatcataaggcaaaatttgctccagaatactctagatttgtaatgaagtgtaaaccatattataataaatccaccgtacctcccttgataccagtactattctactgcatctgacttagtatcctacaaacaagataagttccgcaatccgagctgatgcctccaacagatactaacaaatataatgaacatgaagcaaactcccaactcttgtttgtgaatcaagcaaagcatttaggttatgattttttttcaacatatgaagtataaaccaaatgaggctgttgctctttggtagcctaattgtcaagtaatgaagctatttgacaagccccaaaatgaaatacagggataaactcacctacatttcttcgaagcagcaagagataatccaataacaccagcaccagaatacaggtcaacaactgttgacccacgtggtacatatttgtgcaacgtatgcagtaacgcattaaaagactgaaagacattgcaaagaggtcacagcatttgtaagacattgatggtatggaatttagtataaactaacatagcctgtgaaacttctccgactatatctaaagattcatgcagcaaaaggatatatggagtatgcttgtatacaattgatcactatgtcctagaaagttgaattgtctagaattttggttttatctagtcctttgcatagttaagttctacatgaatcagcgataacttcaatcacacgtaccaaagtattagcctgcccaaagctataaggatccagagaaatatcaactccaccataacgctcccataagtcgttctccccaatgagatgtctccatttatgcccaaaaattatctgcagatgtaagaacatttttcttgaataaaataaatcatatatcctgaaggtaatgttcaattatgtctcttttaacttgtaagccaacagttatagcgtaagaaaagaaaggtgaacatggagaaagccttggatatttttttaaaattctagtccactagaatttttccctggtgtgttgcacaaatgctgacattagcatagtagcttttatatgggggcaggaatacagacatacagttttgcatatgtgcatcctcttgacaacgtggctaccaccagctaatcagagggagctgattgtacatacttgatgaatgtacaagtaagcttattatataagtgccactgttttcatccatatataatggatatgttgagatgttaaaccagtagatctgagcctctaaaagtgaattgtacaatgtccaacttcagataaaacatcaactttttcaagtatccatcatgaaaatggtaaacacagtatgtgcatagccaacaaatgtacaataagttcagttgtatacactaaaatgcaagggtgtatcttacattgctggttgatgtctgaaaattagcccatatagagtgaatcagatgaacattacttcttggtcccccatttctccataagaactgtcgcaaggagcacagagattgaggataaaatgggaaaaagaggagttgaagtactgatagaaaacgtccaaggaaacgcgaaagcaaaatagcagctacatgtgctgtagctgcagaacctcaatttcatcaacttacttctgacaacaagctcaacttctctgcatttttggatcgctcatcccttgaattccaaaccaacgaaacttgaactcttcctggttaagcaaatagcgcatttaaattaatttggaattagtattagacaagaaaagaaacttagagcattcagcgcatgaggaatcaggctaaccttgctcatatcttttagcaactggaatagatgtgttatacgttgtcacagccatctagagaatatgtaaaataaatcaaatgaccaggatcactaacataatgacatgggagtttttgaagaaaaagaatatgattgataaggtgacgtttttagccagaaaaagatgcataagctgtcattcatatagtaatatgtattatgtgcatgctattaagaaacagtttacctgcacatatctcagttcgccggtactcgcatcctcatcaaatggctcaatattcaactcagatatagctaaaagaacatagttactatatattaggtttctttggcaatggaaaggatatttttttttgcatatcccaatgaagcaacaaacaagtaattgtaggaacatgccttgtcttagaagcttgacagtagcattgatgcttgggtgatgagctgaagaaaatgtaaaacaaaaaggattcataaactgtcatgaaaaaataaagcatatcacaatgaagctcaaccagatcattgcagcttcctttgtaagtagttctcttaatttcataggtcatgataactttcttttttgaacgaactggcacaggatgtgccaagttcattgaatataggaggtatgtcgtggtaactaacctctgcactctggaatatctgcaacagcgtgtgtcccttcctgatataggccaatcaacgggttctctggtgttccacgtatagctagctttgcacggcaccgccactccctctaaaagcaccattctcatgtttagtggagaagcaaagccatcataattcttagataacctaaaacatttactgagagatccatacggcaatgtggcttagtacaggatttgcatgccttcagacgtcacagctctaagaagtaacgcatcacatggcatagccacataggccatcaaacaaacatataatcaggttgattgggcatctattagatctctgttactacaattttgcattaaaaaataaacataattagctatacaaaaaacaccgatgctactttcaactaaccatgatctatccctgcacaattgaataagaaattcagctagctagctcgctacatttggatgataaaattttctggtggacgcattgctttgatgtcctcaaaacaccagcatcagtttgccaaacatattcccaaatgaacaaaaccatgcacgactacatatatatccaaaatagctaagctaattaccgaaccgaacctgagatatcgtgagttcatgaccctttaaactaatctcggcaccaggtaagtaaattagacaaccaaacagcacggattgcatacattgggcacggccaaaattgtttagaagctacacgtaccagcctgcctctgctgaaggtgaaatctccaactccgtgacccttgaagaaattctccacctcctgcagcaccggcggcttgtccagatccacctcgtgcgtgcaacccgaacacctgcagagatcgcgcatcagaaaaaaaaaatcaaaaaaatcacttcgccgtctctcacacacgcgcacacgcattcgaggagagagagccgtacgagttgaagtggacgcattcgaggcacgtggaggtggagggggacaaggtgggggtgatgatgggaggcagcgtcgcggtggccgtggttgtgctcggcgcgacgacgacgacgggctcgagccgaggcggtggcggcgggggaggagcgggagggggtggagggcgaacgcgagtgcgaggaggagggcgcgtccgggtcggggcggccaggcgcgcggcggacggcgccggccaggggagcagccccgccggtggaggcattcgccggcggcgaggaaggaggtggatgaggaggcgggaagagggaaatgaaggggataaggcggtgaggaggagagagatttttttcccgctttttgtcggaatataggtcttgttctttttctccaataaaagttgtttggatacatgtggcatattttttaagctgctaaatggtgtgtttcgtgtgaaaactttttacatgaaagttgttataaaatataaggttaatacatttttcaagtttgtaataattaaaactcaattaatcacaagttattaccatctcatttggtgtgaaatacttaatttttatcttcatcttcatctttatcttcagaatattctaacaccaccatatatgtgactgatgaagtctcagtgatgatgacgaggatttttcttttcctccgaaatatggcagtttttgaaatgttttgtttgcaagcgaaaatgcacaagtgagcttcttgttacgggtgtaaactcaattgttttgacttggacaaaaatgggtctcaatccaaatataccgtgtgcactactgaaactggaagtaacaaaaatgggtctcaatagtaattgatctgacaaacagtggcatcaaacaacttgtaaagccgctcaaaaaataaaagttatgcaattccttgccattgccaacatagacggaagttagtttttctatgtctctggattggtgttttacatagttgtcttatttttaatcatattatggtttttttagtttatagtattttatcatgcaaggctgcaacccctgtaatagttgtggctattattaaaaaactagcatcaaaacaaactgcattaggatgggtttaaatttgcccaactgttttctaggccactcatgagaaatctatagattagctttattttaaggaaaaaattctatataaaattacatgttagtttaattcaatcacaaggaaacattccaaaagggatgatctaaccaccctttgaatttttttctctgaaacattttttttcaaccattggatcaaaatctagccatttacattattccccataccactaatagctaggagaaaaataaccacgtgctatcatcgtcgccgccacccgattcacattgcacttagtcttcccatcgcctccacctaggtttacattgctcctatcccctcgccttcactgccgaccgccgcctctcgataactctctccttgtttcctccaccgctaaccacactcctctcctgatccacggcaccacaccatccatgagcctccctctatactcgtaatcttcacccctttcctcttccctccctaatccctctctccatcccaacctcccctccaatctatatcataccttatattctaaatctgtcatatgtcgtcactggagaaacccaagagcttatcgaagtttgttagagatagattgacgaggtgatgcataaatctttgagcaagatctaaaggttagaaaatcatgggttctttgtcttaagaatcattcggatgttttttttaagtaaatcggttgtcaaaatttttctatatgtgcggaagcatcgatggtgtgatgatgcaattgtgggtctagaatttaggggttgtttggttgcttccttgagaatcatgcctaactcaggcatcgatctcagttgttcgattttagtcgcctgcggctggattgatctgtctgagtgagaacgctcaagtgagggcagcaaccaaacatccccttaaatcttgatggatacaaaaaattatgcacacataggtgtcatttttagtaggattttaataagattaaggccgatggtgttagcctctttaaacgtgtgtcaagagtatacttacagctagtgtcagatctaagaattttgttgagactgaacggccatataataagtactcctacagatgaatctatacaagaccattttgaccattaacagtagaaatagtgacagatcaaactcgtgatttaggagcagaaaaacggggaaataacttagatcgataggacgatgcttatgtcttactgatggtcatatgagtgttccaagccatggtgcgggcattaacagttttgcaatttatctcgactaatcttgccaccaccagggtaattaattactattgcaaattgcaatgctgtatatgcacttcattagaaccaacagagagcagtttgctattctactttgcaacttactatatttatcctaaaatataataatatttagctataaatctgattaaatatctgtcgagatttatagctaaaaatatttatatttagggacgacgagtatatactgtatattatagtggatatttgattaaatctcttaaattaagaaacggcccaaaattcaggcccagtaagcgcaaacagtcccagcctgtcagctcttaagtccggctcggtcgaagcgatggagaaagaaagggagccacgaaacgaagctggaagcaagcaagcaggaaggggaggagaatccaatccaatcatgtaagcccgcctaatcgatccttcctaagctgttcctacgcgcatcctgggatttgttccacaaattcttcatctgatcgaacaaatcggagccattaccgatgaattcgcacttttcgtcagttcatgtagctttaggtgtgaaaaatccagcggtgttctttttttgttgaatttgaagcttttgttgcaggtgggcgtcgattaatcggccgccgaccccgaatcgggaggaggatccgcagaaggagctttccctcagagaaatcatcaacgtcaaggtacggcttgctcttcatcctcttgcagaaaccgtgcaggaatctgcgaaacagtggttgtttttttcttttccccttccaatttgctgcggaattgaagttcttgccacttggtgccgaaaaggcggtggactctccggctaccggtgacgtccaatcacccaagaagagggtaatcttcgattagatttgattagggtttggtttagtggatcttttttgggtgggtgcttttttttttaatctttgctgctcttgtgttcgagtgtggtgactgacagtgaggtggtttttttggtttttgtgaagttggtagagagtggggagaaggagaagctgatggagctcctccgggagcggctcgtcgagtgcggctggagggacgagatgaaagctctctgcaggtttggttccttgtcccaccaaattcttgtatcgtttgtgatgagtttctgcttggtgatcctgaattccggcaacgattccgtgcctaagcctctgtgaacaatgatctgtgtcttctgtttcctagtgcgtatagctaccagtttgcttaatgtacaaagcacaagcgtttgtaaggctttaacatgaatgaatgaatgaaggaataattagcttcaacatattgttgtttcagtcaatatctaaaatttctgcaattaatcacttgttttactcggtatgctgtttctgaaacttgcccggaggtttataagtaaaccagacagcatatgggtctttatacatgctttttggctgctcattgaacattatggggggtgcttttaaacttttcctgcagaatgttactttaactgttaggtttccatggtggctaggccatgtagtacatatagtacgattcttcttaaccctagtatgcagtgttgttatagaccattgctagagagattagaaaacccaaagacttagaccacattacagatcgtcgctgacctacacgtgctacctgatgttgtcatgctgagcccattttggaatttgtacacattccacggtttaaaataggtcactaaggtttttcagcatcaaatagattttgtaccatcattggttctatgagctgttttatttctgtagggcctatgcaaggaagaaaggaagaaataatgttacagtagatgatcttattcatgtcattactccaaaaggaagaggtaaagctatttttgtttctccaatttttctcctacaaatgtgtgaggaattctatttactgagtcgacggcacaccaaatggtctgccaaatacaatataaaagtataattatattatagtaacatactaacatagcactgtcacacattttgttttgtcatcttttctcatattttgctaccaaaattggatttgtgagttaaggccaaataaatggatattaccttttaatgcataaatggatttgtgatgttactaagcttacatcctcacctcaatgcctcatatcatctgttcatcactcggttctcaatgtttattgctggtggtattacaaatttacagtactgggtggggaagttctttttttttcctttcaaaatatctatctctcgtattattctcattatctcttgtctctggaacagcatcagtgcctgattctgtgaaggcagagctcctgcaacgcatccaatcctttctcatgtcttcttcctcacttcggtagtccatttgtcgtaatcactggagccgcaggtatgaaggttcgaagctgatcatgtggggaggagctatgcaggaatacaatgcatcctgtaatatcaacaccaaaacgatcgagtgatatttatagtgttgtcgacaatgtttctcttgtcaggcaggcagttgggcctgttctcagtctgtacacctctttaccctgcttagatgtgaaccttgaaaaatgtattttgaatggaagcttccagcttgttatgctgcactgtgttgtgttggctttggttgcccctggatgatcgaaatcataaaaattatatatcttgatagtgttcatgtgtcacatgtcaaacctgattgattaaagtgatcttaaatggtgggccagagagaaatagagtcaatagacaccatgtttttattgtgtttgtgatactcgtgagaggataatgttaggtgcttttgtgtacaggggtcgtatgggctgccatatctgacgggttttttggctgatatccattggtcctttcatccaaacaaaaaacgagcattcaaattcatttttacctagtcgtttttgcagttcgtagccaggtttgcaagcccaaaataacggtgtagaattcgagttttttgcacatatattgcatcgctgacactaaactgatcaagtagtagttagaaatatcagaaatgacgaaggcaacggtgtaatcatccatatcctggggcagttggcttgtcattatcataagctcgatcaaaagcgctgcacaaacacgttggcgccatcaagcagaatgccaacccacacgaatcaggcttcgattcatggcacaaatgccaaatcacaaattctgcaagatgttacgacacacagccacgctgaattgtcaatgaaaggaaaaaaaattaaaagtttgggacaattggtattgggtagagcaatccaattgtctggcgtcaatcaagctatcccaaacaaaaaaggccatcacaatttgccaatcaatcacattgctaacctattgaaaaaagttggcatggtatcccacatgtcacatgcacttcccacagattgattacaaaattgacaactgagaaaattttatatccataaagattcatccagatatgcacaaaatgatcatttcttgagctagatatcctcaccttacagttgatttaacatggatacagcacatgaattctcaagagtgactattcacttgattattacaaggatatagtgctctcaatactagtcttctttacagtgaactcagggccggatcaggtagtatattgtagatacagctcatagaagggaagcagccatgtcaaacagcacaaggcccaggggtcatcttctgcctcctctcatctaagtctagggtatgaacaaaagccggcaagcaacagcgaccggtgtaccacgccttctccttgcgattcttcgcttctctgatcggcgtcggttctgtgctacacgtggagctggactcagatactggcttcacagctgcagaaacaggctggaattgctgcttctcattcttgctgatgtctggaacagatgcatcggtgctatcttcggaaccattctgcatcgcctcctgcaagagctcggctagttttctccttccagttggagaaggttcaggtgatttggaattctgtacattatcaggtacaaagacattgctcataactgtttgtgttctgggttggtagtttggagtgctgccacgagacggagtaaaatctgcacacgaaaaaacatacattacacatgaattgaaaacaatcaaaatcacttggtacagtagaatatctacttgttcattgaacttccagaatgatgcagaagaaatggagtttcttataatttaagtgtatagcaagacttctgaaataaaggaccccatggaataggtaaccgaagttaaaggtggggggtccaatgcagctaacagattattagatgctagaaacatgataatgccaaaagacgaaatcaaaggcctcaaccttttgtctcaacaagcaatcaaagggctaaaataagccccttagaatccagagagacagataaaactgtatcatcaccaaatcaatcagcgcacatgcaatttggactaaacaaaaagaacaggcctcatgctagtatgctactgatacaataataggatagacttgaaaaggaaacagcatgaacaaggcactggcactacagacatgccagtgagaaggaacctatttactctgcatcattagattacctccattcacactgtagaagtcgtcctcgcaatcagaatctaaccatgcccgcgagtcaaagaacatttcatccttgctacctgcaaattaagttctttaagttcctctatccattaaaaactgcatattcaggtcagacaagcatgtgtaaccatggtataaattcgatcaggcttaattaatgaacacacaaattcaacgaagtgcccaattgacaaacaagaacattagaatacacaaaacagtcaacttgcacatctcgtcgatgattggtaacacaaagagcaagcagttgattttggacaaagtaatactagatacaaacacactgcaacccccccccccccccaggctaatcaaatggccatgaagcaagttcctgatttggatgaacctgaatcgaaaaccagcttgtatgaacacttgaacagaggtccgtttcagttaatatcatcaattcctactgaaacaatcagtctgtttgatcttcggaagctattgttaataccaataagcaatctttttattcttcataaactacttttaacaccataaaacttccctttcaaattcttaaatccagacccaaacaataaatcaatcaataaacaaacccaaaaggcctcttttcttcttcttttttttccacagaaagatcagccaagtcatctactcatctccctctttaacctttcaagaatagacttacctagctaagcaaccaaactgatcaatcaaacaaccatctgaaactgaaactcacttcagaaaaagacccaagagagccaagatcaacgaatcctaccagaaccggggctcctgacgccaacccctgccgccgccgcctgctgctgctcctttcgcttgagatcaacagacacaccgccaccgccacccttcccgttcgcggccttcttctccttggtaggcgacgacgcaagaaacagcttcttggggaacccgaggtccttgtgaaccgaagcgcaagaacccatctctctctctctctctcccctccactccactttctctctcctctcacacccaacctttttcaaaccacagcgacacacatctttctctcctcttccccgtgcaagaacgagaaatggaagcaacaaaaggagagagaagagaagagtagagagagagaggagagagttcttgggagaagaggaagaagagggacagaggagaggagagagtgggagagtgtgtttctttactgggagtagcgcgtgggcccgggctgtcatgctctcattttgggccgttgtgggatgtggacgggccccacgggtgtaactagagacggtttttggcttttgcagcattttggggcttttaattccagcggcgtttttggcaagccacatcggatattatatagagtattgtattggtatttgggtactaataaaaaaactaagtacagaatccatcagtaaatcgcgagacgaatttattaagcctgattaatctgttattagcaaatatttacggtagcaccatattgtcaaatcactgagcaattaagcttgaaagattcgtctcgcaaattagtcacaatctgtataattagttattttttagcctatattttaatactttatgcagattgttcaaacgtttaaaattttcctactgccgtgaaatgaaataataatggatgggagagaaagtagtaacagaaatgacttcagaaaaagtttgttgtcctaacctaaaggtgtgttcagtttctgaaaaaagttgaaagtttgaagaaagttggaagtttgaaaaaaagttgcaaatttatatgtgtagaaaaagtttttaatgtgatatgatgtgatggaaagttgggaataggagatctaaacacggactaaaaatcaaatccagatagaactttatgtgttttcatggtgctcaacgatttggtaccattggtgagaaaaaaaattatagctttgtcgtcacggattaaatcgtaaattacaccctctctattttcaaacaattgataatgctgacttgttgtttagttttcaataatatttttttaaatggaccaataggaatataagattataggttcaataaatcgataaacgttaacaatatggtatcttttcaggtattcattcttatttgaaaaaaaatatgagcggtgaaagtttatagataaacaattttcgttaccgctaataaaaaacatggccatgttgaaacttagtactttgaaatgtatagtagttctgtatgacttgaataccaccattgagaaaaaacaataaattgcacaaaacaagttgaaaattccagtggtgaaattggagagtagctagtatacatagacccgaaagtgaagtttataggttttctttctcattataccctgtttaaatggaactaaaactttttaagtccctatcacatcggatgtttggatattaattataaatattaaacgtggactattaataaaaccaatccataatcttggactaatttgcgagatgaatctattaagcctaattaatccatgattagcttatgtgatgctacagtaaacattctctaattgtggattaattaggcttaaaaaatgtgtctcgtaaattagcttttatttatgtaattagttttgtaaatagtctatatttaatactctaaattaatgtctaaatacatagactaaagttaagtccctgatccaaacaccacctaattaatctgctagtcccctctctctcctactcctactaagcaatcggtgacaaggcaaagaatttgacacttgaagtgttggtacgtgtgatagctacggagtacaatgcccaacccccctatgtggctttcatcttggaaaacttggcagagacacgtgtgatttttacgttctgtctagagagctagagattctaacaaataggtagtgagtaaccaattgatgagaataaaaaaactaggtttttagtttctaactattaattcgtttcctaaaatctatagcttataattatttgaacttaggtaaaagaagtatgaatgtttgagttgagctggagattccgaggcaatctacagctgctacaaacttttctaaacaaacaatgtttctctcgttctccacgtacacgctttctaaactgttaaacaatgtttttttaaaaaaatctatataaaagttattttaaatattcatattaattcaattttagtttaaaataactaacacttaattaattatatgctaatggctcacctcgttttatgtatcttctcaattttcttttttcttctccactcaggccttgtttagttcccaaaacaaaaacttttcacccatcatatcgaatgttcggacacatgcatggaatattaaatgtggaaaaaaaaaatcaattacacagtttgtgtgtaaaattgcgagacgaatcttttaagcctaattgcgctatgatttgacaatatggtgctacagtaaacatttgctaatgactgattaattaggcttaataaattcgcctaacaattttctggcggaatctgtaatttgttttgttattagactacgtttaatactttaaatgtgtgtccaaatatccaatatgacaatcaaacttaaattttttttcctaactgaacaaggcctcagacactccatagacgtgtacatgtgttggaccacaagtctctcattctcatatattcttcaatagcagatagcaacatccgttgatagtaagtatgcttccatgctcaattcaaagattcagccatccgtctcgtgtcctcatgtgattttgtcgatcgatgcaagatctttttagaccattcatactattcctagtggaaattgatgtaggctctaatttgtcgtcatcttagcacagttcggaagcgtgcaccttgttttcaatcaaatttacaactactaaatcgcatgacttgatatctgataactaaaagagtaaaatacaccagcggtctttaaacttatcggaaggtttcacttaggtccacgaacttgcaaagcgtacatcaaagtccctaaacttggtttattgtttcatcccggtccaaagccacgtttaaccgtggtcttgcctatgtggcacgccatgtgaacaatgacatggaattttttttctccttttttccttctttttttcaccactgcgacagcccctctcctcgtgccgcctctcaccaccaagaaaaaaaagaaggaagaaagaggaaaaagaaggaagaagggataaaaaaataaaaaaaaattccatatcattgtccacgtggcgtgacacgtaggcaagaccacagtcaaacgcggctttggaccgggatgatacaataaactaagtttagggacctcgatgtgcactttataagttcgtggatctaagtgaaacctcctgacaagtataagaaccgctggtgtattttactctaactaaaatcagtactccttctttcaaaaatactaggacgtattctgaacaagttttgataataaatttctcttacactatttcactttcggttacggaatcatagccataagaaaatgctttcaaactgcatatacactatatttgaacggatgggggtgattaattcagataatatgaatccaacaataataatttctttggtcaaaacctaaacattattatatcaatagccggtcaaaactcaaaattggatagccaaaatacgcgctatatttgaacggatggggtaattccattttacgtatagatcaaaatcataattcattttcaaatagaaatgtactagtatctcgttatactacaatctttgatgaaataactactccctccgtctcataatataagggattttgagtttttgtttgcactgtttgaccattcgtcttatttaaaaaattttagaattattatttattttctttgtgacttattttattatccaaagtactttaagcaatactttttattttttatatttgcataaattttttaaataagacgagtggtcaaacattataaacaaaaacttaaaatcccttatattatgtgacggggggagtactaaggttatatgcctcaatgatagacatgtcgatgtctccaatagtagcaatccattataaatttgactgagtcaataatatcttctttggcgtgttacaacttacatgcccgacaccctcaattggctagtaacgcaatacaatattgctcctgacgattaccttttgtctctacctgaaatttttgtcaaacaacggcgaaaaggtagacgcaacgagatgatgataagaaaaggtgacattattatatattttacattttatatttgtaaattccaataggtggaaaatttttccaatatccatgtaagccactgaaattgatcttcaatgttactctaaaaactcgaatacattctcctgcaagggtaattcatacgtattctttattctcatcgatataagatgccatctggatgaataagaataatttgaaagttatataccattttgcatggatgttatataccatttcaatgactatcagcctcatcgtttgcccttaaaaaatcagccgttatcaatttttaaatattaaaacttcaatttttttaggatattttgaacgtagttttttagcattggcatttaagcaatcaaagaccatatataaagttgaaatttaattttttattactaataaaccgttagtcatatgcttaactcttggccaaatgacgagatcctttagaataacaaaaatcgaagcaactagataacatgcacctgtgttattccagaaaacaccatatataaataattggatggataattaatacgcaacagtacatataatcccagctaagttgttttcagaaggacaataatcgagtatcgatcgtgctctctcgatgtagacataagtaatacgcgtagcaagcacagtgtatgttagtcgttacatacaggccacgtcggcaaggtcaccgagtcgtgacatcaatcaaactggcaaatatatgagaaagatatcaacagatcgagctaatcaaagataatattactctcttagtttcaaaaataaaagtatttttataacacgtatcaaatagtggtcaaattataatactactcccttaatctcaaaatacaagtaattttctcataaacgtctcccttaatctcaaaatacaagtaattttctcataaacgtctgattggtcgaagatatacaatttttttcattagtataaatttaaatcctagaaaatatatatttatatttgggagcacatcgaatggcatctatctgcagcgtacacagcggtgagatcagaaacggtgccatacttcgcatgacacttgcatggccaaattcagatcgacagatacgacctgtcaagctgatggaaaacgaccgcctaaatgttctgaaaaatgcagtgaccgatttagtagtaaaactgaaacaaagatagtagaagtgtaactgatcgtcatgtaaggttcatgaacgagagagacatcgagagaattcatgtcctgcacgtcagggaattgaagtaaacactggaaaccctgcaggcaatgcaacacgaccacgacaacggcttggcggttgaattgtggatgaaccgaagtagaacagtagcttttaatatatttgctaatctccaaataatttaaccgtactggtgtactaagagtagtacttgttagctaaactgaaagtcagcagtactaaccaactactgtgagctggcaataagcatgatacagctaaggtagagccttgaatcaccgggcatttcatttatctctctctccatgttacggatcgggtcattcatgagcaactactgctatgatcctatctcgatctgcaagtgtgccactggtacaggttggttgtggtcaacctgcatttgggtgccattttcctgtgaatcactggatcgtcacccttgtatattataggtaaagagaattgtagatgatcctagttgctgcctgctacttgcaagtcacaacacagcatggtgattgccgacctgaaagtgataggtccccatcgtttgtcttattttctaataagtcaaaacggtttattaggaaataaaaatgaatttgtaggtgaaacttttataaatgtgttcttggtgacttaaaaaccaatgttgaaaaagaaactacattgaaaatatctcaaaatcaatcttaaaattaagcttaaaaattcaaaatttggcttttttttggctgattaggccatccgatgggagccatacttttcagaatctctttttcaaaagaaaaggcttttcagaaaaaaaaaagtacaaaatctctttttcaaaagaaaaggcttttcagaaaaaaaaaatgtactggtacttgtaatatcgatctgaattctgaaacgttgatnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13062 - DNA, 648 bp, Oryza sativa
tgccatggcgctaccggcactgttgtcttcgttgacgaccaagtacctcctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcg

SEQ ID NO: 13063 - DNA, 4344 bp, Oryza sativa
  unsure (1)..(4344): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttaagacggagggagcagtatatattattacagtatcaatttctctcttcagcaatgttcctgaatacatatacataaaaacatcagcccatcgcccatcaataattaacacttactctctctctctcacacacacacacaaaaagaagggcaggggcatatggcctgtacaaacccatctaagcttcaaatcgacaaaacattgtattttggaataagtgtgttttataactctcatctctttctttctcttgattgaatcactctcttaaccataaaatcgagtataacggctccatcatgttcaaaaaccggtgtaaatctactcctgcaatgttttagaaaatgatttttgttgatgtaacagtatgatcacgactgacttattcagttagcagatataacccacatgtcaacaacattttcatcatctcatctttttcctcacctctccctctccctccctcccacttttttgtaggcgtccaaagtcacgcgactaactggctattggctagtattcctgcatacttgtacttctcaaacattagccactacaattcaacactttttttataggagcaattcaaaccctcacacacatgcaaataataactagatgatgtcccgtgcttttgctacggatatatgttacatattggagaaatgataacatgatttagattgaaatattataacaatgatttgataatgatgatttagcatgtgtttgtttagttttagaataaaataatttataggcataattactatatgtttaaatgttgagctttatatgttcgatgggttgatgtggtatgcttacatggagatactagtagtgctagtaagtaaatattatgcttgtatttaagctttagatgtttagtggagagattcagcccttctacatcctacaataaggctgcaagccatgggccatggcccgtacacgcccaactttaggcccgaattcgcattcgatccgctaataacaatccagtagcaccgcgaactgtcatccgttagcaaacttcccttgatcccaacaaatttcgctcgaaaacactactctcttgtacactgcaggttgttcgcttcagagtttcagagcgtgtcgcgtgcaaccgtgcagtgaagctctccgtccccgaccgtctccgattttccagccgctttcgcgatctcctctcatccccctgttataaagccccactaccctccagacacgcctagcctctcatcgtctcgatcgatctctcacacgcgcgcgcctccattgttctcggatcaacaagctctccaagaacagcagcaaagatgaagccttcgtcttcctccgtcggcgtctgtaccctgctggtggcggtggcctccctgcagctcctcctcgtcgtcgccgtcgccgcctcggcgaagactgcaccggcgatgccagacgaggagttcttgggccgtctctgcgaccagcagcagggggccacgcggcggcggctcccgtggtgccagcagctgcacgcgaggcggcgccacggcggtggcggcggcggcgtcggcgtcggcaagcggcggcgggtgccgatgccgccgcccagccgcgccggcgaggagatcgacgcgcgctacgacgtgtccaagcgggtcgtgccgagcggaccgaacccgctgcacaactagactgatcgatcgatcgtgtatctgccgcttgcattgcatgcgggcgtgcgtcctcattgatctttcttcccgttgcgcgggggcggctgatcggcggctgggcgcgcgcccgcggtcagtccgcccctatagtactactgtactactactatactagcactactatactactatacctactactattcctacatacaataaatgaatgtatacacatacgaataaacataaaaatttattcatatgcatacattttttacctatataaaaactacatacatgtatatgtggtatacgtatatacaatttaactttgtatacgtgtatacaaactttatatacgcatacgtatacaaagtttgtttttttttttgacaaattgatccttgtagaaaacttatttcgaaattagtctttgccaaaaactatatccagatataggctgttggctcagcgccaaagttgttagcgctgaggttgttcctgtcagcgtcaacaggactggcgctggtattgcgccagcgtggcgggcgaggagcgacgtggcatggcaccaacgcaaatgtatttggcgctgaccccttatacatggtaaacagactgatgtcttgtaatgaattagttatgtactgctgcaatggtaagttcctttgcctggtgtaccttaggactagggttcgaatcccaggtcagccattttcgttttttttccttgttttttttcttcaaatcttcaatctccgtgcgtacatataaatgattaatgatgatttctgtttttgaaaaaaatatatacggtactaatcaccctattacccaccaaactgaaagaaaacatcggccaacgaacaaaattaatggaaaaaatgttgatatgtcaaggatttgaacccataatgtacggcatacaagtcaaaacattaaaagaaataacacattttttgtttaaattaatttttattaaaaagaaatatcacattcagtacagatttaaaaagtagaagaatggattaaaaaagtttagagtcaaattttaaaagaaatatcattttttataaaaaagaaattagaagaatggaaaaatctcacctttctagagcaatattgctagaggtgctaggaagtcgacgaaagccgctggaggcgatcccgcgtcgctcgtgatagcaattgcaacatgcctgcatcgggagcatcgcgtgcagcagctcgctataggcccgcggtgggagcagcagcaagctagcaagttggtagggttgtagcaagagcagcaacaatggtggacggaggaggtaccaccaattagggttggggggaaggggtcagcaatttctgaatcaccatgtaggatggcctattctaccaatttttggaaaaatccatcttctaatcgtgttattcctggccttgaatccaatggcaagtattatggatttacgggtgccaacagttttgatggtaagcatgtaattacgttttttaagttgtaaatttaataaaataccggttcaaaacagttacaaatagagattacctatacatttttcgaaagatttttatgatcgtatcacatagatttttaatctttgaattaaaatccaatagatataataaaaagcaaaaagcaattaagaaacactataatggacactaaattaccatatcctcaagcaaaagaccaaatccaatacaaaatttaaaatttacatgcgaagatttaaaaattacagtgtaacttacaaaagttacagtgtaactttcataaattacactgtaacttacaagaaaatgcaccgtaaatttgagtgagaaaatcgagtaagagataagaaaaaaatctttcgagtgagatatagcaaaatcgttacaaatatgcagttggcctttttttggaagagaaatgtcatcgagcccaatgggccatctatcaatggaggctaagtacgtactcaggcccaccgagaagaggagtactggcccatttcttgcggcgcaggcctccgtgttgcagtttatgggcccacccaccacgttcctcccttcttcctctccaagtccaagacgagactggaagccgcagaggagggagggagagagcccttggcggctcgcggcgccgcaccacaccaccaccaaaacacgcacgcaccgaacgcttcgatggggcggctgcgcgcgtgcacccgcctccgtcgcctcctcgcgacgaggcctcctcatccggctccgccgccgccgccgccgaggacgacgacgacgggccagactctcccgtgcttctccgctagggccttctcgtcggcctcggcggtcgccgtcgcggtgccgcacgaggcgcgcgactccggcctcgggagctcggcctactgggcctggatccgggcggcggccgagtcggccccggccccgcctccgcagcaagaggaggaggatgagggcctcgcgcgctgcatccccgtcaaggcgtacttcctctccaccaggtacgttggaagcatatgcgcgtgcttgcacgacaggtgtttgttgattttttttttcaaaggtgtatgttgatatcatattgtg

SEQ ID NO: 13064 - DNA, 3121 bp, Oryza sativa
atggttagtgattccaatttaccatcacatagttcctggtccaaatgcttttgaatcaacaaatttaagttattaactccaccttggtaatttgttgaacgcaattttgtgaaatctctctttttctgcactgcaaaatttaacttctctgcaatgattggctaacatttctgtaggacattggagttaaggacaacagattttgctatcgctatgtggttgtgttccaatatggttcggctgtgcttttcaacattgctgaccatgaggctgagcactatcttgatatcatcaggaaacatgcttcaggatggcttccggagatgagaaaagatggtattacacatgctattcactatcttgcttgtcatattttaccttgtgaacaaagacattttactcggtacttctagttttcttcacactgttccattatattgtgtgtacgactagcatataattcaattgccttctatgttagtgaaaattacattttgataaaatcccatagaactacaagagagtccatatgcatctgattgatattggacgtgatgcattcataggctggtaatatgtgaagtcatttagagttgagtagctccccttctaccccctaaacagttgcaaaagcttttctttcactgggacaaaactggctcatttgcaaagtagtgaagtagcgtgtaaggttaagaatttaagattgtattacatcctcacatgatatcaattctacaatgaccagattatgcagtagttgagaagccctccctgacaacatggatgaaaggaggtcttgactatatagttcttaaaagcctagatacagatggaattcgcatcattgcaagtgttcttggccaaagtattgctcttgatcattacatacggcaggtactgaaaaggggcaacttcgacaagctttttccatgtggtggtagccttgaaattttgttcttaaggttctaaaaaacactaattttggtaggtcgatgacatggttgaggaatttactgaaattaatcgtgtcatggagaagactgggaactttaccatgcaaagaaagaagctgttccaacttgttggcaaggctaattctaaccttgctgatgttatcatcagacttggcctttttgacaggtatctcttctacaatctaagtaccacattccctttttagatggttcatgtcttccgttgcaattgcataatttcctctcttttttatcatgtatggaagtaatctcattgtataccaatcctacgtgcattgtgacaagctatgctgtgggggaaggaggcatgtagtttgatattcttttctggtgtgtttaaaaggttaatgcattttagctctgaactgtaaaattggagtttacatgccacagttctgtgttataaaagcactttgttcattatacaaatgttatgttattgttttccctgatgctttgcattaaccctagctctgcaaatgccattttacttaaggaagcatactcatttgccatttaagtaagggaataattgaaggaaaggaagaattatatggcttctataacataaattatttatattccgagtgaaggtggcattttttgtcggaagtctcattagttaatgctgatttgccataatactccaccttttaataaaattcctctttccatatcatgcttagcttatgaaaattgcaaaacattttggtgtcctcaactggctgtttccagttgtaaggcttggaatttgccaactatccacatggtttgataagaacccaagactaccatgacaaaaaaatatggataaaagctgatctaaagggaattttacgacatcgtggatacggtctccttgcgtatcttatggcagccccttaaaagaatgactttttcttcaggtctgaaatcgcttggaaaaattcaaattatgctcaaatacttgagtatcttcgggaagaatatgagctgaaccaacgttttggaagcctcgacttcaaattgaaatttgtggaggtaagttcttcgatttgtgttcattttcagtgtattagctgatttttttaaaaaattttgagttcccattcgtgcttacactttattattgcaacagcacaacattcattttcttcaagaagttctccagaatagaagatcagatttgctggagtggggtgtcattatactgctgattatcgagattgtcatctcattatacgaaattatcaaggattccagcatgatgtcctgagagcacactatccaacatctttgacagccatccacccacatcaccctactgttatgctaacccacactctacttcccacaattgatgctaaccttagttgaaaggaagtaaaagctccctttcatagctttacttttgtgttatactgcctgggatgcatttttgttagtttatttattctgctggttccaagtatacctcacagctaacaagagcagttaattctttctccaaatcccaggaattcagttccccaggtttctacgggaagagttttggttttcctctttatgcatttcaacagatgttcttggtacatgccccatttgctgataccactgctgtcagggtttacttactcctgtaggacctatgttggtcccaaactcccaattttgtggtaagacatgagaccagcaggctgccggctattagaagggatgtaaaaatgatgcgaaaacgtcaaatatttaatggcatatcctctgtactataagcgtccctactactatatttgtctttgtattgatatttagcgagatgctatgatctctggttaaaccactcttcttaaattacctgtgctcaaggatctttgtagtttgtacaacccaggcgatacacagaagtgcttcagttctctcccactaaagactgcatgaatcctaaatcactactccctctgttgaacataacctactactattattatatgaaattctatgaatttggagactcccaaatatggcaacttatcgtatcctagttgtagaatatgttcaattcaggattaggttgctatagttttggatgaaggaataatagttttcaagttcaacatgctggagccctacccattttcaggagt

SEQ ID NO: 13065 - DNA, 522 bp, Oryza sativa
ccaggaagtccgtgggaaaatactaccccaaatccatccttcagtcacgcttctcctcgaatgatgcctggaagtagcttccgtatgaatccacctgctcctcttccttttataccatcttctgttacccctcttacacagtttcctggaggttcagcacagcagtctgagaaaaggccacctccacctccacctccaccaaatgtagcccccccaccatttactcgtcaagatataccacccccaccaccatctccaccaccactacctattactcagccaccttctgtgccaccacccccaaattcccctcctccgcttcaacctgctactgacccttctgactcacaaaagcaacgttctcatcctcgatggcagggctctctttcaaaaagtggtttacattactgttcaatctatgcaagtagaatagagttggatgcttgtagatatgaacatgcagtttctgaaccgacagggtaagagatacatcaatccagcctacacattctattattacaa

SEQ ID NO: 13066 - DNA, 23227 bp, Oryza sativa
attcctgcagcccctgcaccatgagaacatttctacattttgtccttgatatatatgaatttaggtgccaggatcctcagcattgatgcttgttaatttggcacaagttcattgcataagggatctccattttatcatcttggttttatttgagatgattgagctaaaattaagtaataagtgaatattttatacctggatgtaagggaataactattttgagattttttttaataaatgcagtgctaatacttctatgttgtttttaaattgaaattcttgatatttaattcagctaatggtgcatggtcatatctctgaacttgaaatctggcaaatagcatcttttgctatttagttcagttcactatgtatgcatgaaaagcagcagatcgttaggaatgggatggtgctactagaagttaccccctattaagccataagccgtgagcagctaatttatagccgattgtgcggtcaatgatgataagccacttgtaggttagcatggctatgtttcagatgtggaagttgatatgtcaatgaattttctttggagtacaatttaagtacttgctcattgtggggcaaatgcgtccatataacgatttatctagattaaacagaaaggtttttaatatattaagagtaaatttcacattgggcgacatattttgaccaaaatttcataatggactaaggttaaatcattgttttcacttaacaccatacatcttacataagttttcagtttggactaggggtgagcaaagcaagggaatgtgaaaaaacttcatatgatttacacatggataattataaaaggcaaaacattttatgttttcttccttatttttagtgtgagtggtaattaactcttttctagtattttatttttattcatttgcccctatgtatatatcattttgtgccacttttaaacatgtttgcatcattattttagtgtgatttgctgaacaaagttgttttgtgattttctatttctttctaaagatatttatcttaatactatggaactaaaaatgatgatttgaactagcttttctctgacaacttccattgatttgctcaaccctagtccaaagtgccaactagtgcaaagatatgtggtgctaagtgaaaaggttgggttggcccttgcccattgtgaaactttggtcaaaacatatggtgcagtgtgaaatttactcatatattaatgatggggctgatgtatttcagtgtggtgcagagagaaaatctcgagctacttttatctatcgcatctcgcaggggaataatgtttactgtttgttatttcactttgcagagagaggtctgtcggctattaccctgttcgaatggtgatcagaaaggggtatgattttattatatacactgccaaccccactacctgaatatctatttttatatgaaaccacattaacccttcactacttatgtgtgtttatcttgcagttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtcgcgtagacacattccgtaacctcgttgcttccagtttcgtgcacagtaaacaattttgcatgaatgatactaagttcctacagctgcttatgaataatatgcttccagtttcgtgcacagttaacaaattttcatgttttcttttgacgagacaccaatactgtacttattccttttgctgcataactgatatatagttgctacaatatcacagaattgaccggtgatccggaatttttacacgcaaagatcactacagggacatgatctgacgaaccgctccgtgttctcttcgctgcttacttcaccacatcggaatctaggtcgaggacgaaggattggtgacttgcccggcgaagaccaccacgccggtgaggtcctccttgatcaggaacatgaaggggtggtcggcgacgaagtccacgacgtgaaccggcgccgatggcgccgcgcagccaagggtcatgacgacggcggtcgccgccgccgcctcggtgccttcctcgttcacctcgacgaaggactcgtggtagacggccgacacgacgatcttctccgcctccggcgatgactccaccatctccgacaggtcggcgccggggtactcgaacggcaggcgcagcccgagctgtcgcagcgtctccgccgcgttcgtcttgtacgacagggtgaacctcggcaccatgaaggcgcccacggggaccttctccgtcagggcggcggagctctcgatcagcgccgccgggtcggagcacagcttgcgcagcatgtcaggcaggccgtggcgctcgtcggggaggtagatgtacatcgagaagaggcggccggtgtcgcggccgcggccgcggccgccgcgcgcgtacgggagcctgaggaccttgtagccggcgcggcaggcgatgtactgccacttgccgctcgacatgaacggcgcggagacatggccgccgtcggggaggtagaagacgtcgtcgctcgtggaccgggcgtcgaacttgctttcccagtcgcccttgaagtagagcgcgttgccgaggacggccggcgtcgcgcggtccacggcgtctttgggcaggaagtccttgatccggccggccgtcgcgctctcgaaccactcgttgatctctcgcctcgcttcctctagctgtacgtgcatccatcgaccaagagagattatatcgtaatttttgcggcaagaaccaaaatatttcgatggatggatgaatcacatggagatggaggagaggtttgttagtcaggcgcgggggctcaccttgtctcggaaggacaccgggcgcgcctccgcgcggtacttgtcggcgacgacgcgcgcgtacgcggccttgaggcggagcgcggcgtcgacccagacgccgttggcgaaccgcaccttgggcccgccgcggtcatcgccggggccgctgtcgtcggcgagggagcacagcgcgacgtgggacgcgagcgccgcgtgggcggggccacccgcggggccgaggaaggcgatgatctggtcgagcgtttcgccgcgggcccccgcgccgaggagcgccagcgccgcgtggagcgagagcggggagacggccaggtttttgtcgccgccgccgccgcgtggggcgcgcgcgaggtggccgagcaggcgcatggccatggctgtctcgtcccggacggcctccgcgagctccatggctgagcggcctctcgagacggtggggtttttcttggatttttggttgttgttgttgttgtgtgtgtgtgtgtttgcgttgcggcgggtgtttttttctctcttttgtaccgtggaatggtgggattgggattcggttacattccccgtgacatgtccccagtccggaatggtgagtgtgttgggcgcgggaggttgtgccgcgtcgcgtggatgggacgcttcgggataatgttgttgccaattccagggttccacttccacatacggctgtgtttttttagagagaacagtgtacaggtggttttggactaggtccctcgcattgacatgaaaattgaaataaaatccgtgggctgtgaagatatggttagttatactcccagtccgctctaatccatagagttagccatacctactacactaataaatacccaggtaaacagtaataatcctttgttactggtacatcaatcgactgaccaactcttctcaaagtctttacacggcgcattaagcgatcagcagattcagaagcatattgattgactcaattaggtaaaccaggacacaaccatatatccaatacatccatcagttacaggtttttaccgtcaggagtagaaaatgagtagtacatgaacatcaaagcatcatgaatatagcgaatgagattccgcgggtactttgagagaagaggactaaatgagttattactgcagtcttgtacgtcaactaacttgcgaagtgctacagaagaaaagctaacttgcttgggtaacagccaggagttgtagtcccgaaactctctccactccacagtaaggatcagcatctgttgacagtgttaatgtgtcattctggctcaaggagaagtcacccggttaaggagacgatttgagcgtctcaatggagttggcgtggtaacatccttcttctccacctttgcagcattttcctgatgcagaaaacaaaaggaagtgaataagtagcactgctacccacagctcgatattgtgtactaaaacaaatgcttgaccattatggaaacatattaatgtcagcagtatgatgataaaagacttatctaagcatctgaacactatgtgtagcctgtaggtgtaaagataagtgtttgaggacactgaattttacctcctttttcgtttttcgagcactagggcttttaattgctgtagtttccttctgcatcttcaccacatcttttctcagagttactgatggttcctgaactgcaacatccccagcatgttcatttgatcctttccgggagcttcctcttgagctacttgcatccacaagtgagaactccccaagcaatgccaccactggaggtctcgagctgtcaatgtctctacggccaacagaatagctgtctggaatcctagcactgccagcatcatcttggtgaactttctgaggacgattcccggaatcaatctgcttgggcagtggaaattgcacagcattattgaggttgacagatgacactggtatgggctctggcaatggcacctgttccctgaagctggcaaataggtcaggcttgtgcaaaggtgatagtgtagggatcttcaaattgacaggcggttctactttgggaactgtcagttgcacaggttgtagcacagattgtggtgaagggagcactggcaatcttggatttggagctaaaggggattgttcaagcctacgtgttgacactgatgcacccttaggagacctctggaaacacttgagcatagcagctgcaattgcaaatgctgcaacagaaaagcacgccaagatctccatcaagtgaagttttattgaaggccacagtgattttaccatagctactattgcctttgcagctgcagctggattctcatactccaatagctcggttgcctgatccaatctgtcattttccaggccctctccatcataccctacctcgttgttttcttgttctattgtcttctccatggaggccaactgctgggagtgttgcgagtgatcctcccctgcctcctcctgatgaactaaccctgactctccctccaccatatcagcggtgtaggttgaaccaatggaatctgcagtgacattttcattcaggcttacaacttcacccaattgctcggcattctcagaggttgcaaccatcaattcactcagttgaaaatcttccttggaattctgcacatcctccacggctctgtccccaatttggcatgtaaattctccgaatggaacatttgggcatgaatctgccaaacccatcgcagcaatcgccatgaagtttttacgagaaccacccatggggccatacagttgggctgcattttcactgccgttgggcacagtttgatctgtagcttcttcaaacacatgatgtgaacccatcatctcagttggtgctcgcaactccagagaacctacttgatgagcgctagcatcatgcacgctcccagttgttccagcaaaatcgagccccatttgtgaggtaggaaagggagaggagctcatacaatagatgtagcagcaagagcaggccgcggcgacgagcagaagaagcagccgccgtgcccacccaccacgaggagacggaatctcaatctcctcctcctcggcgtcggcgcggtcgagaccacgaggagacggaatctcaatctcctcctccttggcgtcggcgcggtcgagttcggcttcgccgcctctcaccgacgacccggaggacacgcactccgagggggtgggggtgggggtggccgaggtggcactggacgactcgtcctccgcctcgcgctccagccggaggaggatctcgcggcgcttctcggggttgtagcgcaggaactccggccgcggcgtggtgtagttcgtcttcgggtcgtacggcccctcgccgcggcaggagagcgacggcgggctcgtcgcgggcttcgcctgggagaagaactgcggcggcgacgcggcctccccgctcccgtcgcctccgccgttcctctcacccagcaccttcttcctctccagagacgcggtccactccgccacggcaccgagacgccccggattctcgctccacgccctcacgttctcgtccgcctccgcgtcccttcgcctcgtcgccatgggacttcctcgcggggaacctgcacacggcgcgtaaaagcggattgagcgacgaagcaaccgaaaattgaggggaattatacgcggagaggagacttagattagattagatccgggcggcagcacccactcaccatgcggaagaactcgcttgggcaaatccatggcggcgagggggttgatttgatggttcggagcggcggcgggtgtcgattcgggggggtgggatgatggggagatgggaagagacggtggcttggggatttgaaccggtttggatcttgccgaccgttggagccggcgatgcggtttttatacgcgcgccgtgtgacactcgtcatgagtccggacgacggtcgagccgcacgtgttgtgtcgtgcaagtagccgagtaggagtacactcttgtcttcggagaattgcagagaaattgctcagaaacacaaggattctattaggagaagtttgcactgtttacatctcatcctaaaatttttcaccctatcatatcaaacatttgaacacctttataaaatattaaatataggcttaaaaataactaattatacaaattgcgactaatttgtgatacaaatcttttaagtctaattgctccatgatttgataatgtagcactacagtaaacattttctaatgatggattaattaggcttaataaatttgtctcacgatttactgacggattctgtaattagttttttttaatgtccaaacaccccatgcaacaccctatataaaactcaatgtgacacgctaaaactttataccccttatctaaacaccccttactcctactttatccttcctaaaataaataaacatttttttacaacagctaaacatccattacctacctttagaaaccaagccttcccaaaataaataaacatttttttttacaacagctaaacccaaggcaacagtacacacgctgatttaagtaaaagaaaaatagtacacacgctgatttaagttaaaaaaaacactacacacgctggggttagcagctaaccagcaagtctcatggcctgtttagatactctaaaatagtaaaacttttgatattttagagttctttttgtcattttagatctaaacactaacagcaaaaggtggcaatttgatatttggcatttgctagttcatggtagcaaattttgctaaaaagtgctctgggaccacaccctctctctttttctctctctttagtgctaaaatgacaactttaagatgcatttaaacactaactagtatttttgcaatgccaattttgttgtcaccaaaacttttgccatttgctatttcccattccaggccctcacaaaaaaaaaagggagctcctcccccaccaaagtttatatcatataacaacctagtagggagtatatctgttcacaacatcgacacaacctcaaacccagcctatagcttttaaggcatggccaacgcaagggatacgctcaagtagatggggcaacacccccccaaaaagctaattaatttcccacggtgcaagttgcttcatgtggtagtctcgttttttatttcagcccctagtgtttttcactttagtactcacaattttccaatttactagcaatgatgcacgtgcgttgcaatgggtaaaggtaattttaatcatgtatactggtggaacaaaaataaaggaatcataatcataataataatattaataaaataaaattgcagtgacctttggtcaaaaagataaaaatatataattaattttctattaattccattagcaaaaaataatataatacgaagtaggaaaagttattctcaaattttagcaattttcaaaaggcttaaatagagcaaactaattatataaatgaaaacaaatttaatcacctaaataaaacaattagacctgtaattgaaaatctgttgccagttcagttaaacatgagcctgcgggtgtgtgtgatatatatctctcactcgtatgtcgtgatcttttttttttgacatagaaaaaatgcacgtgcgttgcgatgggtaattaaaattataagaaatataaaaatattatatgattaaggtttagttttacatgatatgagctctttaagaaaatatatttataatgaaataaaaaagttcaactgaagtgacctaaagtgaacttgttttatacggagcgtacacgtggtccatgaggcggcccaatagtgtgggtggcctgggaatagaatcgggtaggaacaacttaaatgacataaagtgaacttattccgtgtgggcggcctgggaatggcgttcggcctgacacgagagaagctagagccgtccgatctgatagacggtcatcccgacctatataaaagttcaacagcccaaaccctaaccctaaaacatttcccctcccccctctctcaaaacaatgtggtggcggcccgacatccgacatccctgcgacggcggtggcggttcagcagcgacgacgacaccctccccttccggtgtcggcgttttcttggtgttcttgaatctgatcttgtattcttgtagtagtgttttctttagaatttaggtccaaatttgatacggtgtctcatttttttctttcttttctttttttattttttgccatcggagagggattaaagcggaatcgatcgcacgtgcgatggaatttttttatggatgaaaactataacccataagccatacaaatttttttaattaggaatatatagatattgaatcggactttcttttttttttcattttttcgcccttttttcgttactacggatgtcaaaaacgtctttaattttttttaccgcgtcacatataatcagattcgatttttttcgcccgatttctttttcacgcttttttttcacggatggacgatggaaatactttttaatttttaagtagtagatatagagatacagatagagatagagagagaaacggaaaacttttttcgcaacttttttttttggaatcggacaaaaaaaattttacgcttgttttttaccgcgtcgatggaatcggattcgatttgtttttttaccacgccatgtcacatataataggattcgattttctttggaatcggacatgtactttttttttttgacccttttctttaccgcgtcgacagagtcggattcatttaattttttttccttttttcacccttttttaccgtgtagaccgagtcagattcgtttctttttttttcctttttttcgtccctactttttttttgatcggactcattttttttcccttctttcgccctttttatcggacatgtttggtttttttttcacacggtttttttcgcccgcggatttttttcgtccgttttttttatcggacatagtttttttggtccggtttttttcgcacggtttttttctcccatggtttttttacagacgatggaagcaactcttattttttaagtaaaaaaaatagagatatagaagtttaaattttacgctaaacacctaaaaatacagaaattaatataaaatctctcctccctccccctttttcccaccaacaccccaaaatcccctctccccacgccgtcctacttcaccattcgagctccgccgagctcctccaccctcttccctctgctcgagctctcctcctcggcggcatcgcggcctctcctctcttcttccctccccgacggcgactctcctctccctctccatcttcttctcggggtaggagcaacaacgacgcggggcaacggcttggggtgaggcatctccccaacgcggctccttgcccgttcctcgcccaaaaacaacgataagctgatgaaactacctggccctctactgcgtgtcgcggcactctgccaaggtgtggtatcgatcaagctggcgtgaatattcgtctcaggaaggatgagaccacgctccatgctggagcgttggctatgacctcagaaagaatgttgtcggttttgtaaaccctgactaatgaccttagctcaaccagggcacccgtaccctctgcaagacactaagtagcctcacgaaagcacgacctcgactaaggcgaagtcacggactcttggcatggcgagccaaagcaactcgtggcatcggtgcaccgatcagtggaagaagacaaaacagatactgcccctagctagaggtacaagggaattttttttactagtactcatgctggcttcgtgttaaacaaagcacagctaaattgctaaggcgtcccgcgttcgtgcaccatatacatagatcgaccgatcgaagcagacaaccgtacgacgccgcgccgcgcgcggcgtgcacgcacgcacgcacgcacgcacatcgatacgatcacgcgaccaaaacacacactccatctcacatagtcacagccggcctcccacaacccgcacgaacacgtacacaacagcacacacacgaacagacacgatcgaacccgcggaggcaaatttcctcgtgacgacgcggcgacggacggcgcgcgcggaacacgcacgcacggcggagctatagcttagtcttggctcatcatgcggtggaagtcgtggaagtcgagctcgccgtcgccgtcgtcgtcgtaggcgcttatcatggcctcgcactcggcgacggacgcctcgtcgccgagctggctgagcacgcgctgcagcccgcgcggcgtgatcctcccggaccccttcaccgcctcgaacgccccgaacgcgcgccgcaggtcctcccgctcctcctcctccccgcccttccgctccacgatccgcacgaagtcctcgaacgccagcatcagcccgccaccgccgccgccgctctcgccgccgcccgccgcgccgtcgagccccatcgccgcggcggcggcggcggcggcgccggagtcgtcgcccatggacgcgaagaactcgcggagctcgtcgccggagatccgcccgtccatgtcgcggtcgaagtggccgaagatctcccggagctccgccaggcggtcgcgctccctcccccgggacgtccccgccgacgacgacgccgacgaggagaacgacctcgcgccgacgcccgtgggggactccggcggcgagacggccgtggccttgcactgcccgcacgccagcaggctgggcaggctcagcttgaagctccccttcggcgacaggcgcctcgacggcttggagacctcgacgcccgccattagcaagagagagctggatttatgcgaagctagctaagctttcacttacttaggattcccgagcttagctagtgaggaggcagcgtgagtgtgcgagcgtatatatagcggaggaaggcgcgagactcgcaatgcgaagtgctgtattttacggcggccggcagcacgcagcaggggaagtttcaccctactttttctgttttttcttgctttccgtcagaaggatcgaccgatccaatggcccatcagtccatgcatgtttggcgagttagtcaccaatggtcactagcaggtaacagccagaaaagtttgtttgttttccgctctttttaatgagaaatgactcgttctaaataacagaaagtgattgaggttccgaatgaagtgacaatcactagctagaaatcaaaccagaataaccatacgtagaagcataaatatgtgttctttctagaagtatcattatgtgttctttctttgagaaactagctgcgttgcaacggatatttttaaagataaaagtaaaagcaaaaattacaggtttatagtatagttagttaattaggcatataatttcatcttcacaagcaaccctacggaaatatactgctagatcacctctttttatctatttccacaagttatacgtacggtcggataatacaagattagaagcttataattcatctgtagatgaaaggtgaatttaaaggttttgtatgtaaccccttataatttcttgaattaataattctagagtcattgacatgttgtgggtaccttatgtttatgatagctagtttgagtttctggtgttggtgtagacttggacaccaccactaacatcatttaaaatagtatagatatgaaccatggcaagttattactaacttattaggttggaagttctcatggtgcatttcttggaagaccatttgcttcgtggggaactggtttcccccccccccccctaaagatatgtccttatgtttatttttgtttgtaactcccaaatacctataacaaaatcttaaaaatgataatattgatgcattaatgaactatcacccccaaaagaataacttaaaattttcttcataggatgagaggagaaacaatctacacattgagtagtagaagtattattcattcgttattttcttcctcgcaaacaaaagattttttttagcatgcagatcgaatttaaacttgcatattgataaagtgatactccctccgtttcatattataagacttcctagcattatccacattcatatagatgttaatgaatataaacacatatgtatgtctagattcattaatatatatatgaatatgggcaatgctagaaagtcttataatatgaaacggaggaaatacatcgcacaattatctatgttattattttctaaaccatataaatgacatacaaataatgtgtgtatatcccctcataaattaactctcccatttatgcagataatgaattgtttctgtggtttcggcatctccggtgggcagcatgtgttcctaacatttgcaacagagagtgcttagcatagtatgtggagttgtggacatttggagtacactaacatatatagatatacacgcgtaagataccaatcagacaaaaccacaaaatactgcgctcgagtgctggttcgatcagacacccctgaaacatcgaggacaccgctgtaagtggtgtgatgctcatgcaagacgcaagccgtgaatacaagaggaatcatgcatggatattacgtgattattcctcgtataactatccctctccaatacagagctgcaattcgaaaggcggccggcctcctataccaaattgctgccgtgattaattatttacttcctaaatctcgcaaaatcccaatcagatatcgccacaaggtcgatggcacaaagcagccgcccacgcgctcaatttacctgatcctcgcacgcatgcatgtacatgttgccgatcaaatggccacatgtttatcgcaattgaccatgcacgcatacgttggctgcgtttgttcccatctgtcaggtggatgcgcagcaatcacacaacactcgtacccaaccttttttttcgttttttctgaatgatcaatcgcaagttgcatgcgtcgccggggggcgggttcaccaccgatctcacaattctcacctgaaccactactcgcggcggccggaaaggcgagcagaggcccgagggagataacgtcaggtgttcggtcaggccgtgcaggaggaaggcgagaggaagcttcctccgctagcaaaagaggaggggagagacgactcatgggctcatggcacgggcaacgcccacaaaaaaattgcgatcccgcagctcgtagttgcatatactcttgcatagttgcatgcgtggttggttaaatttactggtgacgtgcatatagctttacgatgtgccggaagataaggttgtaaaatttgtcactgatcgcaccgtgataggtgctgctctagatatttactagtaccagtttatcacattaattatagagtgtatatatatagaccatgttgcacacttgcacttaattctttgacgttagtcatagagtatatgtatatatcgaacagtgtccattgacgtacgtttcttttctatttttgtattttgcggggaacacttgcacttaatttggcttctaagtaccactcgaggggtttagaaacgtcaatggacactgttcgcctaatcgaggggtttgaaaaaaagcgttgttcttgtcaatggacagtaccctagcctagatgcaaaactgcaaatgcacctatttagaaaaggtacttttaaaaaactgcttttgagtgaaaaacttcaaatctaatctttatatgtaagatatataaagattagaatgtagttacgacataactaggatgataagccgctctcgcggtttcacgggcgcgtgtgtcgcagttgcgcagacatggtgcgtatggctggtgtggacccggagtgatcacacagcatggcacatacgctggcactggacacacggacgtggccaagatgggacgttcctggcctggggttgatcgacgggggcgtcaatctctcttaaggggtgaggatgtaacatcccagcctagggcttaatagaattaatagaatactcatatcaacaagttgtaactttttttccggaagccaatctccaaagaactcccgggttaagcgtgcttggcctaaagcaatttgggatgggtgaccgaccggtaaattcttcccgggtgcacacgagtgaggacaaagaaaagacatgtgtaagcgggcccggcctgggagaggcgggacgttacaaaatggtatcagagccgactctcgcggtttcatgggcgcgtgagtcggtttcatgggcgcgtgtgtcgcagttgcgcaagcatggtgcgcatggctggtatagaccgggagtggttacacagcatggcacatgcgttggcactggacacatggacgtggccaagagaggacgaccgggagtggttacacagcatggcacatgcgctggcactggacacatggacgtggccaagagaggacgttcctggcctggggttgatcgatgggggcgtcgatctctcttaagggggcgagggtgtaacatcccggcctagggcttaatagaattaatagaatactcatactaacaagttgcaactttttttccggaagtcaatctccaaagaactccagggttaagcgtgcttggcctggagcaatttgggatgggtgaccgaccgggaaattcttcctggtgttcccgggtgcacaccaggctatcagatgtaagcgagcccgccctgggagagtccgttacagccgcgaaatctgcacggctaatattgttatattttttttcctcaaataatacgtatatttttaatttttattattaaaatatattaaaatagtaattttgtattaacttaaccaaactaaccaatatataatattaatattgtattgtatatacgtgatagttattaactatttttaatttttaatttagttatttctaaattgtatccatatatggacttttgtctactcttacaatatttcttactttttagttgctctctattatttataaattttattcctatatagattctaaacccttccgtcaatgatctttttttaagttatttctaaattgtatttctatatgagctctatactcttatttaatatttttttaattctaaatctcagttatttttaaactgtatattcctatataaactcttctcctaatatttcttatttttaaatcctaaattttagttatttctaaattgtattcctatatgatatgaactctagactcttctcctagtcttttttattttttattttgaattttagttttctctaaattaatgtttttaagtctggcttacaattagttttaaattcctctatggactctagaatcttcttataatattttgttatttttaattatgaatttccattatttctaattgtatttctatatgtactctaaacttatcattcaatattcgttattttttaattccgaatttcatttatttctaaattgtactcatatatggactctagactcctttttaaatattttttatgttttaatttcgaattttagttatttctaagttatatttttatatggattctaacttctacttttagtttccttattgtttaattctaaattttaattagctctagatagcatacctgaatggactctagtctcctcttacaatattctttttttttttaattttgaatttaggctattttaaaattttatttctatatgaactttaattttctcttagctctaaatcgtatacatgtatggactctagtctctttttctaatatttcttattttgttccgagtttaggtaatttttaaattatgtttctatatgaaatttattttttttctccgattaatatgagatttctatgccgtgagagcgaatgcggagtttttttatattactttaataagttagtgtagttacaatataactacacttacagtatagtacactatagtacaatgtacctacatgatgtataactagagtgtagatttgtggagtgtaaaactagtgctagcacagtgatgaggatggttcaatggagtgacagagcaagcgggattgatccccttagctcacgtcatccctgttaatttttttcccaatctatctatgcacgaatgtcaggatggatcaatggcccaaaaatcaaaagattttcccttcaaaaactgtcgtaagatgtatagcaattccgttcagaaaatactctttcgcattgtatcctggagggaaggcacgcactgaggctattcacagtgcacgtagatgtcattctctctcatgcagccagctcagagactcccctccacctaggcatagcttggagcctcgccaattttggctccccgttcttcgtcagaatcgcagctttggggcccacaagagaagaggtgaagaagagggagggaggggagaagcgtcgatgccgatgttgtcgtcctccccaatctgcgccggccgagactcaccggccgcgccgccccccgatccatgcctgccaccgagggaggaggccggacggggagaggaagcggcagtgcgccagatggggagcttcacccggtgcggtcgaagcttgggccacgccgccgcatcgtcgcctccaggcctgacgaggagagatggaggcgtggagcttggtgccgccaccactccgccgatgctcaaacgcctgccgccgccgccgctcgaccgccccgccccgctccggtcgccgcctcgctttctctgccactgcctcgctaccttcggctggtggggaatagatagaggagagatgaaaagtgagggtagacagtgggacccacttaaaggagtatgcactgtgtagcatgtagctaacaatattcctgggtgtttttgagcttagttggcatacgaaggctccataaaaactcaccgcgcactgctaatgcccttatgcacagcattggccttccgatcgaaaaatgtaccgcctctaggtagggataccgaggcgtttcgtgcgacgtttactcgtacgtcgtccaacttttgcccaacacacggggagaaaagtgctcatcagctttccagttaagttcggtctccgcgcgtgtctccctttggaaggtcgctctttcactcgtttgccggagcgcgcgcccgcatggcgagctgattcctgattgtgagagtttttcgtctccgcgcgcggctggcgcgtgtgctggcctttggtaagtttcggcgctcccctttttgccgggactactgagcatgggagctgagcctgggatggactactgagccgctggctctgaagggaacttgccttgttacctgttctgatgcttctcgcgctgggcgtggttaaagcggagctgcgcctgcaccggaacgacgttttgctttcgtgctgctggtccaaggggaagaaaaagttgtatgtccatcacgacgaaccaacatcgtgatttgttcggggaaaaaaaatctacctcccttacccgtaaaaaaagtccaccaccctttactgtagaacgagcatctgaatttcctcactccaccacaatatcaaacataatagcatataatagcatatcgtccaactattaaaaccgattcaataaaccttcccggatggttttgacaggggtttcatttgacgttacatttacatggcgatacaatcaaccaaaaaaaataaaggaaaatgaaagacaaccaaatgagggtggtaaacatgatggtagagctagggtacattcggcgatggcaacggtagcaatccaccagagagacacccacgcgagaataccgagtatattcctcgcatcgttgtgccagtcgtaggtccacaaccgtgcacatcaccgtgcggcagaaacgtctccacatcctccgacaagctttcaccgtgacaaatgttgcatgctagcatacacaagtcatgcctagtgatgagagagcaaagagtgtggtggaatgggacaacaagtgcagcacgagagtcgcatcaatgtaggtgaagcgacgcatgtgagtaaggctgagatgggcgctaacaccatgttcgcaacttctcgtctcaacagcaacaataaggtaggccctgagttggcctacttatctggtgtcgccagtagtgccagcgactcgagcactgccgccccatctccgtgttacctttgccacaaggtagtctgtgagggagagagagagaggaggaagaaatacgttatgtgaaacatgtatcttttatttttctaactggactaaaaaactgcccgtgcgttacaaagggaagaaaagacaagaaaattgagaagaagttgagaaagatttacattatttaattaactaaaatacaatttttctggaatactggggtatttctaactaggtaggtaaagtaagcgtgacaaataaaattgcatgctgatttaacttttgttaaattatccatgattaatgctatgttcttatgtgagtgttgggaaccctcacctccgacacgaaaaacggagaaatagattaatacgtgattaattaattattagcttaaaaaactttaaaaatgaattaatatgatttttaaattaacttttatatagattttttttgcaaaacacgtatcgtctagcagtttgaaaaagtgtgcgcgcggtaaacgagagagtgaggttggaaacatagacttaagaacacagcctaattacactctctgaatttttcttggaatttttagaggccaattgctaattctaataatacaaacaccatgttagtatttatttaaataaaaatctaaataaaaaccctcttttctatatgggccatttatagctcattttcctcctcaacccgcacaagagccagcccaccttcctcccttattctctcctccacctcagcccgtgagcacatgttcggcccagcaagcaaccgaatgtctaattggtctcccctgttctctctcacactgtcacgtggacccatcgcgacagtatcatccctaacctccgtccggactccctcgggtgcctgacgccgcctgaaactgcctcctctgtaaaatccagccgtacccttggagataatccaaacttaattgagaggtttctatcctcatctcctactctttccgttttctcaagaatcagagcaaatccgcttcgtatcgagctcgaaattgagttctatcctaaacaagcgaacctacagtttagtcatccgtttcgtttggaagaaaataatgtagtggatgatgacaacgatggacgaaaaatcgttccggaagccttacttatttttaattaggtataaatagattatcgtatcggataatatcactgtgtagagaaaaaaagataaattgaactggttttgacatgtaaggatacggcgtgtctagtttaggcaaaaaaaatgggactcctgattttgtgggtgaggaaggaaattcagacttggagtcatcactagctggagtcagcacaaggaggtaatatagcctttattctttgctccggagcctgccgcgttgcatgtgtttgggctagcaggccgctatgtgtttgggtcggtaaagagggaggcctacctgagtcaagagggccctagaagtggccggactccgaacagaatcgcggaatcattgccagtccgtgttgtgaacgatttcggactacgactccgtgtcgtaaccaaccaaggccctataaagccacgtcccccgaggcccatcgacgctatcgtgttcgcctcaatcgaaacgcgcaatcgccttcgaggcttcgatcgatcgttttgttgctcggcgcccccggagacgtacgtcttcctcccgagagcaagagagacgatcgttctacgcgccaatatcatcaagatgtcgtcggagcagcaggcgagcgccggccaaccggtcctctgtgccagtggctgcggcttctacgggaaccccgccaccctcgacatgtgctccgtctgctaccgccagcactgcctcctcaacggcgccacgatggcgacggggccctcctcttccgtggccgccgcgagcgccgctaccgtcgcgaccggcgcagttacgtctgattcctgctccgtgccttccgctgaggttaatggcgccgcattctcctccaagaacaaccctgagccggcgacggtagtagagaagaaggcgccggcgaaccggtgcgcgtcgtgcaagaagaaggtgggactgttggggttcgcatgccgatgcggggctacctactgcgggacgcaccgatacccggagaagcacgcctgcggcttcgacttcaagggcgccagccgcgacgccatagcccgcgccaacccgctcatcaagggcgagaagctgaccaacaagatctgatcgccgtctggtgcaaactagccatagatgcattttaaattgttaattcagcttcagtaggctcacaagtcaccactcccatgataacggtgtcgttgatccgtgtaatgaatcgccgtaccttgtcttatgcaattacatcagttaatttgtatctcttctctgacgatccatggtgtatcggtgtttgcttaggccatggtcgtacgttgatcgaggtcgcgaaacccggtcgtttctggcgtgcgcggtgcacccgacgccggttaccccagacgtacgctgtcgtgagctcatatctgaacactagacgagcaccaagctagtcaggttgtcacggccagatacagtggccttgtaatctgtacttgccgtaagtgaacatgtcgcgcagccatgtggtcgacggagtcgaacagatctgagtagctgaacattgaccaactttatctttattctgctctgctgtaaaacgatcatactacattcatacttaccgcagcccatgcacaattgcaatggaatcgtagcaaacaatgtgacacgcgtagcgttctattatatctgtagtatgtgtagttagaatcttttcgcttcaacttgcttcttgaatggttggcagctcaacaccccctccccacacctttatccgctcctctgctagcatggcctgccgtccaaaaacatttgaaaaaaaaattgaaactaagccgagacgatcagcttcgactagtcctttgatgaagcgagctcactgtacctctttctgccatttggttctgtagaggatgacaagcagaataacagtctgcaggattgttccgatcagcatccccacccaaatcccctgcattggttagtacacaacggttaccacatctccctgcaagaaaatcatcactgaaaaataaaagtttagaccgccggctttgtctgtcttactgttgcattaaggctcagcctgaagccaaaaacggctgcaataggcagaccaacgagatagtagcagccaatgtttacgaaggcaaccgatgactgccaccctgccccaatcgccacccctgcaatttgtgccatttaccaatggcacaacatagttgcatcaacaagtgtcaaatcctgaagcaatttgagcatatatttcacttgattatagaatggttctgtacctgatagcaccggctggatgctgttgaggaatatggtggctgcaagaagatagcccagttttgcagtctccctgacgagcacgtcgtcgtccgtgaaaagcctcggcagctgcttcctcgccacgagagcgaccagagtgaaaactagcccgacggcggccgacgtgaccacggcgacgatgaccgagaatttggctgctttcgggtggttcgcgccgagttcgtttgccacgcgaacactgacagaaaaaatgtgacaggcaaagcatgtgtgtgagctcagaaaattaccagtgagttgagtggaagcaacgcataggataagtgcgttacctcactgcagcgttaaagccaactgcaaccatcagtgtccagagctgatagttcatgctgtttacgacagagtaagttgaatcgtttaaacttaatgttcaatcgttgccaggtataaaaatatcagaacattgctaattgatgtactaaccatattgaaatcgcaccaacttgaatctctgggttcttcaggcaacccaccagaatcagcactgctgtgtaataccacatctccaagctgcaggcaccaattcatccatgaaaaaaatattttgctaattttcaccgtgaaatggaacttgaactgcatgtacaatgctacgaaccacagcataacggcggatgagagggagagcttgacgaagccgccgaggctggtgaatgctttccgcgagaagccgctccaggcctccgggaacgacccgccgacgaggtacgcgaactgcgccgcgttgagcagccaccaggacacgtcgccgacgagcgccgcg

SEQ ID NO: 13067 - DNA, 1273 bp, Oryza sativa
gcgcgagcgacgtggcgaggcagatgacccacgaccgctgcaggtagacgcccagcatccgcggctgcccggcccccaccgcctgcccgcacagcgtctccagcgcgctccccatgccaagctgatcaaaacgagcgcgacaggcgccatgaacaaaatgcctagcgatgatcgatcacatcaatactgaccgtcctggcgtgattttttaccaggaggccgaaggcgaggccctcgacgacgccgttgacgacggagacggcggcgagctcgaccttgccgatgtggccgacgaaggccgcggtgacgaacccgatgaggaactggaagatctccgtcagaatcaccggcccggcgatgcgccacaggttcccggactcgccccgccagttcttgcggtggccagcgccagccgcttccgtccccgccggcggcgccatttcgctcctcagccccgtgcgcgcgccaccctcagtacggttgtgtgtgtgtgtgtgtgcacacgacgacgcggtacacatatagagcagagacaagccacgcacagtgtaacgtagagcagacaagccaccggtcgtggtcgtacgacatctttgtagctgcgtgcgtgcactgtggatgcggttgcacggcggatcgatcagcatgctagctgaggtgtggggggggggagagcgtttagggtcgcgcaacgtggacgatggagtaggtggccgtggacttacagggcggatccagaaaatctgtttgttagtatcataacgtgtatatcgatatcatagtatgctaattatacttagaacataatgttatagtatatggataaccagttttattttaggttttaccgaaagtcgtcggtgtcgcctgacaccgatgtttatactgtagatccacccctgacttccagtggatagagctcctcctgagttccgacataagcccgtctaatccatttccccgtgcaacgctgttgcggccagccgatgtacaaccgtgccggtgtggcatactacgacactctgcagaggcgtatttagttagctcagtagctctagcttgcacacgtgctggtgacctggtgtgcctccgagaagtttatcaacccccagaaatcttctcctgaatgctgaatctgagttgactaggcagctaggccgcctgacgaacaacttatgggtctttaatatccacggtgtcctcgttgtcctgtcattttctagtttctctttatttgggatacggtgcttcacgtacagctctcaccgggtgg

SEQ ID NO: 13068 - DNA, 625 bp, Oryza sativa
catggcctcttcaaccctgcggcctttaattcatcaaacacctcatctttatcttttttgttcttaactttagcaacataaatatgacgactttcaccaacagctataccactagcaaatcccttgctgcctataagtctatctaaataccttatttggagaccaccaccccaaacagaggaaccctgcatacatccatatgcatgaacagcatgcattatgttcccgtactcaaccaaggcaaaattctttgggggataaaataagaagtttgctaaggggccaaactcctcaaatttcgatctaactagtgactctgcagcactatttcccagtgaaccaatccaaagttcctttgaaactgaaatcacatccctcgagaaatgagcaccataaagatcagatggttctgaatatgaatgcttcgcctttccaaaattctgccccggagaagtgagagttgcagctcccccagcagaatcatgtgttgattttggtgtgtgcatatcaagtcttgcagcttgatgccctgcatcagaaattacatttccttgcttgcagacatcgagtttgacatctgctaacttctcagttttcacctcatcagtatgcaccatctgtgcat

SEQ ID NO: 13069 - DNA, 536 bp, Oryza sativa
ttggattgaaatatgcctatcaaaaataaatttttcagatttagaaatataactattaaaattagatggagggagtactaattaccactcgacacatgtccagacaccagaatataggccaagaaaattcacgcacgggatggactagcagcgccgtcgtcttgctcaaccaccgccagttgcagcttgcagcactacgaatgaaatcaactcatcagtgacgacgccgtcgctgaaaaggctaggcatgatgagagaccagccgatttttttactgtaactacccttctttatcgtaccggtccacttcagggaacctccaattatgcccaggaaagcagagacagtgctgccacaaagtcaatctagcgacatacgcgaatgacttctaccgggctaatcaaccactagctttttcatctaccgtttcgaactaattgaacaccccttagggcacctgcaatggttatctataggctctctacaagagatccatatcagcatattttcctacttggaagagattaaatgaagag

SEQ ID NO: 13070 - DNA, 1362 bp, Oryza sativa
tttgcgcccaggatctcgagacggcgaaccacatcctcctcgaccacgtgttcgctcggcaaatctggctttgagtgttgtcgcctcctagctgggctgccctctctcccccgtggcagctggttccaggactggtggccgtcctccagggcctgcttacctgagcacctccgtgacagcttcgactccttggtgctcctggtctcttggcaactgtatgagcgaaactctagggttttcgactccgttctctcctcagtttttgtggttctggagtccatccattcggaatgccatatgtggtctttaactggcgtcgccgtttttgaggatttgttaggagtgtagcgtggcttggctccttcccgctgcttgaagtctgtttttagccaccgtagtttctctaagcttcagtttatttttcatttgctttttctcccttcccctaacataagccggtctggctgattgtgttgtgtaactaaaattctttttcttctaatatgacgtgatttttttgcgcgtatgtgaaaaaagagtaggcagctaggcctccgtggatatctggggcaatgcaaataaagtccgcttacactagcaaaggttctgaagatgatccaggtaatctggacactggagaagaaaggccgaattgtcgagggctgttcaaatccccaccggcgtaaaaacagatcccatttcgatatgcacagttgagaacaaaaaactgaagatattgggacgtggattttcatctctcaatgggacatcctctcatagtttgcatatcatctaaatagttataaaaaaattgaaaaaaatgacaacatagattaatacagaatatattactccacaagcatgcaagaccaaattcaacttctataaattgcaacaaaaataacaaattaaattgaaaatagttatttgtaactatatttgttatttttgttacaacttgtagaagttgaatttaaacttgcatatttatgaagtgatatatttcataaatttgcataaattttacaacaggcatcctattccttgggttaatttgatttggacctcttattactctgataaattaccacatgctattcgcccaagaggttccttttggtggaaggatgtgttgcaatttctagatattttcataagtctgtcaagttgtaaagtgggtgatgggaaaacttgtttgttctggagtgatttttggaatggtaaagtcaggtcagctgtttaccctagaattcactcttttgccctctctcacaaggactctgtaagcataacttctactaaaagcatagcacagctttttgctctgcctttatctgaacaagcttgcatgcctgcaggtcg

SEQ ID NO: 13071 - DNA, 254 bp, Oryza sativa
cctcttagactataaaagtaaactagtaaagcctaaaagtaatttacctaaattatagaagtaacttataacagaaagaaagtaactttaattaatgcctttttttcattgaacaaattatcatatatatatatatatatatatatatatatatatatatatatatatatatatatatatatatatatatatatatatatatatatatatatatatatatgtgtcttttagatttgaaaaaaacactctctata

SEQ ID NO: 13072 - DNA, 14066 bp, Oryza sativa
attcctgcagcccatatatatatatatatatatatatatatatatatatatatatatatatatatatatatatatatatgtatatatatatatgtgtggactctagactcgtcttttaatatttcttttcttttaatttcgaattttctgtaaattgtatttctatatagactttatgctcttcttccaatattatttatttttatttctaaatttttattatttctaattgtatttctatgtggactctaaactcatctttcaatattctttaattattaatttcgaatttctgttacttctaaattgtattcctatattgactttaaacttttcttcccatgttttttttaaaattttaaattttagttatttgtaaattgtattctatatggactctaaactctacttttaattttattatatttattttaaattttagttagttttaaattcctatatggactctatactctacttctaatattccttattttttaattccgaatttctattattttcttaattgtatttttatatgaactctatactctacttctaatattccttatttttaattccgaatttcagttatttcctacttgtatttctatatggactctatactctacttctatattccttatttttaattccaaatttcagttatttcctaattgtatttctatatggactctgccttttctttttcttcgattaatgtgaaaatttctaaaccatgagagtgaacgtggaggctcatttttctatttctttaataatataatagattttataaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagccagtgttgatagcgctacgagggacttaatatctccagccagtgtcgatggcggacttcgctaccctaacagaaacggtaaatctaattgaagaggcctctccaattagtcttaaccagagacacccacgtgttaatactttatgagttttggttattattaatccattaagcaagtaggggaaatattcctatcatctatgcttcaaataaaattttctcttaaattaatcatccgatttacaatccgattacatcattgtgtttttaataataaaaactttacaataaaatctcacatgattatactttgatgaaaaatcataaattacttttatgatatgtctaacttacttttagatttcagtaagttacttcttagacatataaaagtaaatttagtaaagcctaaaagtaatttacctaaattatagaagtaacttataacagaaagaaagtaactttaattaatgcctttttttcattgaacaaattatcatatatatatatatatatatatatatatatgttacttttagatttgattaaaatacttcctatacattcataatgctctgaggtgattacttttattattattttagttaattccataatttgtgctgattaatttattttctagatagagtcatgtttttatctctacaacggatttacttcaaatgacatgctaaagttacctttattttgttctaagttacttttataatatatgtaaattaattttaggttttactgaatttacttttatatatctaagaagtaacttagtgaaatctaaaagtaatttagacatatcataaaagtaatttgttatttttcatcaaaatataatcatgtgagatcttgttgtaaagatttaattgttacgaacacaacggtataatcggatcgtagatcggatgagtagtttaagagaaaattatatttgaagtataggtggatggtgcctctatatagagtggtagctggtttagacaaatcagctgcgaccagcgcgcgacctcaagtcgatcaatgtgcgacctcaagtcgatcaagctggtagcctagctggtacccccgtttttcctatacggtgtaactaatggaagaataaagatcgcggcttcagtagcttcacaagaaaactagttagatcaatttcgttttagcagagatgatcgtgtaagactaaggctaaatcaaagtgaattggactcttaacacttccatccgagcgtgcaaacggcaaacatcagcagattggagggccaccagaaaggcacatttaaccccatccctttctccccttctttgttccttgcttgccgaccgagaactctgatcgtgacggggccagaacaaaccggcacgtacgtacactgaccggccgcttggactcggatgagctaattaatcaatcaatcagtccgatcgagagtttttattttcaattaattcctatcttccgttggactttgacgctttgattagaaattaatcgagtttgttaatttgccacgatcggatccgcggttgctttcagtgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcgggggggggggggggggggtcgggtccgagggtgacgtggccacccctccctctgtctccccgaggggtcgggccgctcccgtttcggccccgagggctggggcgccccgacccactgtggttttggcgccacgtgtgtgcgttaggtgagcccaccgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattcattcacgcacagatccaccagaacacaggagtagggtgttacgcttctcagcggcccgaacctgtctacgtcgcccgtgtcttgtgcacttcctctctcgctgacgtttcttagatcgagggcgaagaacctcacttagcgtccccggccgaatcggcaaaggggggcctgcgcggtctcccggtgaggagccccacgctccgtcatctggcgcgccaggtgaggggcgcgcgtgtctttctaagccctcgtcctctttcgtgtgcgccaagcttctcccgctcagcccaatggccgaacgggcagtggcgcacagcctctctccgaacgctagcggcgacgacggggagcagaacccgcgccgtcgggctcgcaccccaccgtccccctctcgccgaaatcttgggcggggggaggcgctcggggaggtcgaaggatccgcgaattcgccgcccgcgggcgacgggggaggacggcgagacggggcgcgtcgcgcctcgtctacggcgatggcggcacgccccagggcgcgctccaggctacgggcgcgctcctgcgtcacccgcccgtcgtccccgatccagagactccagcccgacgttggctggatgacgtggccgacttggtcatgacggcgcagcagcgcctaggcgccagcgggcggtcctccgccaccgaggcctctggcgctgccgccgccggctccatgtcgtcaaggcggagggcgcggcgagcggcggccgttacccgccgttcgtccgccattccctcgtcaacgcctccaacccaagaagatgtgcgtggggggctggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaatcgtcaaccccgccgagtttctccagatctacacgaccgggatcgaggccaccgggggtgacgacagggtcatggcgaatttcttccccatggccctgaagggtcaggcgcggggttggctaatgaacttaccacccgcgtcggtccactcttgggaggatttgtgccagcagttcaccacgaacttccagggcatatatccgcgcccaggcgaagaagcggacttgtatgcggtacaacgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtactgtgcacaacacctccctccacgacctcgcggactctgccgcgcggtcaaaagtttggctgagcggacgaggaagtgggaggaggagaagaggcaggagcgccgtgagggcaagaccccggcggacatgcccggggtccccagggaggtgattgagcaccgtcttgccgtgcggccgggcgcaaggccggtccgacagaaagtgcggcggcaggccccggaacgtcaagccttcatccgcaaggaggtggcgcgacttctggaggccggattcatccgtgagatcatccatccggagtggctggcgaacccggtcgtcgttcccaaggcgaacgacaagcttcggatgtgcatcgactacaccgaccttaacaaggcatgtcctaaggacccttaccccctgccacgcatagattagattgtcgactccaccgcggggtgcgaccttttgtgttttctagatgcatactctggttgtcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcaccccggagccagatgagccgttgctactctacctggcggcaaccccgcaggtggtcagcgcggcattggtcgtggagcgcgacgaggacaaccctcactccgcgtatccccaccctgtgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtacgccccgcgtggcctctcggacgaagagcgccctagagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtagttacgtcttaccccctcggccaaattttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgagtgatgcagttcgacggctccctgtctcttcagggcgccggtgcgggggtcacgttgacctcgccgagcggagacgccctcagatacctggtccgcctcgactttcgggcgaccaacaatatggcggagtacgagggactccttgcaggactcagagtggcagctggactggggatccgccgcctcctggtgttaggcgactcccagttggtcgttaaccaggtctgtaaggagtaccagtgctctgacccgcagatgaacgcttacgtgcgccaggtgcggcgtatggaacgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagtgctacgtgctggtggaagggaccctctatcggcgcacggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcaataagcactctgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggagaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccacgcgctaccagcagagcctgcggcgctaccatcagcgccacgtccgggcccgatcactctacgtcgacgacctcgtcctacgccgcgtccaaacgcgtgctggactgagcaagctctcaccaatgtgggagggtccgtatcgagtgatcggcatcccccggccgggctccgttcggctggccacgggcgacggcacagagctgcctaacccgtggaacatcgaacaccttcgccgcttctacccctagtgggggtcgggtgtcatgtctcgggctcgggccaaccctgcaccccccctcccgggcgtgcagggttggccgggggctaccacatgcatatacttaccttttttctcttccgtatttcaataaaagcattttcgatttcctgaggactgtgtctgtgccatcatttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgtgctcccggcctggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgcagaaatttcctctttacttgattgcagattaaatcagtctatacaagaagggggcccgaaagcctcggaagaagaaggaaaagttattaagattggcgggggcctgggggctcactccgacgcgcccgggtcgtcggcctcgtcgtcgctgtcgtccgcaccgtcatcaccgccctcctcgtcggagtcgagcgcgaacgcgagccgaggggccgtaccctcgaagctgtggacgatgtggtcggcggcgtcccggacctgcgcgcgcgccgtcctcggttccgggagggaactcttccagcgctgcccacggggagaagtcagggtccctggcctggtagcttgccagtacgagctccaccgccccccgggtgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggacacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgtggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttctcgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgcgcgcccacgccgcgtcgagctccgcccgctccgcctgcagggcctccatctgggcacttaacccgtccagcaccgtactgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggtgcgcccgcggcctcgtcgtgggtggcctcggaagtcatcgtcgcctcgggcggagtcgggtcgggggtttggcaggccgcctggtgtgcgcgcgccgcctctgcctcccggacggactcccaggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccgaccggacttggaatggcgggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggggccgtttcttctttcgctccccctcgggctgcggcgtcggcaaggcaccctccgggcgcctgctgctggcacgcaccgcccctccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggccccggggggcccgctcccccgacgccccgaccacctgcatgatggccaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggtgacaccggctgtacggtgaagaaccaccggaatagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctaccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttccttggcgtctttacacccttgccaacgctatgcccggctcctcgcttcccgcgcccactacctcgccccctcgtttctcgcgcccacgcctccactaaccccactcgcccgtttgcggcgcacgcggaagatgtgcggccgtggcggttgagatggggcagatcgtgcgcgcattaactacgcccgccaaccgtgaaaagcgtcatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgccgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgagggtgacgtggccacctctccctctgtctccccgagggg

SEQ ID NO: 13073 - DNA, 10955 bp, Oryza sativa
gaccccggaccagataaaaaggaagcccaggcctaaaaagagagagaaaagaagaagaagggaagggggttgggactttggcgaaggggttttaaagcctgaactttttttcgctctccggctctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcagctagctaggcagctagcaacctactccctccgtcccaaaaaaaaaacaaacccttatttccgtgcccaacgtttgactatccgtcttatttaaaaaaattatgaaaaaaattaaaaagacaagtcacgcataaaatattaatcatgttttatcatctaacaataatgaaaatacgaattataaaaaaaatttatataagacggacggttaaagttggacacgaaaacccaggatttgtattttttttttttggacggagggagtagctacatctatgttccgtaacatggtaacgattgattaatagacaagggaatcgctcgctgctccggtcccatccggctaaccattggtttcgccggcttaaaaaaaaatctcctgattatagcgtagttaacttgtttaggaggttggggattcccccctatctaactcgaggctaactaagcagagcttagcttaaattagctcgtattacttctagttgcaagttgcacatacgtactccttgcttatgcagcagagagaacaggcaaccggcagcctcgcgtagctcgtcgtcctctgccaatcgcccacacgcattgtgtttaggcagacagagcatctttgtctcagatctccccccgagtaaactaattgccactgggattactgggagaagccaccacctacctgttcagacttcagcgtcacctgtgtgtcatggatgatgcattcatgcttgcatatgtatatgctctgtaccctgaatcgtgagacatacgtggtgcacaaaatgcaacatggatggatcatggatggatacatggttggatgcatgcatgtcgtactggcttggatttgcatgtgtgcgtccaggtgctggcatatacttccagcagcagctagctacgtgtatagaattgaataatgtttgtagattttgacttggtgtagagaagacggacgagagccagctagctgcaaattccaacagacaccaggtgcagtgggaaaatactagtgtttggttcaggcagagcgatcgatcgatcgatcatgacgccgttcctgctagataggtatcgtcctcttgtctctttccagataattaaactagcctagttgacgagtcttttagtttttttttattaatgctgggttgctcgatctggattttagtttatctcggagaggggaatggaataggtgtcatattatatgtgtactgttcaccaatctgcagatataatagtagaatacaaccgttgcttgatttctagatgaaacgagaatgacaggcaagctcttgtgtgctggctaccacagttttgagagaagaacctaacttggtttctgataaaagcattaaaaacaagccatctgaactctaagaaatgtacaaacataaaaaataggtcatgtcgttttcgctttttttatcatatcatttacagagtagttcttaattaactgtagaccagagcattcctcattgagaataactctcaatatatgtatgtacaggatatacggagtatttttttttcctttttgaattaatatgttgctcccgtcatctcagtatcaatccagtatacttttttttttctgtagtcttcccctgttccacatcaaagaccatgccgtattccgttgcaaagacagcaatagcatggcttgataaagaaacatattcaccaatcaccagtactgcccgtctctgaatttcagagtcgaaagccaaaaggtaagctactcgattgactgtatccacagttccacaccctgctgttccccgcgagaacaagtagtacagtattgcccatgcattcgcggtgcgggagttccgtgcgcgcgcgcgctccgtgtacgcgcgcaaaaagaacggcggctctcgaggcttggcacgttggcacgcacgcgcgcgccatatgggcttgctcgatcgcgcggccccgatcacgtacgtgcgactgtgcgagcgaccgagcgagaaccacgcgtgccccggccgcccaccccgcgagtccacggcacactcgcctgagaaaaaagtgccaatatcgctgatccatccgtgggtctgcgccggctaaggttatggttgggtcaattcgtaaacatacttatacggttttttaataataaacatacttatacgataaatttacagatacaagattctttgcaatattactcatacaatagcagtgaataacatgtgagtccgagtctaaatatcagtgtctgctactttatcaacagtactgtagacatttccactagcaaatttaccatttatttttagtagtagtacaaggctgcacgatattgctgatactatagcagctatcgtgtaatgacagtacccaacacgtagtatagtagtgttgttaattgttttatatcctaaaatataataatttagtgtgggatgtaacataaagtattttagtaattacgaatgaatatttatattttatattagattgttatattttaggacatgacttatggagagttcgcgtatttgggatatacaacgacgtagatcgatcggtctgtgaagtgaacgtacgactcgtcggtctctatcgatctcggggtcaagactgacgttctgacaagggaaacctgaatgacctgttaaattggacgtggtgtactgtacacttggccagaaggggttgcgtacttgtgtacgtatttcagtatttctgctctcgatctctctctctctctctttcgctagttagctttgtcctttatattataggttgatgtgttgttccattccctgtacggctgagggtgcaaacgcccgctcttgttcctgtcaccatgtcccattcgatcgttttcctcctagtacagtggacacgcagatttactgtagatcctcgaaatggaccggcgcggtaacaccgatcgtaaatttctcagtgaaaaaaaaatgcaatgtaaaatcagttaaaacatgtggccaaaagatcagactctgctaattacagccttacaggggggctcagaaccaaacaaaaccatctctagccaccaaaattgactcacgagaggttaaaacttgattgaaaggaacaactcgatcgacagatcgatccgattgatcgatcgtatcctagctattagctagctagctactacttcatgagacgcgttaattgaaccgatgttaacgaaaataattgggtgtactagctagcacaagtcaagacacgggaaatagtgatcgtttctacgcctcgacccgatcgatggatgattcgatggacgacacgtaaaacacgtttggctcttcgcgatcacagaaaggggatagataggccgacacgcgcggtacaagctggattagtacattattgtctccacatgtatatatgataatatgattattgctgtagcccgtaggtctatccagccgtacaagtaccactatgtatatatacgtacgtaccctgtggatcaaccacaaattatttttgtgacgtgctaattttataaagaggttttggaaggatttgctaattatattctaacgagcttatatggaagatgagtcgacaaatgcagccaacacgttcacatgattaattacgtccagcccggcagtctatatttcgacgtgaagttaattagctagcagaagatcctatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccaggtgtgtatagtagtgctagctaacccaaacaatttcttttttcaattaatccggcctttcatttgccggctcggctccgccattgactccaactaattgtttgattagtttttggtcgttgcttggttgatcgttcttgcttactaattggcgtgcgtgtgcatccagctcggggacttcggcgggggagaggaagctaatgccgacgatagaagatgagctggacaggaggcagatgctctacagcctcctcatgcccgtcatgaacttgtgggtgatccatctctgaatctctggccattatcctactttagccatctaactgttttctttttctcaccatgcctttgattgggacgttttcttgactcccggcaacagttgaagctacctagctaagatacaagtagccgtattaatttctagcatgcaatttttaatcttcttttaataaaaaagaaagaaatgatttcttaatctagtgtcattgatcgatgcattagtttaaggcctaattaatctaatctacagagacaaacctaaacctaaccgttttccgtttaaactttaccatcgaccgatcaagaaacagtacgtttaatttttcatatgctaaatataatacttgggaaatgtaatgaccggggcgagcgagtcatgcgtttgtagccttggtgacctcacaagggtttggctaagaaacaccgcaacttgcgagaggtgtggctaattaatcattcacgttgagcctaaaatataatgtgtttgtgtcttagacgctagaggtgctgctgccttgggtgtctctctactttttaggcaccgagattccttttctaatttgtaagacatctaacgatagctagctagcttcctaaaataagattatgtagcagctcaaagtcgctcgcatacgtaaccaggaagttggagtgtaaccttacaaacaaagcgacaaatcggctaccggccttgttgcgctaaaataagctaagagaaagggagttttcagaaccattcaattagcttgaagcttgaataaacacacacgtaaattaatggtactaacgctcatgctcataaaattttatcagcattattacgtgccctgtgtcaatcccacattaatgtatcccagctgaaaggaatggtgcaaccaccggtgtatctctgttaattagccatcacaatgctaaatctttcgtacatctgatatcttatcataggttatgtcaacatcggcctgaatctttaattaatccggcatgcagaactcagcatcagtgggccatcaattacactgcatgatcattgttgatcccttcctgcttaacgattcaacgacataaccaaccagctgctagctgactgaatgactgtagtagtaaactagtattatagctagatagtactgtactagtgattaatatgtttatctcagattaaattaactaaaggtaattaaataaaaaaatgacaggtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgaccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgttcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctaccaactacttctgttgacccatatgtacttttttctgcttgtgcaaaaatgggagtgaactagtgacactgacaccccaggaattcaaccccactcatgttcctccatgagagtatgtctgttggtacagcgtcacccatgtctgctaggatacactacttatagtggagtatatgtttaaatcgctcttattattctattactacagcatgatcctttctgctaaagttttcaacacagacgtagctccctattttgtaatgcatgactctaaaataaacagtgtttttgggagggaaaaagttctgtaacttgctacactagtacactgcttacagcctagcccgggtttggtacaacatataattcccaacagacaaaagtatcaccttatgtttagatttgaacttttgatatagagaaatacgcaacacttcctgcataaattgaatcctacctgaactcatccaacttgcaacctctcacagaacattaatttaccagtttcaatcgttaaattattcatgaatattgtagtaggtacaagtgattctaattatggggctaaaactgctatagcttgcacataaaaggaaacatggcattgccactgccaatgacttgtgcaaaaacctatcgattccaatctaccacagctccactctcccatgtctgcttgtcacagaattcagtactaattaacagtcaaataagatatttttcttttttaaaaaaaaaactaaaagacgagctgcttgcactcatggcccgtttggttagggggagtttttaggagggattggaagtttagagggatgaggctattaaatgttttgtttggttaggagacatggaaattttggtgggatggggatggggaattgaggaatgaactccctccttttcaatacctgggtagggggtcctttacttcgcctaaacaaatctcagccatccgttttcattaatgacctaatctccaactaaactccctatcaatttctaccacctctaccaaacaagagactaggatgaaaaatcaaatttccatcttaatctcaccatcaattccctcgtgtaaactcccaatcctcttccctcaagttgccaaacaagccgtgatatttgggacaataaggaaatttagttgcttgcacaactcagataacacgagttggtgcttggtagcaatacagaaaatacggcacgtacaatacagaaaatacaacatgtgacccacattatggattacactagatagatgttggaataataaatatgattatttagatttataattactaatcatatagtggattgtgaatatgaccacgcattttgcagtagttaaggtgcctttgtaccgcttgggtcctgtgtaacaggaaggtgtccatcggacgagcatctcaaaacatctggaagccttctcaactttggtccttgtttcccactcaggcgttttggttttacatcctagccaaccattcaaatgtcacatactgaagttctaaaataaaattatcctacttaaaaagatctttatgaaggaaatattgtagactctagtgacttgcccaaaaaaaaaaaacctccattatttttagatcagaatgaatagcagctggattattgctagttcttactgcaatatgttaataaggttaaccaaagcataactacaaatgatatgttttttatctgtgtgccttgtgtatcctagttcttgtgatttgacctcagtagtaagtcagaaatcatcaggggagttctattttacgctgttttgagtctcttctatcactgagtcacgggtaatttgattattcaagcccatcacgaagtgtaaccaaccttaatcagaaagattactctataattgaatagagagcattatgggtagattataaatctaatcttcctaggccatcagccttaaatgccttgatggttacacaggagtttcaagtgtctaccaggaatgatatcgatttgttctgaacttgtaatacatggagagtactcattcacaattaattgttagcctatcttacatagttagatctaagatcagaccaaaggaacaagttataattgtgtcagtctagttctattactccctggttccctctagtaaaaaaaatttgacgttccaacatcaattaattttgactggagggagtatgatatattttgtaactaaataattacagattggtaccaaatattttaagtaagggaaattgtgttcggttgttggccccaaacctggtcaaatattgctgtagggatggcaaga

SEQ ID NO: 13074 - DNA, 854 bp, Oryza sativa
agtcaagtatgccttcatcccacctcttatgatctcacacctacacaaaatgtaagaatgaaatcagttggttttcacaagaacacgagaagcaaatcttcatgatcagattattcacaagcactcagcatctcttgcacagtcaagtggaaatgtagtttctcaagtacgatataactatgatgcatgatttaggaataactggtgctatatgcattagtggagcgattctgatttccacaaccaaaagtgatgcaaaccaacacaatgtctcaattagaaatcattagagcattttaacttacattgatgacagaaaagaagcataaactactgcagtgccatggagatggaatattacagaccatcacaattgacttggtgagtggtgacagcagtgctccttgatccttaaattaacattcttgatgtgcccattcagatgaaaagtctcaagcaagcagctatgtctatgtggatgatctatgcaggtgttcaagtctagtatatttataggaattgtgaaaaacctaacaatacaaggattagttacattagtgttagtggattttgttcacctttaagtagttgtttgggtgcatcttaacaagtactcagaattatagacaagaaaaaatgtaattacttgagctcaagaaatccactcatttctattgctccacagaatgagacttcgccgtcaccctgggaaaaatgcatgtcaccagtactcagatttgctccatcaacaaataccgggagataaaccttggaacctctacttagattcttgatgtcacaattccctccattctcccttccaggaatagttcttgctgcttcatttgcgattt

SEQ ID NO: 13075 - DNA, 2294 bp, Oryza sativa
cctggaaatcggacacctgatatacacacaatggaactattgaggtatcctaaattgaaaagcttcatttagaacaacaccaaaaaaaaaattctacctggtatttgaggggagtatgcataaattccttcaaaataccaaatcgcctttcttgcactagggaagtggtcggttaagaatccaccaccattctccctttcaaatatggcagtatatccccattcgtcaccgggaagtggaccaaggttgcagatctctacagcaagaagatcaccaggtgcagctggaaccccttcagcatcaactattcttaagggcccactaagataatgagtctgtgggaatcaatagtcagtttcgctgatatcttgttttgtaataagcgctgtgataaaaaaaattaaacggcatctcttgcaggagcgatatatatacttacaattgtgagatccaggaatttgatgtcatctgcggagttatcatcactgactcttcctccagtccaatcgaccatctcaacacggaacaattccccttcagttacatctgcaacaggagggatatctggatgccagcggttatggagagggactttttgctcccatggcttcttgctcacatctataggaactaccaatcttggtgttggaagagccatgttctgttgcagggagggaagggatcagaggttcatccttccggaagctcatgcttctatataatgatagcatatccatagcaatgagtcaggcaaaaaacgacaaaatgagcaaagacaaaggaatcccaggaaggaatggtttcaaatatacactccatctcgaaagtgcactgaaaaataagtgataaatcctcttattaaaatatttccaagaaactaagcaaatcttaacctagcaattattttatatgtttggaagtacttaagatagtggtcacaatcaagtaagaattgtcctgctggtccctcatatctctataggccactcagagcttagatgatgagatattttctagttcagaaatcagaagtggtaccaaccaacttgggccgtcatattcatcggtgttttccacaggcacttcatgcatcacttatgctaccaaacatgcacatagttaggtttttgtgataaatattcaaatataatctgaaggagcccatgtccccaataggctccaattcaggctaacttgtccatgtccccaataccaggaacagtctaactttatcttcttttgcatcacatttacaactagacagctggatatttattcttcaaggcaatgtctaactaacaggggcattgagttctattggttctattttcatttaacagtattaaacaaccttgcaaaaccttcctgttacaagctaaaatattactccctccgtttcatattatatgtcgtttttacttttttccaggtcaaacttttaaagtttgaccaaattcaacacaaaacaaacatattatcaaaatatattcaacattacatttaatgaaactaattcagtgtcgtagatgttgctaattttttttctataaacttgatcaaaccagaagaagtttgactagaaaaaagtcaaagcgacttttgactagaaaaaagtcaaaacgacttataatatgaaacggagggagtataatggaaacactagtacaaatagaaactatacacaagggtaagaaagtcattcctgaagtagtactacagaaggcaagaaaagtcattgttgaagaatatcgcttagtcaaaatttccattaacattttgcctaaggaccataacctgtacaattagtcaattacctccaacaaaaaatggaaatagattgtatgaaatgggagttgcggaattgtctgatttccaccaaaattaaccactctttgttaatgatggcattgaattaatagagcattatcaattttgcttcccaagtatagaccccacatctcatgaagtgcatgtgccaaaagcactcatcaatctatctgtgaccaataaaaccgttatcttagtaaagaagcacctttctacaattcctgctcccgaatcaacttacatgatcacatccaaactcagaaggaaagcaaaggcatgattctctacatggtatatattgaattaccttccaatgttgttcctcactcaacatactccaacaaacatccatcagtagtatacttctttgacttgtcctctaacattcgaaggctccagcctgcatctttcctcagtcccttcttcttcatccaatgcaagatcccctgagcttcctgccacctccc

SEQ ID NO: 13076 - DNA, 2591 bp, Oryza sativa
agacttttccacacttcccatacatgtctaccagcgctgtgcccagtacaacatccatctcccatccctgcttctgcacgtactcgtgaatccagatgccagtgtcgaccgcacaatgggccgcgcaagcgccaagagcagcaaccatggtaacgcggttgggtgcaacatgagcagcaagcatccgccggaaggtcgccagagcgtgaaaggtgcggcctcggttcctgtatgaggtgatcatagtggtccacgcgacaacctccggtcggggcatttcgtcgaacatctgctcggcgtgcgccaggtcagggtcgcagtccgcgtagcgcgcgaggagggcgttgcggacgtggaggtcgggcccgaacccggacttgaccacctggcaatgcacggccctcaggtcggcgagggaggacagggaggtgagcaggagagggaaggtgaagcggttggggcggacgccgcggcatcggaggaagtggcggaagagcgggagcggggagcgggcgggggcgcggccgagggagcggaggagcgagttgaagacgaacacgtgggggcgcgggtggcaggcgaagagggagagcgccgggtcgaggtggcggagacggccgcaggcgaggaagaaggcggagacgacggcggtggagcggaggagcgcgcggtccccgaggatggcgccgcggatgggcgcgagcgcggcggcggtggtgcaggtgttgatcgcgtgcagcgcgcgcgtgacggagggcggcggcggcgcggtggacgggcggagaggcggcgggaggccgccggtcatcacggctggcggtgcgtggggcgtggaagcgcggccgccttgaacaaccctggatgtcctgggttgatgggttcgtcctccgcggccgatttgtccgttaacggcccagaaggcccgttgcgcaagcaagagttgcccgtaaatggagtatatttgtcaccgttgtaaggcaccgttgcaactttgatcacggaaaataatttttagatgattagattatgatgataaataaaactttaaaacttatgtttaagtatgtaatacactttgataatttgacatctatttaaatatttagattatttttataaaatagacgaatggtcaatgtttaaatatagattgtgcttagcaacaaatataaaggaactgagagagtacataaattgttccagaatccagacacgattttaagcaacacataatttgtttgaacttaaatcaataggtcaaacaaattgtaatgttgttggaagaagtatatatatacgctgtgtttagatctaaagtttgaatccaaacttcagtccttttctatcacatcaacctgtcatatacacaacttttcagtcacatcatcttcaatttcaaccaaaatctaaattttgcgctgaactaaacacagccataatttgttttgatgatctagtagtctcacggattacaagtttacaacaagacggtcaacagcaccccggaggatatggcaatcgatgacgttgaatgactgacaagcatttgttctttgatgccatgatcaacagaaatcttacacataaccgcacagtaaaggtatatgtagataaggagacaacaaacaaagataagatcagctaaatatacttgctgcgttcattgaaggctcaccgtttcgaggctcctgaaacttgattggtatttgtgacatctgtggttggtgtttcctaacctgccatgaagcataagaacgtatgtaactcattccaacacagtataaccatattcatataggtcaatcctacaaacctttacaccagccattgataacaacttgtgcgaggctacgtaaacataatcagagttgtcaatccttttctctacaaaatatatgacttcagatacacctgactgcaagaaagataagtattatagttagtgttgaaccaatttcttcaagtgaaaaggcgcggtttactagtaaattattaataaaatgcaatgtgtttgtatacattaactaaagtttaaccggcaaagcatgcagtaaatatgaaacttttaagctaaaatgtgccgttaggttttatgaagtgtatgattgagatatatggtgttataatgcatttcctcaaagtgagagtaatttaaataggtgatgacaaaaatacattttaactttaagatactgattctatccagaaacaaacctggataataatcttagcacactcattgcaggggaacatggtaacatataatttctgcaaagagaagataacacaagattattcttagcttataaaggcaaattaatgagatgctttaagtttgtaggagattagaagtccaaacctgtccagccgctgaagcatggtttgtatttaaaatagcattaacctcagcatgaacaacatagctgtcagggtgaaagatgacggtcacaattagggacttagaattcaacatctaagccttgctataggagactatttttgtattcaaggaatgcatatgtagtgtagcacagtgtaaagcttagaggaattaacaccagggcttctcacacaaattttacgcaactgga

SEQ ID NO: 13077 - DNA, 7925 bp, Oryza sativa
catcgagtccgctgctgccgccgttgcatcgcatcgagtccgccgcggccgccgccgcgtcgcatcgagtccgctgcggcagccatcgcgtcgagcttccgacgaatcgccgccgtaaccatcgtcaagctcccgatgaatggccgttgcaaccatcgccggccttaccctcttcccctctcttctctttgccgcatccccgtgccggcgtcgcatcaagttcgccgcggccaccgtcacatcgagcttccgacaaatcaccgccgcaaccatcgccgcggccgtcgtcgccgatgaatcgtcgccgcaaccatcatcaagctcccgacgcagcttgcagctatcccggtcctcccgccacccatcgccgatctgggccgctgtcgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccatccacagtaccgcttcaatgggaaggtgcggtaccatgaggtaccgacgatttttgaccgtagggtgttgccagatcaacggccgtactgcataacctcaaggatagtaaaaaatcttaaagtctagaacaacaaggatcagtagatatgagcctgacacaggagcatagaagtaaatttttaagggccatatatagagttgtagactaatccctttagataatttttaagggtcacatatagagttgtagactaatccctttagattttttgtgcctcacaggtcacaagatagctgaaaataaaaaaaaatcgccatgtgcatgtctctgggaacttttttccccgagttattaacagtcaacacacaggatcccatccacgccgcccttccttttttgcattcagttatgctcttcattctttgaacatatcatcactcttactctatatggtttgtgaagtcagctggtgtatgcgagacttttgggctgggacgcaaatcatcagctcagcacatacaccacccaacagtttaaggttttctcctctctagattatgaaatcaaatactccctccgtcccataatataagggattttgagtttttgcttgcaacgtttgaccattcgtcttattcaatttttttttgcaaatataaaaaacaaaaagttgtgcttaaagtactatagataataaagtaagtcacaaataaaataaataataattttaaaaaaaaattgaataagacgagtggtcaaacattacaagcaaaaactcaaaatcccttatattatgggacggagggagtaggaaataaaaggcatttgcattaactgtttattttgaagaaagatccttgtcaatgatctaccacatagtttaagcttctgcattccaaataggtggcaccaagtgattatgtacatttagaactagagctcatggttatatctaggatatccatatttacaaaacaattatctcatcactgctaaagtaaattgcccgtactgatcccaaaaagcctatagagctacagtgtatcaataaaagatactgtcaatgtctctccactgatgtttccaaccagttgctctttcatgcttcccaggtggtgcttatcgtgttaatagtctataggcatttcctccttgttttttagataatggattattaacccggcctctacaccttagaaaggtgtacacagcccaaggcatttcctccttgttgctagaatattgacgttttgttgtatttgctcatgtttcctttaatatatttggcccacaatccttttgcatgttcacaaagaaaagggatagtgctaatcaaactagtgtagaaaataaattcatgacttacgggtattttgtctccaatggatctcccttggcagatttctgaaatgacaagcaattaggaaaatactagagaagtgatagatgttaagctatgggactcttttgcatgtggcagcttgtatgtgctaaataattacaaaatgagcaccttacatgaattttgactttgcactaacagtacaataattaatttagtagtccttgttacatacgaaaaaagagcttcagaaaaaatatacctttgcccagggtagcttattgtcagaacaacctctaggaaatccattataccctattcctgattgcattaagattgggttacactatcagaacaacatgatatacatattattaatggtgcattgcctgccaaaacaacatacatttcacagcaatgctgcagtctgaagccaccaaataaaagggtgcattattatatgtttcaaaaaaaaaagtagcatgtgttgaaaaaccaatatagctggatcaatgttaccaaaaaaaaaaactgaaatgtagcagcgagtccaaaagcaaacatgtaattaaaaagaggactgccatgctggttgtgatttgctgtgaagagccaaaaatgtaagactgaaatgtcatgccattatgccacaactggatagggatatcaatagtgtatctaaccagtaacaaatgcccctcaataaagcagtaacaaaatggaatttatacaaaataatatatcgacactggggtaggcaggtaacacgagaagaagtccgttgcacacactagcacagcactatctcagtacacaaaacagtactgcactggccaatcatgtggtctaatggagagaacaacaaacaagaaaaggatataataaggcagttcagtgcacttcctaagagtgaaaagcatatcaaatttgatttgtgaccataatgcttctagtttatgaaaaatcagtttcagatatagcataaaaatgtgtacagtgtccaatggttacatggattaaccttgtgtgtttttgtttttaaataagcagctaacctactaaaatgcaaaaaggctataaaatttcaaccctgaacaaggtattctttgagtttcaactttacctaggattatcccctcttggctaaccaagcatgctccaacctgcatacaacatactgatgaattgattaaatcattaatgaaataggtgaaataatgaactaatcaagcatgcacgagctgcttaattgagttaaagtttgctttatgacaacaacaaacaaatacattcaaaacaaatgttatccttcctcttccattacatgacatttgcaaaacgagcaagaaagatatacgtgaacaaacttgagatgaaatgaagcattactacttgacattttggtatagttgtattgccaaatgatcctacccaggggtaaaatttgccactctggtatgtatggttggcaaaaggttgaaagaaagtcatgccttattgtctaaaaaagattgaaagaaagtcaagtccaaataggtaggtgaattcttctaaagtaggataataaagggtagcatcatcccgaaaaaaatcatcaaccacaacagtccactgctctccgacaattttaatgattctccacagtatagtatcattgaggcatttctacaaacagtatgactgcatgagctcaaacacgttaaacgtcgacaatcgttcgttggaatccttacacgggcagtttagcaagcaacgaagatgcactttacctgccgattaggatccttggaccgcttggccgaaaggaacgcgatcgccatgaagtagtcgtcccaggagatatacctgcagaaacgaacgcaacaaatcctcacaagatgccaaaaacgagctttaactcggctacacctaatcaaagagggtgagccggtggggcgactaggactaacccttccctcttggcgggatcgaagggggactgcaccggcgggcgctcggcggcgcatccgttgaccgcgaggtgctcggcgcacggcgtgggcgggctccgctgcttggcagagctggccccgtaggatgacaggaagcgcagcgcggccgcggcggctgcggcgcccacggcggcggagatggacgctacggcgaggtccctcgccgaggccatcgcgctcgctcgagcggggcttgggtccggagggagactgcaagctgcggccggctgaacgcgggagattttggggatttttttcccttttcccgcgcgcgagataatccccttgtgtagtactatggtgctcgttgggctgggctgactagcaagtcggcccaaaacatccttcgcgtcggccgttgggctaaggatagcaaagttgcttcgagaaccctgctttggtgaaaaattctgataccttccatttgcaaaggaaattcgatatctaagcctctaaggggaaaaaaacgacactgtccatattcaaaatgcgtgtagagcctataaaaaaacttgcgtatggagtatttaacatgtctcatagcctctggctttaatgcacttttgaaataggaatgggaacgagtggaaaggattacagcacaataacaatatcccataaggtagtatgaaatattgcaaaaggattttgagggggaaaattataattgttccttgtgtttttcttatgtcatgtcaaacaactattctaattattttccaaatgttttgttcatataaacttccgagggcgagtaagcacaaagctaatactagcgatgatagtactatattaatctgtaaggatatctaaccgctcttattataattataatatgtgtctatggtcgctctgtctaattatattctagttttagaatggagtttaattctttctctataaaagggtgaggtatatatatgattatccttctctagcaccggttagctatatctcccctcattatactcatactttcttccctaattatctctctcttcccatcccctctatacagtggcggatccaacgcgagtacttggggcctaagccccctatcccatggagtagaggaagatggaagaagaataagaggggagatggagggataaggcggcaacgagcccctcgccaacctctctctttgctggtgtaagaattattagtcgttgtttcttcatttatttagaactaggatctcgatctgccctgcctctcgaagagggaggatcatcctattttgctcgtgtaagaattattagttgttgttttttcattgatttagatctaagatctccttttctcatcatgtaagaattactggttgttgtttattcattgatttagatctaagatctcccttttccatcatgtaagtatcactggttgtagttttttcatcggtttagatctaagatatccattttccatcatgtaagaattactggttgttgctttttttattgatttagatctaagatctcccttttctatcatgtaagaaatattgtttgttgtttttttcatcgattttagatccagcgccaggcagccgcgggcggctggcggaatcgccacaacgcatggttgctgtccccgaggatctccaccgcgctccacgagaggttggccatgctcctccctgaaaggagcaactgccttggctccggccacggttgggtcattgtctatgacccgatcttctacaagccgtagttccgcctcgtcgatcccctcatcggcggcgagccccagctcggcctctgcggcgtgtagccgccgcccggtggcaccctccaccgccaacaccaccgcccgcaggtgccagcaccgcgcctcctccagcccattgcccatcaccacgccgccgcccacctccccgcccctgtgcgctgctcggtaagagagaagagagaggagagggaggaagaggagtatgataagtgggacccacattttttgtaataaataatttgctgactggattgccacgcgtacgccacgtaggacaaaaccgctccggattgggctgtgggggataatttgtccggtattttaagtttagggtgagtaatatctggtttttgggtttagggcggtaattcggttgaccgcgatagttcagggggtaattcgtactttttcctaagtattttttttacccaaactaacgtaagcgcaaattttatcttaccagttcaccataaatccattataatcatgtaccccgtcccataatataagggattttagaggtatgtaacatattctaagactatgaatctggtcgcatccctctagattctaaggtagtcctactttctctattttataatgtaagactttttagatttattacattatgaaatggatatggcgtggagtgtttcattgctagtaggagtaacagattcctagtatctgtccgtttgccattacaccacacaggcacacatgccacacaccaaaccacaggccacacacgcctgaactgacggggtgtcatcaaacggactacggagttgacactgtagactcctctcccccgcgtcgccccgatcatggcgtcgtcggcggagccgccgccgaagaagcggaggctcgtcgaggtccatgtcccgtccccggccccgagcccctcctcctcctccgctcccgcgccggcctcgccacggtccccggtcccgccccctccgggcgtgccgccgccgccgccgcctcccccacaaaccctagccgccgccgcctccccgcggccggaggaggccgtacgcaagcgccgcaacagggaggagctgcggggcctcttcgagtgctaccgccgcatccgcctctgcgtggagcgcaaggacgcgcgcctcctgcccgagctcgagcaggtgtacctctcgctcatcgccagctctcgaggtgcatggactctcccctcccactcacgcttcatcaagatagcgcaattggaaagtgccgaaattcgtatagcgagtcgatgtggcgttttctcgataccactctacgctcgaagctagtagaatttagttctgatccgtctctaatctcgattgatggttattacttattacttgagcacctcgttcctatttttcttgctccgttgtgtgtttgtgttaatcaggtgagggaaagcagaaggcttgcatgggtgttggattatatcattagaggaagtatacagtggttaatggtgactaaaaggatgctttactgccagcatattatagtgaaatagatttatggatccataatccatatgagctgccatgggaataaaatatccagcaacaaatttcacatgattaacctgttctgtactcctgccccgtgtgtagtttgaaactttaatctacttggttaggtcttaggtcaacaagctgtgtacgtatttgatccaggctcacaatagagaggtatgtgcttgggagatgtactgtagggcgtaggcactacttatttacctgttcggaagtagttcctgagaataattcttagtcacatgcttgtgaccaacagtatggaaattattgttggtgtatccacaactggttcatcaccacgactgatttaaaggagcacctgtttgtttatcgatccttagagcttttgttggccttactagtgatgaactcctatcaaaatcagtgtccaactgtatttattgattgtatgcttgtgtgaatcataagcatgcatcacaaaaggataacaaatatattaaatccaggtttccaagttaataaaaaaacagaagcaaaagttgatcaaataatactgcatcactgatgtaaaactgaagtaagttcgtggggtatcgacattttgatcatcacatgttaaccaacaacatagaaaaaaatgcttagggttaaatgctctttatatttggaaacttaatctcacatgtttgagcttatctagctatgctcgaattttcttttggcagcattcatgtttctgtactctttcagttatatttttaccaatttgattaacagagaatggaacttttggaggt

SEQ ID NO: 13078 - DNA, 1045 bp, Oryza sativa
acctggccattgtaacaagaggggaagatgtggatggtgtggcataccagactgctagggcttgtattcttggcttaactgacatatgctccacagcatcctgtgaagcacccaaatcatctgttttaacaggaatctgctctgcagtttatattactgtcctcacattcttcatttcaacatttgatgggaaggatatctatcacataggctcaagaaaacttctaaatcttcaggaccctgtggagctgttagacattctaaagcaggattcagggggtgacaaccaacaggcagacgactgtttagttgaactgagagcactttcattgctatgcatatttcttttatttccagagaacatactagatgcctgttttgcgctgattgcttctgcagaagatgtaaacggagaaggattgtactttctaaagcagctaacctgccatctgaacagtggtatcataactgatgctctcgatgttcagggggatggaatctcccagtgtacaggaatggacgtagatcatcctagcaccaaagaatctgttgattccaatctatcttctcatagtgttggtgtttcaggaagttctatgttgcagccaaatgagtgttacatgacaatggtatggaccactattgattgatgaagcattttaacctttcggtcaagtacttttgaatttttcccattagaaatgatgatgggttctagcatataaagtcaattactaagcaccaatttgatagtggttatattagttgcccatttatttcgcatttcaccaataggatggttgggttatggacagtcaaatgagtaccgatgttcatttccttatccatgataaggatctgcacacacttaggctaaaagtaagccagaaggtttcaaagttataagctagatttgctataacaaagatatatatattatcagtgtgtttcaaagtgcctattttatgtgcaacttgttaatcactttcctaactgtgctgcctttctgacccttcattactgttgggtgttgcacgaggccttt

SEQ ID NO: 13079 - DNA, 433 bp, Oryza sativa
cggcggcggcggcgcaccgagccgagaggcagacacacgatcccggatcccgaacagggaggaagccagagggcgaagctcgcaggaacaggccaacaaggaagcgatggagacacggcaacccaggagcccgcgcgacggcggcgtctagccggtgaccggcgagcgggatgcggcggtgagacggtgaggtcggaagggttgcggtttcgtgccttgctcttgttggcgacggatcgggccgagcaggtttgggccgagaatttccgcgagcggatggaaaagctttgatgggccggagcggcaggcgaagcaccggcccagcatttctgggcaatccagaagtgccggttgccactgaacagcaccagattcgcctctccctcccgaggccttggccggcgcgaggtcgaggagaggaagctcccatggc

SEQ ID NO: 13080 - DNA, 1146 bp, Oryza sativa
attcctgcagccctatcctgcttctgcttgttcttgccacaaaatatagtgtaaacccgaataaaatattttctttcagttgtcccaaaatggatacctatggttgtctttcccctaatttattctttgatgccaggaaaccgaagctggcagtttacaatcgtaaacaatcaatccaatctcctcagcaagtaggctacttgaacctccttggttagcggcatgatcctgtagctgtacagttcagccaccaaactgggccttatcttgtacattggtggagcgccgttgtcttcagcgcctaaatccacctcctgtccaaagatcttagccttagcttccaccctatgttcaatagcacgctccaccgtttcataggtgaggaggtgcattagttgatcgcagtcctgaaattcccagataaaaataattagccgcttgcataatagactcaactttgatatgtacctaaagtaatgtacaagaaaacacatggaatttatttgcttcccatgataaagacagattatacagcaaaacagaacacaaacctgtgctattatcgcaggcatgtaagcttcaggagactcttgaaacttagcctctgccacaaacttaccatagtgaattcttttggagagcgcctggatgatagaacaggaaaacaagaacaggtgagcataatttcccaatataaaaatgcctaattgcacgagtcaccagtgaacaacagtatagtactaatactatgaaaatgacatctggtgaaaattctggcagcagaacatcttgaagcaatactacaacaagaaatggtttacaagaattattttgctaatgctaaattattttgagcaaatgaaagctacagcacagtagccagaagcagtacgaggccagattattagaacatttggtatactaactgtagtacctgcaagcagatcgtgtcacaaagagcactggatccataattaccatcacttccttctttcactaatcttggaagaagctcatcaaaatacattttccaaatctccttgttgatattaatagaatcagcaataggatgcaaaacctagaaaagacaagaacaaaaatatgaattttatccaaatttacttataacaatacaacagcacagta

SEQ ID NO: 13081 - DNA, 7174 bp, Oryza sativa
atttgtcccttgcaaagaaaaaaaaagttctttggtttccaagtcaattcccttttaaaaggtgcacatgtttatctagaaagttttgctgcgattcagggattgatactacagcagtcgtacaagaaaaataattcaccctttgttgagttttctacacaaagactttggtcaagtcaccagctgcccacgatttttggtcgaaatggcaaaataccttgcatgaaatttacatgtttaagcatccttggcatcacacaatgattaaaaccataatatggattcaactaatcaaaactcaaaactacagtatggctttaagtcaaagctggcaagcacaatcattagcacaatcaactccatgttgttaagaaatcatttgagagaaaatatttcccaactaggagaccaattctcaaccatcaactcgacatcaaaccattcctcatttttcttccgaaccagagaccacctcgaatcggatagtatacgattcatgaatccatcaattaaagcataacgctaacccggtctcgattcgcaaagcactaatgcacaaatcgcacagacgaagatgctatatgctactacaccaccaacgccaaacagagaatcacgcatccgattcattccaagaccgggcaggcataaggagacctcgcgagcagggggggggggggggactagagaagagtttcatacttggtcacgggggtgacggagttgttggtggccgcgagccgcgcccgccgcgacgacgggacgaactccacgcggctggccggccctcctcccccgcgggccatccccacgggcgcgggcgaggcggccctgtagctggagaccaccttgttgaactccatagctcgcacgctcgcgcgcaatggaatccggggttggtagggtggacgtcgtcgggagggagggaggggtgggtaggcgtgggggaaatgaaatgcggggcgtcgtcgtccgcgatttttgtaggcggcgggagagcgaataggagacgacgacgggaggtgaggtgacggcgcggaagggaggggtggggggatggttggcggaggcggaggacgggaggaggaggaggtaggaggaggtaggtgggtgtggggttggggttcgtgggaggtggtgtttggatttcgttacttaacttttatttcatggagttagacactaatttagaggattaaatatggactacttacgaaactaattatataaatgaaagctaattcgcgagataaactttttaaacctaattaatttataattagagaatgtttactgagcatcacatagactaattatgaattaattaggctcaataaattcgtctcgcgaattagttcaatattatgtctaagattatggatgagttttattaaaagtctatatttaatatttataattagtacctaaatatttaatatgatagggacttaaaacgtcccgacgtctcgtctcgtccggtagagaggccggcgtgagaaaactgcgaaaattgggggcggtagccggtaccaggaggacgttaggtgtgtcggggtttttcacttttttgctcccgtgttctcggcggaggtgaggtggcgcgggcgcacggcgtaccacggggttacggggttggtattgtggggtacggtgcggcgcgtggtgtgtggcgcgaggagggccgggagagcgtgaggctcgtcaccacggcacgcgtcagcttcggcctcgggtttgaggcgaggcggaaacgaatggccaggtccaggtctgaatagtttctgctaccgtcaactgagacaaaacacaagaggcaccaaaaacatgaaaagtgttttaaactcctgatgtctccgtttatttttttaaaattcttcgagtggatgccctctaatttattaaaacactatctaacatttatgatatagacataaactacttttaaaaaaatcaagtcaaaactcaacccacacgttaagatattatcaaatgtgtagattgaatttgaatatgatttttggtgtagtggtggactttaatatactcgttcttaaattatttaaaattatacttgagaaaaaaaattatatgagagcatattcccttgagagtgagagattagaatcatcccccctcaaataaaaaagtgctcctaccatgtgaacgacactagtttgctggtcgtgtaagggtattagttactccatccgtcccaaaataagtgcagttttacactatttatctccaacgtttgactgttcgtcttatttgaaatttttttatgattattatttttattgttattagatgataaaacatgaatagtactttatgtgtgactaatttttttaaaaaaatttaaatcaaatagacggtcaaacgttggacacggatttctactgctgcacttattttaggacggaggtagtactagtccacgaaacttaatttaagttaaaataaactatgaacctgttctattttgacttataaattagttcataggttagccgctacacccctacaactgtgtaccactccatgtttgtcgttaggattggcttttttagacataggggtacggattaagaagcaactagtctaacacaacggaatctatactactagtagtgctagtaggccattagctgtgcaaacactatgtttagtttatgtgctaatttttttaagtatatagacacacatttaaagtactaaacatagactaatgacaaaacaaattacagattccgtctgtaaactgcgagacgaatatattaagcctaattaattcgttattaacaaatgtttactatagcaccacattgttaaatcatggcgtaattatgctcaaaagattcgtctcgcgatttacatgcaaactgtgcaattagttttttttctgtccatatttaatgttctatgtatgtgtccaagcattcgatgtgatggaaaagttgaaagcttgaagataaaagtttgaatctaagggtgtgtttagttcatgctaaaattgaaagtttggttgaaattggaatgatgtgacggaaatattggaaatttatgtgtgcaggaaagttttgataggttgaaaaagttataagtttgaagaaatggttaaaagttaaaagttaaactcggcctaaacacggccaatatgtaaaagcatggcatcctgacgatatccgccgcttcaaacgtgggaaggttgtccctgtcacgacgacttggcagccggtcgtgcaagtggggattctacgacgtttttgcactcccttcttctcaggcacggcagagtttatctagttctagaaagcggcatttcaacatcagcaacaccaacactgccggagcatttcttttttttttttggggtcttcccttcttattttccctgagcgtagaaaattctgtggtttccagttttccacggaagtaaattccaattttccaatagatgtacgtcaaccctttgcttcctctccagctgcagagttgcaggtttgacgaatgcagcttatctacaaaattcccatcagagggaacacagttacagaagaactaggggaagtacagattgcaaatccataaggatcttctttagaaccgtatacgtaaagggcttcatggattggccactatatatgggtgtcaccctcaatcgtgaatctgcaaggtcagatatcagtatatcaaatgcagattgcctcattgcagattgctgtggattgttcaggttccgggttagcccagtcaccagtcttcactgacattagcccgctgtggttacatcagatagtaacaagctccttcatcatttcggaattcagtcggtggtaaggcatcggaaatggcatcaaaacaactcttgctgcctacctgaatgtatcacgcagggacagattatattaagtttgtgtccacttgccaattaaacgaacgcctcattataagtgaaaagctcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctatttataaacggggacagcattagttcaatttgaccaaaaatgaaaaccaccaagcaaatgaagaactcaaactcactttctctgatatttcagcttctgcaagattttcttctgcaactgaaattacacagacataacatgtctcaaaatggcgcagcataggcataaaacagtaagtgaagatggatttgatcaattgactactgcatagcctactatcttgccttcttctgccattttacacaaaacaagattgctcattaaaagttacagatctcaagatagaatttccaccagtggtcatgtctatcaaaatagtggaaaagaaaaatcaataccatatgcaacaaggagttctggatcagcatatacatcaacaaggacctgcaagatttcagcaatgaatcacagaggatcactaagcatctcaattctcaaaagactaaattatgcaaacacatcagtaattcagtatgcatgggcactatcgtccaaaagaaagcattaattgcatagagaaacagtcaattgcaggctaataaaattgcatcatgaacggcctgattatacccaaaaaatccaaaagggaggagaaaaaggcaatgatgaatatcaccatctcaactccataagtgagtttgcaaattaagaacaagaacaggtaggtattattacacataatcgccatccatgatagataagtcacaactgatgctacatgaaggaaatgatatttctatgaactatgggcattgaggaactactaaatcggaataagtcaagcagcatttacttgataaaaaggttgattcggtcctttggacaagttttccacatttgctgtctccatccatgacttggattcacagcacacaggatccatgccacaaatcacagctctatatccttcagcaggtgatgttatcatgtaaaattaagaagagaaactaaagtgtgttcactgaagttaatatttgatataaagtgtgcttcaacacatgcaaatgttccatttaaggataatggcaattatgaaaaattaacttttcatataaagtttgaaaagaaattgtagtagttatccattttctgaacagcttcagaaataatgtgtgaacaacaatacgaagtaggtagtatagcagtactcaccgtgtaccttatgacgtactttctgccctagtcgaaatgcatattccacattttgatatgcaagggccttagcggagactgccagagactctgtctacatgatgtttgaagttaatatgttattaacacattaccatcacatggtcggtgcactacagttttgttgtacctcaagtttagcaatttcatcacgcagtgcagctgccaaagcataattttcactgtcaacagccttttgcaaatccgcactgaaacaaatggataaagctaagtgatctactgatctctcaaatgaaccaatgctacataacactggaacatcatggagaaatggaaactattaacataccgcacgcgtaaaaggtttatagctttgtcctgagcttcagtctttgatgagcctcttttagcttcacgttgcctaattatctctgtttcaatctagacgaggatattttctttagcaagcctcatacaatgaattcatttatcttcaagtgaaatcatttggtacctctgtgagtttttccctcaattgttttgccacatcaaattgctctatattcaatgcatactggtaagaaccaagaaattaatagttaggctggacgtgcatagataagtatcaaacatttgcatggaccagtagccagcaactaagaatgatgcaattatcatgatggtagatttcattagccgattgctactagtctatggaattgatccgtgaaaaaagaatcgttgccggctggattggtaactttatttgctttagaaaatgatggtaaggaagcaacaactcacctgtattcgggtttgtaggtccaattggaagtagaagattaagatgtcttcgttagcagactcactgcgttccagccttgcattactactgctacggtcatctcctccaaatagccatttagcgttagttctcactgtagtacccatttgccttctattggtcctcatatgtagttttttcacacaccaacgccatgagtacgctccacatgttattgaatttattttgtaaaacaacctcagatcatccactgcaagacaagctggtctaaaacatgatccatggggcgaggaaattgaaccacatgcaaaaatgccttgcattgtattggtatgagatttgaccagttcaattcccacaactgatgtagtccaatcaccacactgacagttgcaatcagcaagccagtggcatctccagctgcgcagagaacaaaaacattttgcttaaaactagtacaaaatgcactaggtaactaagaaaggctttgaattgtggcatctaaataattacaaactactattaactaacaaactaacaagtagtgcctggaaccctaccatatcgtaaatgtgcaataaacattttactatcttcttttttttttgtccgtagatactgatcaatctattctgaattattgaaggtaaatcgcacctaacgtggtccaggcgagtaagcaaagaaaccctcaaactctttggaaataataaagtgctagaacctaccagtacgctttgtttcgagtaatatctatcagtgctctctactatcacgcaaaaaaacaaaatcctcaaaaactaatgggttatacgggagaggtaaggggttgcccgcagcaagataaaacgccagaaaaaaaaaaaagctacgaaaccaatcaaagaagccacagttcatcaccaaccgaagaaacgaaaccaatccaacccttttcagaaggaagaaatcctaatgggactccggtctacgccgccggccatgtagcgagcgtggagagaaggatagataccttttctggccgaggcggcgcgcgcttcggtgggaggaggaggcggggaagcgtcgacgagtctcggcgaacgggga

SEQ ID NO: 13082 - DNA, 3754 bp, Oryza sativa
ctggaacaagggacggggaggagggcgccgtaggcgccgacgtcgacgtcgagcaggatggggtcgtcgccggccacgggagcagtagcagcaaaagcgatggtgggggcaggcggaggcgggggctgacgacgatgcctcggcgtggaagccagcggccacgggagcagcagcagcagccgccgccgtcgcccgcacgccgttgccgcgcgcacgccctcgccgccgcccgccctcgccgcggctgccgcccccgagcgcacgcccttgccgccgcccgccctcgccgcagccgccgccgcgccgcgtgcaagctctcgccgcccgcccgccctcgccacggcggccgccctcgccgtcgccatcaccgcgccttccgccggagccgccgccggagccgcgcacgccgctgccggaacggtcgccgtcgctgcacggtgcttgacctgagcagagctgtgcttgcctgcttggatccttatgagaaagactacacaacggtatataccacttatccctcatgccgcgaccccacgtgccggcttctcccgagtatgtcgcatgctgctaggattattatcacacaggtttgctgtgtgtatcagtgtatagtcttgttcctgacagctagctagtacctagcatgcctaagtcatgcctttgatactagcctagctggttgttgtgcatgccaaatccctgtaatagctactagtagacctgtaccctagctatgtagggtacttattatggaggagcctagtagcctagctatgtgtctaagatgggttgcatctatttgttgtatcctataccatgcacggattagaccggacaaataattacctagattatacatggatacaatggattattctaattagatatgtcatgttgggctcttggttataccacatcttagaaactctagtatgtgatacatagatgctagattatcatatatgatatccaggtattgggtcgaatacctaggtaccaagtatgaaacctataaatacaagatctgatgctgagttatttggcatgatacctataagtaccggatctgataactaggtatggtgtctgatacctatgagtaccagattggatacccgggtatcgggtatctgatctcatacctatgagtatttgttccaatacctatatgtaacgggtcggatacccaggtaccgagtatgatacttatgaataccaagtctgatacctaagtatcgggtctgatacctatgagtaccggattcaatacctaggtcaggtttgatacttatgagtatcggatccggtatcgcgcatgatacctatgagtattagatcggatacccgggtatcgggtatctgatcttatacctatgagtactggatccaatacctagataccgggttgatacatattagtagaggatctgataccaaatatagggtgtgatgatacgagacttcagatgtgataccactaattctaatatttatgggttatatacttctattcaacagtcaaataaaaagatggaccatgcatagctaggccagaaagtacagccaaacttgctcacgtgctgctgacatgctttgtttaggctaatgctactagctctagtgcttaattctaactttactagttgaagcaggtgttagacccatatggacctaaagaggtgtagaagtagtgctgtattagagtatttcatagctattttgtattgtaggagaaaagagacctctcgtcagtcatcactagtcggtagcctccatgtgaaaggacagcacacgacacgctttcagagagaaaaagaatcggtgagtgattagtaagtataaattataaactataccgttgagacggtacaccatcccatagtttttctcgatccttatccattcattgaagggtacaacagtaaattaatatttcataaaaagaaatttctatttctctttgtgggacccagtgccaccgaacaggcccatttttaacccaaaactgtgggacccatctaacggggctaaaagtgagggcaaacggtgggttcatgttcaaaaagatgaggcaaaattgcaaactctaaaaagtaggagtaaaacagcagttgaggttcaaagtgagggcatggatgcaattatccctacaatttttggcccaaaaggaggaacgcggttccccgctcatctcgtcgcctgttcttcacactcgtcgggcactcgagcacaggcgcacggctgtcagatatggcaacggaccaccgatttggcattagggacacgggcacacgggcccgacgttagtgtctagcactccagcgtagatgtgcaccgagtgaccgaggccacagagatgcgctgactgcgttgtgctggtgcgcctggtgcctcgtacatacaatacaatagttttgagaccctcatacaatacattactccctccgttccaaaaaaaaacccattcgttgctttaggaagggtcacgttcccttctagattaagtttttttttttttaagaatagagtgtggttgttatgtcttttttttttcttattcgtgtgcagtactgtaatgcattagtactgtaatgcattaggtacaaaatgtctgatgttgttcgagggatgagttcatgagtacaaagaaggtggatccttcttttgcgacaagtagggcgacatcgtttggctgattataagcataagcaaatgacatattagcaaataaaaataatttgtgaatataacgtttatatacgtattcttaacgatttaaaaagcaaagcctacaaaataaactacgatgaaaaaaatcccaaaataaacttcatatttaaggttgaaatgcatattttggctgataaatataagcataagctaaaagataaggccggtagtatctatttgaactttgtgaacatctatttcatttgctacggcacaaagtgtatgtgctagaacatatttttctttatttcttcattaatttcttatggcacagtggcatgatagatatctttgagccctcgttcttgacagtactcaaaaccatatagtttttcctctctttctgcttgaaaatgccatcgatcgatctattgtagccgtttgttctcaccagcccttcgaacggcaatttgaagccttggttcaagatttttcaatagttcttcctgtttaaagttgaattcgaaaacatggaatgagcgtttgacatgtttcataatattagtttggagataagaacataacaaagaaaaggaatagcattttttcagtttataagtataccaattcatattctaaatattataaatagtgatttgatcttttttgtgtgtactacatctcatcttaactcagttcatctaaaaaatatatatattgttctattgctaacctctaaacatcataattttcccattcgttttttttatagcgtgtacatcttttcaaattcattgatgtgtacacaaccatcccgtagcaatgcaagggtatcagttagtttttattgtttctagcaggttttatccaatatcacatgtatatattacaattaagagtagtttaatttacacacacaagaatatatgtaagctataggggtaaacttaccatcaagagggacctatctttcaccacactcaaaatatatacagacaaccaacaaaaatctccaacttgcatgcatttgtattcaaccaacctcgggccatcctggcttaactaattcagacaagcaaacagt

SEQ ID NO: 13083 - DNA, 6029 bp, Oryza sativa
  unsure (1)..(6029): unsure at all n locations
ggtcaagtgaacttccagcaaacaaaataaggttacttattataatgtcgtaggactgttacttgtagcataacaccgagctctgcctcattgtctgctatgagattcagcaataataaccccatgaatcatttgacaggtgatcagctcatagcttcacaatcgtcctacaataatggtgataaaatatttgccaatggatgcttactcccgaaaatgataggccaagaattctatctggaagatcgtatgacggttccaagccaatcttctgagctcgtgtccccttttaaggctctcagtgaatgttctgtaccaacctgcatcagaagtcacacggaaaaaggaaaaaaaagggtcattgaaaattttatatacacaaagtcatgaggggaggaaaaagttaccagacctttgtaatatacacatcaactccaagcctagctatcgcagcagcttccaatattttggtctccattccgccagtggtgtcatgtgcagctacagatatctccactgcaatgcatatcagattatctttgttaggattacacaagctacaacatacagtttatctttattatgctggtcaaaagaacagtgtgtctttatcatgaatttcattagcccctggcttaaaagattatagctttgatcccaatactcatatttcaaactgtcactcctccataagtatagtatttgatccaaatcattgagacttccaattttctctgcataatgcgtaagaacaaatgatgtatttgttcattagaagttattaattgaaaaatcgtcaccggtagctacttaatcatgtgcctgttacgatctgataattttttatgtacttgaacttgttacaacgaaaatagttgcatcagttactcagtacaactgctatgagtaactcaaccaccagcgtacacatggaaggaagacataaattatacctcctttcttgttgcctttcaatgctggttttacaatcgaccagctgccattttcatccaccgctgtttaaacaggcaaacaacacaggtcagcctaagacagaaagcaaatggtaattgcatatcttttacttttcgtgtgctccctacaatttctgatgcatatcaaacaggaattccagtaggtgagtactgaatgctaacctatctctctgagaagtactgcattcgggtctgatggaggacgatcaaatactccatggacatctgtctacatctcaattttcagagtgctatgcaaaagcaactataatgaaggatgggcaacatatgcaaagagtggtgcacagaaatgtgatagaacaaggcctgtctgataagtgataacagcaatacgaacttcaagtattagaataaagacatttcatccatgtaaataatttgatgcacgcaccatctcacatacataatataaattgtcaagtcatggcaaaggtgagaaggcagcaataccagaaatacaacatattttggactcagaagctgtgcaagatggcgtataatgacatccccactcaaaatggtgcagtcctggtcatttaattataccacataagtcttgagaagtacacaaaatgtgtcatagtccagagagacctctatgtaagtgtaaattaggacatgggcgtgattcaatccaaaagctcaccagcaattcatcaagaacagcatctccatgcaaaacctggaagaaattttttatgttctttttaatgtagatgaagaaaacataagtagagctgtggaagtatgcaatgctttccctattcttgaaacatttcctgaacaaaagtttactcatagtatgttcaaatatctgaactaattcattatttaccagtacaaaatctcagctaagttggtatagaaaatgtattgcaaaataggatgcaacttagaagaattaccagtgcacataacatgtgtaatgaatatgttacatactacataaatattccagaaacgccatatttttcttacaatatggatacataagaagtgacccatataactacattacttaatataaaactttagtcgttgtaaattctagagaaataattattcaagattatgaagtacaataacttacagggacaaagccaacatggagtgatagcatgatttgagaagcatccactgattcaagctgtaagtgcaaaactggaaggtaaaaaatcaaagggcatctctgttgataggattagacatagatcttcaagaactttgcaatgtcaagtccatgtccaaagaaacagaagaaatttagttaattgtttgctttctcacatttctttgcttagtagaccatccacaagcaaacggtgacatcccaacagacggtattccttctacagaatcatacacagttcaaaaaagacatttacttaattattagctactgatgataaaccgacagcaatagactgaagcaatgcatcaagatcatataaaagatggatacatatagtggttagttcaggattaagattacataggaaaattgttcataacaaatgacaatggatccttggatggcacaacgggttaagtgaagaccgcacagtaaaattccagacaaaacacatatattctctagattataatggagcatgagtttatgacaaagtaacaaaaatgaccacatagatatcctgatagcacgaaagaaacatgattgtgattcaaatatgaagagtggtccttcatctcaatgttgtgtacctcttgcaagagctctaacaatctcctggttgagagaagtgacctgaattgtaatatgcagatcataagaattatttttcaagcatgcgcatcaaagaagcactacatatgttgacgatatactgggcaacaaagatatatctctgaaagtaagatggagaaaaaaaatatagattataatatgaacgtgaaaggagaacttcaaaaactagccttactgaaattcttgtagccacaaagccagccttcacaagtgttgaatgaagaccccctttatggactccaatctacttgcttggaagtgaccaaaagaccctgaggtagcagatgtaggtagtcagctattacaccaccaaaatcgtgggctgtatcctttaaactacaacaggccaattatagtcggccagtattacaggcatcatgaagtgtgagctattttctttattctcccctggttgcctaggactacattttcaaatcaaatctttattgatgcagtggaaagtcctaagcaggaaggatgctgagaagctggaggccatggctagcaaacttatggaagcagtctcctcccttggtcctcccagagctggagtagggtaagcactgatgctttttctgtggtgctgttggttagctgttatctgttgagttgtttagaggtgcctgagttgtcttttgcttttggtcgcttaccttcaacccctttgtatcccttggcatggtttggtttctgccctgtttctgtgtttttgtgctgaactcttgtaagtgggtctcccccaccactgtgccgcttctggctttctataaaagccgggcccgatggtctatgatctaaaactatattttcagggtgtctaccaatcaaaacagatttattcaaatatattccacgaaggtcagctacgttccgaatatagaccggttaagcaggtcgtgaacaatgtttacaattgcttgtcattgatacacattgagaatggtacttggttcacagtttcgcaccaaattttcacttagccgtagtagtattctgaaaccaaaatacagcaatcaagctgatcctatcgtctccagatcccaaccgaccaccgatcccccagttctgctcatgaactcatcagcaatacaaaatgacagataggcacagttgttagttcagatgaggagccatgcataccggcaccatggacgacgacgaagttggagtcgagccccaagcctcccatctccgacaagccctccacatccacgaccgggccggtcggatcgccgggccgtctgctccagtccatccccacaaccttccccgccgcgccgccgtgggacatggcctgccgcagctgcgcgcacgccgaccgcaagctcgccgcgtcgatgctctccagctctcccttgttcgtgatggccgctccacctgcgccatcgaagctgctaaagaggagcagagaggaaacaagggagcgacggagcgcgcgcgagtaccgagtttgacgatgcagcggacggggcgggaggcggcggggtcggnntgctgntnctgnnnccgctcctncgccatgggagcttgctcttctttacctcgcgccggccaaggcctcgggagggagaggcgaatctggtgctgttcagtggcaaccggcacttctggattgcccagaaatgctgggccggtgcttcgcctgccgctccggcccatcaaagcttttccatccgctcgcggaaattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaatgaggctgttgaaagcggatcagttgttcaggaaagtcattgacggcgggtggagaaagcaatctcgactgcttgggcttgacgttggtagtaagtatgttgggctggctgtttccgacgacaaaaataggatcgcattgcctctaaggtatgcacttcaaactattgtagctgaatattgtgttccttgatccaaaggtttcactgagatagtgagatgtttccagaacatatttagcacaagtgattccagtgtgtccataaaaattagaacatcactttctatgtgatgatttaaatgcaggcggttctatattccattcctctcatggattagtaggaatgttgagtttccaactcatttcaatggatcggcattttttgttgtacttcattcaaatcattatcatgttggattggaatcttccaactatcagaatttgtttcagtttgtatggtctctggcttttgtaagacagtctattattgtgctgtgtctgttgtattaggtccttctctttgattaattcgactatactaaacttcggtttgttagaaaataactgtagttgccttcaaactttaaggaaaattatttgcaatttacaatatatcgatacacaagatcttatccctactatcatagtgtacctttattatttttaaaaatattagtctttaacatatttaagccttataaggcttttcttcacgagaaattcttcacttaccattgttaagatggacggactgcacttggctaaagctgatatccttttacctacctaagcactcagacagagtggatctagatttgctgaagtatgcgtttatctagaattttgtggtcattgtctgcactgctagcataaggttatctcaggataacacccctgttttatcagatattgactctcttgaatt

SEQ ID NO: 13084 - DNA, 5706 bp, Oryza sativa
  unsure (1)..(5706): unsure at all n locations
tttactgacatttanattctggagtaatcagattgtagaatcacttaccaaaagatcgagttcttaatatgccatgtaacatcatcctacatcagatcgagtgcttaatgtgccatgtcacatcatcctgcatggctgcatcgcatgcctgcatactgcacaagcaattttgtagcatgtgtgttgaggttacgatgcatttatggaagccagggttacaggccttctctaatatgctgttctttactgctcaatttactcatgtcatttacatttccaaaatactcgagggtgacattgtccacaaagaaatcataaatgatttagcaatagaagttacagacagctcatgatgcatatattctttcattttagattctggtgaacatttaaaagcactcatgttttgctatttttcatacatggaagccaattccttttctttgtttttgtgaataggtctcaaaatactcccttgcaggctttgttgtcggctatccgttcaacttgcagggtcaatctagtccaaatgtaaagtgctcttgtgctgggagcctgggatagtgcacctcattttctcactatatgtttggtgatgtttcctttttctattaagcaggcattacaagtaaggcttcttgttggagagctctgtaaaactgggaaacttgatgatatgagttacacctattgggatgaaaattttacctcgaaggtgatggtacttttttgcccattatctctcaaacatgaaactacatattagcatggggtgcattactcatgtgaccattttatcctacttttcaagtacttttttatggtgaagtgttttgattgatctgtttatgtctccagtgtgtagaagcccttttacatcctctgaaactacatgacccagttgaaaccaaaacaatgacagataaatttgctgcggtttgcatactccaggtacatacaacaaataccaaatgacgtcattgtagacttcgttgtttcgattatgtaattattattgaaaaccagtactcatagttcatttagctgaacatctgcttagtgacattgactatcatactttgttttcctaaaaagatttttactttctgtgcagcgctacctagataatatgaacagagaattgagatctgcagataattctggaaaacagggtgacacctgagttccacaatgcatatattattctgttcggtgcacactaaaccaaagacaacggaatcagcatctgttcggtgtactgctgccttagtgtactgctgccttatgaaaaaggctgtgcagttcattgagacatgtacaaaactctgagtttatgctctcgtatacgcctgataagttttgtagatgcagacttgcagagctgacaattcgtcagctagcaagggcagcttccctgcctgcctgctagaggcaatttgttgtaggtgatgcacaagtactaggaatcttttcccccttcctttattttcttgcttatgaggccattggcaccgaaatgcctgcttatgcgcagcttgaacaatctcttccaatatgattgccgagcatgcgcgtgtgtatatgagcctctattgtgtttcgggaaaaaaaatgattgccgagccaagaagatgcaatcaggctgtcgagtcaaatcaggttgataatggcgtgctgcagccagattccatttcctatgtctgcatgcgcatgcttagacaaaattcaccgtgatgttaacaactcatgtcattcgacgacgggcagcttttgatcattgtcacatccctgatacttgtaaatcctcaataatgtttcctcagttgtgcatatccgtggcctgcaatgctccgtgcaattgttgaatctgtttccagaactgatagcgtaaggaattgtatgaccatgatccttgctgtctggttgcaaaagattgaaaattctactctacaaagcaagttaggctgacagagaatcttgtggatgggatgaggtaagttcacttatccaattagtttactactctataggagacaataggtgaagaaataggcacaagagctaatgtgcagacttgtgctgctgagatcgtttcagacttggacaaacaatgctatgtggtttacatggactgcgagtctgcaacagataaaatcaccaatctacagctgtaatctgcattgtccgtttcctagggttagcgtaaggaattttccgatgtttctcccaggatctcagtctcagtggctgagatcgctgctactacctacacatgcaaaagatcataaaattcgattctatcaagtaagttaggctcatgaggaagtttcagaatacaggtaactacacaaaggagttaaacacatcacacagcacaaaagaggagaaaaaagagagaaaattctgaggtggtaggcacatcacagcacagcaattaagcatgaaacataaggggagcaagcaggtcggcgcagccacttgtcaagttaacatagctctcacgtatgcctgcctgcttccatgccaaaagtctactacactacagctcaagctactatgtatctgcctatctcaagagcaggagacagtggtgagcacagcacgaaaccaaggtagccgaaccatgcaaagtcaacacagttgacaaccagcaatagctttgtgcaaaagagatttggcagccaaggaaagacaggtcaggagctcacatcaccattggaagtcagccactgatcgtaccgttgttatttttagggagccgtactgtctaatcagggggagaagagctgatgaaggtgtatactggcacgttggagatggcttgaaggtaaagaagacggctggttcacggtaggtgattcggtcgagcagccaacggttttggaccggaatgcacgagctagctcgatcggcattctcccttttattgtttatatattttcccggttgtttgtttgtttgttattccggcgatttcttgaccagagataagcagtcgtttatttcaaggtctgagtctttgacaatttgtttgtgtgttgattttgttttggaaattgtagactttgactgaaaagaacgaggttaattaatctcgtaatccagtcagagatgagtaattggcatagcgacggcttgcatgaaattagaagttttgttaatttcatattagcaactaatacgatctcctgcctgtttgcactttgcaggaggaaaattcagcaagagtaggaattggaggcagaagttaagcacaatgtagcatatatggagttatggatcaggaacacgtactctccaaaatgatattcagccacatatgcatagtttgtcctatttaagcttccatgaatactaaatataatatattttttcggtgcctacgaaaataatcaaataacgacccctgttggagtattagacaaaactcatacgtggttagtccatactacgtgcgcattattggctgatggccatagcaatagcagaacatgtccatacactgtacatgaaaatcgtgatcgaactctgttccctttactgttgggcacctgcagctgcagtatctactataccaccaaacagtactacccgtctgcatccaacgtgcaaacttcggtttgtccaccaccgggacatgtacctcgtgtgacagcgacaccaccaagcgatcgatcgagagcacgcttgcggtgaggacgtgaggtcgctcgcccggatgagtacaggggctcgaggccaaggagggggggaaccaaacgtgtgacgggaacagcaacgtctcgtgggggcagccccggtcgagccgaggcgcgctggcgctagctagagtccgtagcgtttggtgatcgatccgacggcctgtctccccgcgcccacgtcgtcacgcggtgagacgcgggcgctcggtccacacacgcgcgcgcgtacgtgcgtgcgccatggccaccatcgatcgcggccaccggctgggtgatagccggtgcgaggggaaatatccggaaggaggctacttcctctgtttcataatgtaagtcattttagcatttttcatatttatattgatggtaatgaatctagatagatatatatgtctagattcattaccatcaatataaatgtgggaaatgctagaataacttacattgtgaaacggaggaagtactatattacgagatctcattcgagataatatcagatatattgatacgatgttaaatctagtatcccatactgaaccatacccgttaggtctcagttgataccttattagtaacagaccgacacctatcgatactaaactttttacccattggtataaaccaatacccattagctatcagatctagccgagagaaatgagagaagaaaggatggagatggtagaactatgatgctctccatcctccctcaacacgaaatgaatatgacaacgatgtttcccatcatctctctgcggagggcccgccatagacgaggccgacacggagcgacctcccgtccgattcacccaccatccctcatccccccccccaccctccccccatttcccctcccactcgaagagcaacgcgtatagcagagaaggtgttcggtgcaacgtaaaaattgggtggcgaccaaggcgagcacgtggcgtcatggagcgagggcatgaggaggatgagtggggtggagcgaatcgtcacgcgaaggataccttcctatttcctaatgcatgggtacataatcccaatatatagcttcatttgttttttttttctcccaaaacaaattgagtctggatttgaaattttgtcttagcaacttaggaagaaggaacttgaggtttttcaattcttctctcgcatgtccatgcagtattcgaatcgatcaagcttaaaggtcggttgtggtcaagcgtaggcgtcgctcatctaggagtcttgttgggaggatcgtagtactcttttgatactttgccagtttcggtcaatggtttcggagtctttactccctttagagttttcttcttccctagtcgtttccttgtgttcccttaacaattgtctctggctgttgtattgtgtaactgaatttcggctttattctaatatattgacgtgtatttttttcgcgtttgcgaaagaaacgacttgaaattttgtggatgttattttaataggaactttttaaaattttagagagcttttataacatggtccacggagtttttcatttattcgatactccgtattattttttaccggatattttcccgggaggagaccctcgcgggcttttgtcatgccgctgtcccttggtcccgaggccgcagagccgtgctgtcccctccctccgatccctctaagatcgatcggtcgctcgaggccggctacgttagtctcgcctcgatcgatcggtacgggtacactcactggctcaccccactgcaaaaaagtcaggattcgacgcttcggccgattatcaccttgcgatcgatcgacaactcgggggttgtttcacgtgtacgtgttgagtccccgttcacgcgtggactagtcaggaacaggatacactacgtactacgtacactcagtggccttgacaatcagagacaatgtactaagccattcgatcacacctgcatgctgatcagcgagtcgatctacgactctctcgcccgttcgtcgtcgtgaccatggtggattaattagacgtgcaaat

SEQ ID NO: 13085 - DNA, 238 bp, Oryza sativa
gatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttat

SEQ ID NO: 13086 - DNA, 1095 bp, Oryza sativa
gatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctgcccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggtgttgagaccatcctttgtagtacctgggttaagcagtattcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgacaccttgggagaaatctcctgtgacccatgtagaccgtcttgtgtgaagcttcaaccattttcttcttgtttcctccatacactccgaacacgcccatttccctttcacagtttggccagaaaggttgccaagggacggataatcgttg

SEQ ID NO: 13087 - DNA, 356 bp, Oryza sativa
ccactgatcactgaccatgcgcgaagccgtcaaagatgagggtttgggcccgtcacaggtgaccttggccagtgtagtgtatcctctcgggcaaaagcatgttgttttggttgtattgctgctggtggctccgactcagtctgcaagaacacttgttgtttcccatgtattctggccgattctggtaaattcactgaagtcactcttttaaatgcacttcttatatgtagatacagactttgtagcatatcgtggactaatacatatgtgtggccttccatgcattttcatcaatatagtttgttgacttcacatcccatctgacaacttcaggcatatatcttgcaacatgaaga

SEQ ID NO: 13088 - DNA, 800 bp, Oryza sativa
aacttgtctagtgaaacacttcagtggttgtcacagggtcctgaatggagtgccaccacctggcaaggatatgacataaatggatacacctttcacacagtaaagcaagacagcaaatgcacagtgcagaacagtgggttacgcatcgaggctgctagtgacggtggtcgtcgtgatcaatactatggtaaagttgagcaaatattggagctagattacttgaagttcaaagtcccgttgtttcattgtcgatgggtcgatctttgcaatgtaaaagttgacaatgaaggtttcaccactgtcaacttggctaacaacgcgtacaaggatgaaccgttcgttctcgccaaacaagttgttcaagtgttctacatagttgacccatgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccatgaggaaggattatttttgtaatttatgtacgtagtttatgtctacatgtctgttatctgtatgactctaatatgtacgcaatgatcaatagtatattgcttatgaaatagtcaaataaaataattaagtataaaaaaatatgtagtgtatgtgaaaatatgttaaggaaaataaaagaactaagtgaaataaaataaaataaaattgctctaggcaaactcacctgtgacgggctctatctgtagggc

SEQ ID NO: 13089 - DNA, 6319 bp, Oryza sativa
tccaccgctgcctcgacctctccactgccgacctctctgccgctcaccctctctgccgaccttcccgacgccggcctgcaccaccgccgccgcactcactctctcgaccgccgccatccatctccaccgccatctccaccgtcgccgtctcgacctctccgccgccatctccgccgccctctctgccgccatctccaccctctacaccgccctctccatctccgcctcgacctctccaccgccctcctcgccaccgccctctccactgctgccgcctcactcactctctcgaccgccgccgggacctcctcttagtcgccacgccaggaccatcatcgccgccaccgggatctcctctccgccacctcctcctctcgactgggacctccacagtgcgccggccgggactcgtcgtcgccgtgcgccgcctcctctgctcgtcgtctcctctccaggtacccctctctctctgatgccgatgaatggaatggtggagttaatggatgaatgaatgatgcaatggaatggatgagattttgttcaatggaatgaattgaaaatgcatatgtataattgtgctcttttcttgtcattccatacagattgtgcactgtatactgctttatatgttgttttgttcccttttgctagaactattgaattttggggataatgtttaccattttttttagctgaaaatgatggattaatagattggcaacagtgtggttagataggtagggtagctagctagaaatagtttgtctagctagctagttaggggtaatgttcccttttcctataaataaagcatatacagggtttgaattttagttcaaatggatgaattgatagattggctgtagatttaatgtagttctgaggttatcaaaccatcacagaatacaaaatgcatggggaatttttggtggattggtcagtgtagtccatggacggaaccgacctagacaccaaaattctccatgcattttgttttctgtcattctttgataattaaggaactttattaggtttagggtttgaaatttagttcaaatgaaagaattgatagattggccgcagattacctacacttgttgatttatatacccttgttgtctatgaataggtgaattgcatgaattgttgtttatatacatgatttatatacccttgctgtctatgaataggtgaattgcatgaattgttgtttatatacatgatttatatacccttgctgctgctgccacataaattattgtgggctgttttattatctacacttgcctctgcttgataaattaatggtgggctgtgatgaatgctcaagaacagaaatacctctaaacttgatctttttttaatgcataagaacagattatctacacttgttctttttttctgcataagaacagattatctacacttgttgatttatatacccttgttgtctatgaataggtcaattgtatgaattgttgtttatatacatgatttatatacccttgctgctgctgccacaatgattgtgggctgtttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgccccaccacttgttcacttgttccttattaaatggccagtgtagagtggttatatacctctacacttgttctttttttatgcataagaacagattttgtgcacttgctctctttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatcgccccctgctgttgctgcccctgtggcatatatacccctactgctgttatatggccctgctactgctcttattgctgctattatatggccatgctgttgctactgctctaatttcctggacttgctcttttctttatggataagaacagatgaactacacttgttctattttatggataagaacagatgaactacacttgttctattttctttgggttgctttttcctcctagtagctgatttcctctttttatcccttcatgcaaatgattgtaatttatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatctataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaagagtttagggaatcaagcgaggcacatcgcctactgcaacagcggaatgagcacccgcatcggctgggcaccgcagggtacatcggcaaggaggcaatatgggcacaagaagatgcagccgctgcagcagcgaatgtccctgccccgttttcagccatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaaaaacatcctggccgaactcggggaattggtagcgatgtgccctggaagcatggactccctcagtatagatcccaatacaggaaacgaaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccatcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggtgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcggtgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggttttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcaaaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccccccccccccgctatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacaggttgtggaggtcgagtacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgtttgagatggatctgtgatgttatattgggggggtgatgtatctgtgactagaatatatctgtaatgtatctgtgtttcagagggcatggctagccaatcctgaggctagccaatatttagcat

SEQ ID NO: 13090 - DNA, 2855 bp, Oryza sativa
acatgattattattatttgtgtgtgcatgttctttacttaatttattcttagcggatttctgatgtttttgtgagttttagactatgggagataattaagattgtcatgccaaagagtattccgaatcctactaggaaagcaaagggaggggggaggaaacatggtcaatttctcggctgctatcacattccttgtattcttagtcttgggagacatatagccacgctaaaggcaatacagccgaggaatggcaaccttactcacaaggacaaatagtcattaaaaaattatgacagcactaaccatatctaatttcagttcaccaaacatacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgcagtggaggattccacatataatttcatagcataagtacataatacaatatggtataatacacatatgcgcagtactttgaaatatgcataccaggacatatgctttagttcactccattcattcttgcattcttgcacattcaacatcagtcagatctaccaagcatccttgtacattcaaccacaagcagatctaccaatgaatcactaacttatgtagcaatgggggaaatcggaggagaattaaaaccattcctcgtcagacaacggaaggacaggaggcggcagaagattcaccggctgcacaccacggcgcgcgaatccctgaggtgtgggcatcgcatctatcagcaccaacgacatcggcagaggcaggggtggactggggctctttcgtagaccgatgtaaactagacttgttggcttcgttttagggaggggagggaaaagagatagactttacccggctggcctttgggcctgcgtggagagggataggagttggcttggtttcagccatggtttcagccaaaaggtaggaagaggattttaaataggttgcatatgcatgctttgtctaaagaaaattcctaaaaataaatgaagcaacaataaatcccaccaaaattctcataaatactaaacaacaccctaagctcccagcaattttagtttgaatttatcacatcaattgataacccaaataaatccttcaacacagctaaaaatctggaaacagcataccaattagcctagtttgcaccttcaccaaaattaaaccataactcctctagcaaaatctcaaggtcagaatgttaaacatactttaccatctggtgcaatggcttagtctaattcaaaatgtaaccacatgaaatgtgagccataaattacgtaaactttggaacttggcaccttgaaccatcaaatccttgtctaccttgccgtctccctgtcccccaccccccccccacccacccccctaattctaaattaaatgtatgagagaaagagagtaatatagtttagtgtgataatgccaacacatggaaaatttagagcttctagttctctccttctacatctctcttaaatgtgggaccaagtccttgtggggcccactcatcatacaaccatagccaacacatcatctgctcttctctcatttaatttttttttatttctcaaaaggtgagagaacggtttaaattcaatttccactcaaaatgccactctaccactccaagccttctaggaaagatctatatatgggcccatttgtcgtccaaacacagcaaaaaaccttggtgaatcatctctttgatcctaaattatattttcaaagagagaaagaaagagagagagagagggagttaaagtccaatttacacccaaacttcaccatacctctcatcttctcataggaaacatctacaaggggccactagacagccactcatgctaggttgagtgaagtacaagtgggatcacagcgtcaaatcactgccaactcctttaaatcgtttctacccctcgtgttgacacctagctctcactttccaccttcactttcaccattcactactacaaccaagatttttgtgtcagggctaaaatgatttttgcgtgccggtaaacggcccgcatgcacttaggggtctgggaaaatgacgatttttgcgtgcaggtggcgcacccccacgggaaaacaaaaacccgaaaaaacataaactttctttaaaaatgaaaccctagaatctggtggtggcgccgccgctcctgcttgccgctgccgcctcctcgtcgtcatcatcatcgtcagcggcggcctccacgccgctcgcctcggatctgtgctcccctccggccgcaccgccgccgacgcccctcccctccgccggatctagggagggaaggaagaggaggggaggggagctggatgccacgcggggggagggcggccggccgccgtatccgtgcggggacgaccgccaccgctggatttttgcgttgatggccgccgccgttggatccgtgcagggacggccgccgcccgccggatcccacgccctccaccgccacaacgtggaggaagccggcgcgcgcctacgcccaccgcggctgtcgccgcgcgccgccgccgctgccgccatcgggaggagaggagaggacaatggagagaggagaggagaagcgtgagagagagaggactgagaggagaagctctgcgtggaaattttaaagttgaaaatgggattgaggggaggggagaggagagaaaaaggagaaattttaaagtgtgtgagtgggaaaagagggagttagtatttttgcatgcggctctcttaataggtccgcacgggaaaatcg

SEQ ID NO: 13091 - DNA, 27794 bp, Oryza sativa
  unsure (1)..(27794): unsure at all n locations
cgattttcccagaagcaacgagttgccgcctgcacggaatctaaaagggtccctgtagtagtcattaatctagccaactcgccactgtgaacctcatctatttctcacagtgttccactatgcaaaccaccaaaaactacctcggaatctccaagaacttccacttactcttttcacctgaaggagtttcatccatcgcatgtattctctggtgagcttcaccgcactccaaccatgggaacgtgaagttccttctctacctaatcaatccattttctttgtttctattttggcatagatcgaacagttagtgatatgctcgtcggcattcccggtgtccatagcgccgccatcgccccacttcgtcattcccgtcgactcgaaccatctccggccgagccattgcgccaccgacgtcgcctacgtcccaggagaaagacgcccaaaaatgatcaagccaatacgccgccgcgaacgccattggtcgccgttgccctcctattgcctctgcttccctagccgccaagtcaccgacatgtgtgccccggctatttagccacttcattaggcgtaaggactttcattagtagaaatttaaatcttgtaaggttctttttgtaaaattgctttgtatgccatgtgggcctatggacctaaacgcaattcacctaatgcccatggacctttttgtatagggtttagggtaagtcctaaaccctactcagagattactatttcatgcattcattacttgatataatagcttgatgagtatgttgtactcaccattgctttaaccctctctttgagaatcaatttggagtttttgccgaaccatgagtttaaacatataaattagtttcattccaacttagttcccaattatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcagttaccgaatcttcaattttgggacctgatgtcacgcccggaatttctatccaaaattccgaacgcttacatgtgtgttaaaccctcgtccaggaatcagccgaggcacacaataacaaattgataatagagtacaaataaataactatttaatattcacaaataataaatcattacagaggtagatagtttctctcaaagaataactttctacgcagcggaaaaataaaactaaaacaaactgcggaacagctatggcgactccactccacagacatcttaactagaacaaacttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaacaaatatttaagagaatagtaaaacagttgagtaattaatcaaaactaaataacaccatacaacacacccatgttgtatagtcccaacctcatttgaacaaccaaccccggttgtacaaatcaaacctccataccaggaatataccattctaaaccaggagtcaaattaattatcacaattaccattaatgaataatatgggactaatcacgaaaaacattgctcaactcacccataaccgcgggtacggctattcgaatagttttactctgatcagaggtgtaccactgtacccacaagacacaatcccacaacatgtcaccacgcgccttagtaccaccacggtacctcggaaaggaactgtgacattacccctcgcacaacacaactcaccatagtgcaccgttcctggatcataatctccccctcaaaaccagaggcaatggactccccagcgacccccaccaacttctcgccgcttcacagtctggcacactataatgaatcatgctatacaaaagataaagccgttgcccacgctggcttgtggttggtacggtaaatgtttcacaacagtagctcgcgaaccggtccttaattgtcatgagcacaaccatgtcacgcccagaaattcactagtaatttccgaacttatttgtgcataaaaccctcgtccaggaatcagccgaggtacacaaactgacaatttaatatacaaatccatcataatattaacgttacatacttacaaaagaaaagaaaacagtagcgaaattaacgatctagcgatggcttcagctccactcccacaggcagctcaactggggtataagccaaacgtcttctccttctggatcctttttcttcaactgaggtttggttgattattgcaaggtgagcatatgacatactccgcaagccacacagcaaatatgcaagtgcacaaggataccaaaggatggcataatatagggttcatttgcgaaagcagcatttagcaaagatttaagagaagtaaaacagtaaagtaattaatcatcaattttaatcaacactgaacagcacacccatgctgctcaggcccaaccaaacctgaacaaccaaccccggtcgtacagatctaacttccaaaccaagaattatccactccaaaccaggagtcaaattaattatcacattattaacattaacgagtagtgtgagactaatcacgaaaaacattgctcaactcgcccatgaccgcgggcacggctattcgaatagttttactctggcaagaggtgtaccactgtacccacaagacacagcctcaacatcatgtctaccatgcgtcgcgatactggaaagtacccgaatagaggctgtgacaataccttttgcacaacacaactcactacagtgcaccattcctagatcataatctccccctcaaaaccagaggcaatggactccccagcgacccccacggacttctcgccgcttcacagtctggtgccccgcaatgaatcatgctatacaaaaggtaaagccgttgcccacgctagcttgtggttggtacggtaaatgtttcacaacagtagctcgcgaaccggtccttaattgtcatgagcacaaccatcaaaaccatatgctcacaacccaccttaactaggttttaattatcaattaattaacatcacacgattaaccatcgtgaactaccatttaacataaccataattaataataataatataatttataattaatccctttagttagctaatgtttctaagcatggctaagcaaacatacatatagcatttagctgaaccaatccaatatataaggttcatgctaatcaaattataacccataggaaaataaagtcatcttcggccattaaataattgggaaaggttcaccacccgatgacattcgaaaataatgcatagttgaaataaaataatagctttaaacgggttcaacatgctcaaagggttgtttaggatctgtgtgacttgccttgcaataatcggtcttcaattagtcttgttgaacactttcgacgcactcacgaaccttcctcaacgaaaacgctctcctccggaacgtcggaaactaaagcgaaagaacaaaataaacaaaacagtaaaaaagaagcataaacagtatatgtggatatttttaacatgtagatctcgattttagatgaatttagcaacttgaaccactcgaatcggagttacgatgatttagttatgaatttccgaagttttaatctatttaatctattaaagaaaaactgaaaaagaggagatgatgacgtcatgatgacgtcatcgacggcagccacggcacgggtggcgacctcgccggagctagggtggtcggccggactaaccaagggcatctacacgtagaggacgacgacgcgatctcaacgatactcaccaacgtgacgaacgacgacggatgacggccggcggcgagcttgtgcggcggtggcgactcggtcgtcggcagcggcgactctccggtgaccggcgacggcgctacggttgacgagagagctcgggagatgggtcaaacgaaagagggcgactagggggtgctatttataggcttggattgaagagatcggctcaggaacggatggatttggtgaaagaagttaggatttatctgagttcacccgaatataaacggccaaaattcgtgagatatataacgaatttgatgggggtttcttcgggattaggtagaggagatagagaggaatccgtttttgcaatcaattttagaaggggatcaacggatgcaccggatttgatggaggaggaggcgacggcagcaggcacaggacggcagctcgggctctgcctggagctggaagacgacactgtagcgagagggaggtagattagactttttgggctgggccggaagggagcaacaaaggacttccaatttaataaattaatcaatgagatgatctttgaattgttaaaaatagttccaacgctcaaatgatttcaagaaaaatcttgaaaatacttggacactcaaagtatttaacaatattaaaatcagatcatttaatgattaatttaatatttaaataattgctgaactgctctttgtatgattaaaattaagagttgagctccaaaaaatccgagaaaattccagagaatataattaaccatggagaatttaataaaaattaaatccatccatgctttacatttaggaaattttatttcccacaattaacttcacttgtaaattaacgaacatttaatataaattctaataataatttattaaataatttataaatcctaagacgaaaatcaggatgtgacaaaccatcaaaaccacatgctcacaacccaccttaaccaggttttaattatcaattaattaacatcacacgattaaccatcgtgagctaccatttaatataaccataattaataatataatataatataatctatatttaacccctttaattagctaatgtttctaagcatggctaagcaaacatacatatagcatttagctgaaccaatccaatatataaggttcatgctaatcaagttataacccataagaaaataaagtcatcttcggccattaattaattgggaaaggttcaccacccgatgacattcgaaaataatgcatagttgaaataaaataatagctttaaacgggttcaacatgctcaaagggttgtttgggatctgtgtgacttgccttgggcttccacaaatgtttcggaaccttcctcaacggaaacactctcctccggaacgtcggaaactaaagcaattaaacaaaaatcaacaaaaccttacagaaacaagaataaacagtatatgtgaatatttttaacatgtagatctcaattttagaaaaatttagcaacttgaaccacctgaaacggatctacggttatttagttatgattttccgaagatttaatctattagaaaaacgggaaaaagaaaaagatgatgatgtcatgatgacatcatcaatggtggccggaccgagatggcgacctcgccggagattggatggtcggctgcgaacatggaggacatgtacacgtagaggacgacgagacgaacccaacggtacttaccctcgagccaaacgacgaacgacgacggccggcgacgagatgaacggcggcggcggctccggtcggcggtggcgagtaggctccggtggtcggcggctacgggggacgggcggccgggcttcccctcaccttggcgcacctattggcggcggctgcaagcagcggcgacaacgaaggcggcggcgcggcgctaccggagttggccggcggcggtggcgagctaggcggcggtggcggcggagctacggagcacgggaaggcttgggagacggggcaaacgaaagaggaggactaggggatcctatttatagccttggattgaagagatcggactcctcccgcaagaaatcaatccgggaaatcaaaaactcggttttagagataaactcgaaaacgagttcgattcggataaaatactcaacgattagctccgatttttcggggtaaagatagaggaggatgagaggatcaaaatcccacaaacaatcggactcggggaggccggattcgatgcggatttggaggggaaagggggcggctcgggtggcatggctgggctcggccgggcgactgctagaggttagggaagggtccgacatgtggggcccacatgtcggtctcccgagtggagggggcggctggcgggttgggttgggccggctcggcggctttgggctggcccgggcgcgcgggagggagaggagttgggccggaatcggcccaacgacttagggaagggatttttgaactttttaattaaaataatttgtgaaatgttgttccaattattaaaaatacttaccttactcaaataattgctagaaaattctagaaaatagaggaacaagtaaagtatttaataaaattttatctagctcatttttatgttgaaaattttcctagattattagagtttaacttgtaggcttttaaaataatttctaaaaatgatttaaaatatgcatttttaatttaggcgatttttagggcgtgacacctgacaaggtgtgtgggtgggggcctagagcggccatcccgctccctcctcccccccgagccggccctgactacatgggccttaacaggccacatggcatcttatcataatttctgggcttgatagtgacgaagatgaacgtcatagactgtatgacgacagaaggatcatcactatattaatgacaaaaagataagcattctttatagaacgccattagagacgcatgataggttgtcacgcccggaatttctatccaaaatttcaaacgcttacatgtgtgtaaaccctcgtcctggaatcagtcgaggcacacaataacaaattgataatagagcacaattattactctaattaataagcgaataaaatgtcattacagaggtaaatagttcctctcaatcaataaagttctaagcaacggaaaataaaagaaacagcgcaggcgactcctctccacaggcaacttgactagggctacgcctaatcatccacaccatcagcatcactgtagaactcctcctctgatgaaagattgcaaggtgagtatatgacatactcagcaagccacgcaataattatgcatgtgcacaggataacaaagcatggcatagtatagtctcaattgcttaaatagcatttaacaattatttcagaatttaataaaacagttaaataataattaaacaatattgatccaacgctatacaacataccccgttgcataggccaaccattctgaacaaccaatcccggctgcacagttctatctccaaaccaggaattaaccattccaaaccaggagctatcaagttattaacagcatcatttagtatggtgagaagtgtgagactaatcacgaaagacattgttagacccgcccataaccgcgggcacggctattcgaatagtttgaactctggccagaggtgtaccactgtacccacaagacacaacctcaacatcatgtcaaccatgcgtcgcgatacttgacaagtactcgaattgagattgtgacaataccctctatataatacaattcaaagcagtgcaccgttcccggatcataatcacccccttataaacaaggtatggactccccagcgacccccgtgggcttatctccgcaacttcacagtctggtgctctacaatgaaccgtactatacagaaagtaaagccgttgcccacgctggcttgtggttggcacggtaaatgtttcacaaccgaaactcgtgaaccggttcttaattgtcgtgagcacgaccatcaaaaccatgtgctcacaacccaccattatcaagttttagttggcaaattaattaattaaccaatcatgattaaccatcatgagctattattaaaccatcattaaataatagtgaagcataagttatcccagtagtgtgctaatgtttctaagcatggctaagcaattatgactaacatctagctgaaccatcatataaagctcaacttgtcaaattacattaacccaaggtatcaaagaataaagtaatcaagaacaaaagggccataataagcaataggttaattccacccaatgacattcgaaaataaatgcaatagttgaatagaaacaatagctttcaatgggatcaacatgctcgaagggttgtttgggatctgtgtgacttgccttgctggccttggaaatcctcaaagtcttctcctgcaaaattggactctcccggaacgtcggaatctaaagagaaaagaacaaaatcaccaaaacagcacataaacaagcatgaacagtatatgtggatatttttaacatgtagatctcaattttagaaaaaattagagacttgaaccaactaaatccgagctaagatgaattagttatgaattttcaaagattaaatcgatttaaatcatttatgtagattttaattgaattatgacgcaataattaattatttttgaaaaggaaaagggaattattgcatcagcgggtcgggtttacggtggaccgggtgcacggcggcggttcatgaaacggacggccgagatcgatccatccaaaatggacgaccgagatccatcggtccacggctagaccacgagggacgacgacgatgacgtcagtgacgacgtcaccactggcagcggcttgggcacacatgcttgccggcaaacgatggcacggcggcgcgaatggagggcaccgaaacgatgcgggcatcgctgcgaactcaccggtgaccaaagcgacggcggacgagcaacggacgacgtcggcgacgaggaaaaggcggcggcgaccttcggcttgacgacggcgacggcgttccggcggtcaacggtgacggagaaggtgcggacggagacagcaacgagacggcgatcacgacggtggccttcccgagtggtgacaacgaccggagcgacggcggcgacggcggctcaaggtctcacgcggaggcggcgctacatacggcggcgggctaagacgagagtggcgacgggtagaggggagctcgggggtcaatttataggggctagggagcggcggcgaaggcccacggcgaccggcgacgggaaggaaagtttagggttcggaggagagagatcgatccgaatcgaactcaaatccggcgatttccaaagcgatttagacgatgttttcaaaagggaaaaggtagagtggatcacggggatcctttcccctcaatcaatttcaccggaaacggaaaggggcggccggatttggaatggcggcggcggcgcagctcggctagggtttcggcaagaggaagacgacgactgacgggtgggactgtcacgcctaaaactcgtctaatttaaaaatgcgttgtttaaatcatttttataaattattttaaaagcctacaagttaaactctaattatctaggtaaattttcaacataaaaatgggctagataaaattttattaaatactttgcttgttcctctattttctagatttttctgggaattatttgagcaagggaagtattttaatatttggaacaacatttcacaaaatattttaattaaaaagttccaaaatccctccttaaagtcattgggccattttcggcccaacattttccctctccccgcggccaagccagcccaaaaccggcccaacccgtcgccgagccgccctcccctccccagccgccgacaggtgggacccacctgtcggggtggtcttccacctccggccgacctcaggccgagcccgagccgggcgcgccgcgccgtctcccgtctccgattccgcctcaatctctccacttttagtccggttttttgaggggtttttatcctctcatcctcctctatctttcccctcaagaatcggagcaaatcgttgagtattttgcccgaatcgagttcgtttcggatttatccccaaaaaccgagtttagattttcccggagcgatttcttgcgggaggagtctgatctcttcaatccaaggctataaataggaccccctagtcctcctctttcgtttgccccctctcccgcgatctcccgtgcctcgtagcgccgccgccacgtgctccaccccgccaccgtcgccggccatcctccatccgcgccgcgccgccgcctccgccgtcgccgccgcttgccgccgccgccacttggtgcgccaaggtgtggggaagcccggccgcacctcccccttcgccgccggccgccgtagctcaccgtcgccggtcatcccgagccgccgccgacgccccttcgtcgccggccgtcgtcggtcgtcgtttggcacgagggtgagtaccgttgggttcgtcgcgtcgtcctctacgtgtacatgccctccaatttcgcagccgaccatccaatctccggcgaggtcgccatcttggtccggccattgatgatgtcatcatgacgtcatcatcgttttttttctttttccctttttctaatagattaaatcttcggaaaatcatatctaaatatccatagatccgtttcaggtggttcaagttgctaaatttttctaaaatcaagatctacatgttaaaaatatccacatgtactgtttatgcttgtttttgtattgttttgttgattttagtatttttgctttagtttctaacgttccggaggagagcgtttcggtcgaggaaggttccgaagcgtttgcggaagctcaaggcaagtcacacagatcccaaacaaccctttgagcatgttgaacccgtttaaagctattattttatttcaactatgcattgttttcgaatgtcatcgggtggtgaacctttcccaattaattaatagccgaagatgattttattttcctatgcgttataatttgattagcatgaaccttatatattggattggttcagctaaatgctatatgtatatttgcttagccatgcttagaaacattagctaattaaaggggttaaatatagattatattatattattattattaattatggttatatttaatggtagctcacgatggttaatcgtgtgatattaattaattgataattaaaacctggttaaggtgggttgtgagcatatggttctgatggttgtgctcatgacaattaaggaccggttcgcgagctactgttgtgaaacatttaccgtgccaaccacaagccagcgtgggcaacgactttatcttttgtacagcatgattcattatagtgcgccagactgtgaagcggcgagaagtccgtgggggtcgatggggagtccattgcctctggtttgagggggagattatgatccaggaacggtgcattgtggtgagttgtgttgtgcgaggggtattgtcacagttcctttccgagataccgtggtggtactaaggcgcatggtaacatgttgtgggattgtgtcttgtgggtacagtggtacacctctgatcagagtttaatctattcgaatagccgtacccgcggttatgggtgagttgaacaatgtttttcgtgaatagtctcacattattcattaatggtaaatgtgttaattaatttgactcctggtttggaatggtatattcctggtttggaagtttggtttgttcaaccggggttggttgttcatatgaggttgggcctatgcaacacgggtgtgttgtatggtgtttatttaatattgattaattatccaactgttttattattctcttaaatatttattaaatgctgtttatgcaaatgagctatattatgccatcctttgttatcctgtgcacttgcatatttgctgtgtggcttgttgagtatgtgatatgcttattcttgcaatattcaatcatcagaagaggagtatctcagcgaaggtgatgatctggaggattaagcttgttcttggttaagatgcctgtggagtggaatcgccatagctgttccgtagtttgttttagttttaatttccgctgcgtagaatgttattctttgagaggaactatccacctctgtaattatttattatttgtgaatattaaatagttatttatttgtattctattatcaacttgttattgtgtgcctcggctgattcctggacgagggtttaacacacatgtaagtgtttggaattttggatagaaattccgggcgtgacagggacccacctgtcagcggcggtcgcacgcgcgcgcgcgggcggcgctcggcttgggctgacttgggccaagggagagagagagagagcggtttcgtcccaaaaccaaaagggaattttaaaaacctttttccatttaaattattcattaaatgaaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaaacctacaccccttaaacggaatctcgtcctcgagattcggaagaactggcgaacaaatgcggatgagttggctttaattcatcttctcgttcccaagttgattcttcttccgagtgattactccattgaactttacagaaacagataactcgattcctggttcttctctcatttgtttccaaaatacggattggtttctcaacatatgttagatcctcttggacttcaatctattcaagatttgcttcttcggtaggtacccttaaacactttttcaactgtgacacatgaaacacattatggacacctgctaaggattgaggtaattctaactgataagcgacctctcctcttctactgacaatcttgtaaggtcccgcgaaacgtggtgccaattttcctttggtgtgaaagcgatgaactcctcgaagaggcgtgacacgaaggtacacataatctccttcttcaaaacttagatctctgcggcgattgtcggcataactcttgtgacgagactgagccacacgcaatctttcttgaatgattttaaccttttcttctgcttccctcaggatatccgtcccgaaaacctgacgttctcctgtttgatcccacaaaagcggagtgcggcacttccgaccatacagtgcttcgtaaggagccatctggagactagcttgataactgttgttgtacgagaattctgcgtaaggcaaattcttatcccaacttccaccgaagtctaaaacacaagctctcaacatgtcttccaaaatctgatttaccctttcggtctgcccatctgtctgcggatgataagcggtactaaaattcagcttggaacccatctcctcctggagcttcttccagaattttgaagtaaattggctacctctatctgacacgatcttcttaggaacaccatgcaaacacacaatcctggccatatataattccgctaaacgacttccggaataggtggtccttaccgggatgaaatgagccactttggtaagtctgtcgactatcacccaaatagagtcatggcccaatgatgttctgggtagaccggtgatgaaatccataccgatttcctcccacttccattctggtatcttcaaaggctgcagcaaacctgcgggttttctgatgttctgccttgactcgctgacaaacgtcacataccgctacatattctgcgatctcacgcttcatacttgcccaccaaaatctttccttgagatcctggtacatcttagtactaccagggtgaatggagtataacatatcatgggcttcctttagaattgcatctttcaaatctttgttgtctgggacacagattctctcacccaaccatacagttccttgctcatcttccaagaaaccgatagctttacctcttttcatattctttttgatctcatggatatcgggatcattgatttgagcttctctgatgtcacgccctaaaaatcgcctaatttaaaaatacattgtttaagtcatttttagaaattaaattaaaagcctacaagctaaaccctaataatctaggaaaattttcaacataaaaatgagctagataaaattttattaaatactttgcttgttcctctatttctagaattttctgggaattatttgagcaagggaagtatttttaataattgaaacaacatttcacaaattattttattgaaaaagttccaaaaacccctccttaagttgttgggctgtttttggcccaactctccctctctcacccgcggccaagccggaccagccggcccagccagcccgccagccacccctccactcgggagaccgacatgtgggccccacatgtcggacccttccctaacctcaggccggctgcaagccgagcccaagccggccgcgccacgccgcctcccgctccaaatccgcacccaatccggccctttttcttctgattgtttaggggtttttatcctctcatcctcctctatctttacccccaaaaatcggagcaaaccgttgagtattttatccgaatcaaactcgtttttgagtttatctccaaaaccgagtttttgttttctcgggccgatttcttgcgggaggagtccgatctcttcaatcaaagtctatatataggaccccctagtccccctctttcgtttgccccatctcccgagctttcccgtgcctcgtagccgccgcgccgccgccgtttagctcaccgtcgccgccgacgactccatccgcgccgcgccgccgcctccgtcgtcgccgccggtcgccgccaccactgttaggtgcgcgggagcgaggagaagcccggccgcccgtccctcgaagccgccgaccgccggtgctccgccgccaccgccgaccgagccgccgccgccacccacctcgtcgccggccgtcgtcggttgtcgttagccgtgttggtgagcaccgttgcggtcgtctcgtcgttctcgacgtgtgcatgccttccaaatccgcagccggccgctctagctccggcgagcttgccatccgagccggccaccattgatgatgtcatcatgacatcatcggtttttctttttcccgattttctaatagattaaatcttcggaaaatcataactaaataaccgtagatccgtttcaagtggttcaagttgctaaatttttctaaaatcaagatctacatgttaaaaatatccacatgtactgtttatgcttgtttttgtactgttgtgttgatttttgtttaattgctttagtttccgacgttccggaggagtgcgtttctgttgaggaatattccgaagcgtttgtggaagcccaaggcaagtcacacagatctcaaacaaccctttgagcatgttgaacccgtttaaagctattattttatttcaactatgcattgttttcgaatgtcatcgggtggtgaacctttcccaattaattaatggcctacgatgactttattttcctataggttataatttgattagcatgaaccttatatattggattggttcagccaaatgctatatgtatgtttgcttagccatgcttagacacattagctaactaaagggattaattatatactatattatattatattgttattattaatgatggttatattaaatggtagctcacgatggttaaacgtgtgatgttaattaattgataattgaaacctggataaagtgggttgtgagcatatggttttgatggttgtgctcatgacaattaaggaccggttcgcgagctactgttgtgaaacatttaccgtgccaaccacaagccagcgtgggcaacggctatatctttcgtatagcatgattcattatagtgcgccagactgtgaagtggcgagaagtccgtgggggtcgcaagggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacagtggtacacctctgatcaaagtttaatctattcgaatagccgtacccgcggttatgggtgagttgagcaatgtttttcgtgattagtctcatattacacattaaatggtaacggtggtaattaatgtgactcctggtttggaatggtatattcctggtttggaggtttaatttgttcaactggggtaggttgttcaaatgtggttgggcctatgcaacacgggtgtgttgtatggtgtttatttaatattgattaattatacaactattttactattctcttaaatttttattaaatgctgtttatgcaaataagctatattatgccatcctttgttgtcctgtgcacttgcatatttgctgtgtggcttgttgagtatgtcatatgctcattcttgcaatattcaatcatcagaggaggagtatctcagcgaaggtgatgtcctggaggattaagcttgttcttggttaagatgcctgtggagtggagttgccatagctgtttcgtagtttgctttagttttattttccgctgcgtagtatgttattctttgagaggaactatttacctctgtaataatttattatttgcgaatattaaatagttatttatttgtactctattatcaatttattattgtgtgcctcggctgattcctggacgagggtttaacacacatgtaagcgtttggaattttggatagaaattccgggcgtgacatctgacttgatcaatgagagtaggcttcgcatctaaagctgcaacaaagcctctactgacaattcccagattcaatctttcaaattccttgcacaattccaatggcaactgtcatccttccatagcattacaatagcctttcctactaagggcatctgctacgacattagcctttcccgggtgataattgtcacaccctgaagttctcctcccaagcctaaaattttatttataaatgaccctaagaaaatgccggtgcaaagcatgagaaaaccctaagaaagtaatacaaataataatcgaatctggcatgtggaatttttcttgagttctacatgtctaaattcgctaacaagttttttagtggaattttcagagccctagaaataattttaaccaattaaaattgagcaagcaatattttaattccagggaaaatccttttctttctttttctttttctttttccccttcccttttcgaatgggccgccggcccattctctccttttccccctcccagctgggccggccgcaggccgaggcccagccaggccgccccgcctccctcctctcccggggtcgccgacaggtggggcccacctgtcgggtccttccccaacctccggccgcccctccacgtcaccgccgccgccgaaaccgccgccccgcctcctccgggccacttcggccacgccgcgcgtgcccccgccttccccgctcccacccctctctctcccgcccgcgccctcaaccgagatgggtgggattcgttttttgaatcccgccactctctctctttctctccacctcccacctcccacgtcgccggcgaaatcgggcgtgctcgggccgttcccgaccttccagcccctataaaatccatccccgagccctcctcgtttttccttttgccgcccctctctcccgagctctccatcgcccccgcgccgtgcaaccactcgccatcgccgctcccgctactccggccgccgctagccgcgctagggtcgccgccgcaccgcgccgccgtcgccgtcgggttcgcgaggccgaactccacctcgtccgccccttccccgtcgagattcgtcgccggaatccgcatcccctcgcgctccggtgagctctacctctactgccgccttcggccatggatgccggccgccgtggttcatctccctccctctaatctctctctcttgcttccttagggcatcccgaagctcgtccgcccgtcgccgccgtcttcccgtggctcgccatcgccgttagccatcgtctccctccgcgccggccactcgcggtgaggcatccctcccctcttttccccttcctctccctcctagtgccgcgccgccgcttcaagtcatgcgccgtcgccttcggccgccgccgccgcctcccgtgccgccgttcgccgtcgccgtcggccgcgtgccgtcgccactagccatggctggccgaccggctttgatgccgagccgagctcggcggccgcctctaccgccaccgcccgatcggctcagggccgatctgggccgtcggtcccgtggaccggcggtggaccacccgcgtgatcccggtccacattggaccgccccccttgagccactgccgagtggggcccgtgtgccggcgcccttccccctctctcgcgagccaccgaccggtgggacccgcctgtcggcgccgccccccccttgatgacgtcagccctgggaattattgcccaataaattatttaaggcctttttgttatagtaataaacacagtgaatcttctgaaattcataactaattcatccgagctccgtttaagccccttcaagtctcagtaaatcaagaaaaatgtgtagaatccattaaaaatggttttgttctctgtttcagtagacttatagcctgtttgcattgtttgccttgtatgtcgttagattccggctcttccgacgctccggcgtacttcgaaatagtcgccgaggttcctccagcagcagagcaaggcaagtcatgcttgtcacttgatcatgttgatcctacattgcaaatgttctattgttttccttcaaatagtgcatttgttttgcaataacactatgggatgtttacctattgttacagccatgctattttggtaccttgctcctttgttagcttgggttatgacatgaatagactttggactaggaattgcttagccatgcttagttcaactagcacacaatggggaaaactcatttaaaatatagactgtaggtttatatgataatgttggattaatcccaccgctctggtgttggttaattaaaatgaatcacatggtgggctatggttgcatggttttgctagtcgcgcccatggcaattaaggaccggttcgcgggaaaccctggaagaactcctcgtacttaccacaagccagcgtgggcaacggctgggcttgtagtgtagcttttctctagctgacgcatccaggcaagggtgagcttgatggagtggggcgggccctgcgacggcctctgtcgcttccggattcacctaggcacgagaggcgactgcccgtcgcctgctggggacgggggtgaaacctggggtgtggtgtgcttggctagagaggggttatgcgaagggtcatgtcacagtctctttccgatatgtcgtggtggcatgtcggcgcatggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacgtggtgtaacgttggatagtggatgattaatatcgtttaattattacaactattttcgcattcgacttctatttataaatgccagtattatgcaaatgaacctgtatagctatcccttgttgaatccctgcatcatacccccattccggtatgacttgctgagtacagtggatagtactcagtcttgctttattttcccccaaccccagagtgtgagtatgtgtctgatggcgggttctccgaggagtaggcttcgtccgtgccgtcaaggatgcctgtggagtggtgttctcgctgcagttccagtcaaggattagctcctgttatctttctttttccgctgcatttatgtaagacttttataatgtttgtaagacgtggatctgtatgtcaacattgtcgtttgtgtgccccggccggtcctggacgggggttttaatgcacattctgcttggaattctattcgggaatttctgggcgtgacaagttggtatcagagccgaccttgaccgtaggacaagccaaatggaaacctaagggccctctgaatccttttcattgcatatgttctttgcaattggaattgttccgggaaaatttggggatctgttcttgtggttcaagggacaaatcttgttgctcgtttaagtgagatttgttaagacaagtaggtctagggttttagtaaaattatttgagatgtttttgaccgttagttgggatttgatgggcgaaatgcattaggtcttagctcaggaatatgggttgtaaggtatttatgcttttcttgttattataagtatgtatctaatttccccattattttatcgctatgtaagtccgtcttatttattcgctctcatgcaaaataatctatgcataaaatttcgctcttattcgattctcttatttgagtcctttatttttatttaaattggatttgagcatgcattgatcctacccctttgtcttctctagatggccgagcacccacccaaccaccgcggagaaggcatgggtgatttcgtggcagagttggcacgcatgacactggtggtgggctaccccaacgcgccggagtacacgactgttccaccgctcagtggcgagcttcctcaccgtgtccgcttggaggtccatggctacatggggacttgcctcgctaaaatggtggttgaggcgtctggaggcacagcagatcacgcatgtcaggaggcagcatatctgatgatggccagactacgggagcgccacaactacatcttccacgacacggcgtaccggttccaccctcgtcgagccagcggcagtgatgtcagttccttccgtccgacagccggcgagaacgacaccacctttggtcacatgtgcgctgtgatgagggggatggacaggatgcactcggacctgcacaaggcgtccaaggccttgaatgatgggaagcttgtgaggatcattgctctgaaggacgagatagcgcgtctgaagagggagaatgctcaattgaagggtcttcccgcgccaggaggagttcggatccgcactacgccccgcaagtcgacaacggcacccgtgcgcgtccagcttgcgcctaggaacccacctccgtcagcagctcccgcagctccagcagttcccgcagcacctccagttccgcccgcagctccagcagttcctgcagctccagcgccagctccagctcctgttcccatgtcagctcctgcatctgctctctccttcgctcctgcatcagccgtcaggggccccgccagtggaaatggaggttggttgccagctactcccagtggcaaccgcgaccacagcagcagcagctccagtggctcagagccgggcagcggcgagacttatctgccaggctccaggagtcgctcagaaggacgtggtgacgagcaggaggacgccttcgactccaccgaccgcaggagccgttccgagcattaggctggttttccattagcttatcgactgcctagcttctgcttgttagtttgtgtgtttaggttgcttgcttggggtcagtcgacagtcgatatcatgtgcctatgatatggctgtcctaataaggatttttgcttgctgtttaaagtgttttaattcagatcagaacaattgcagtttaaatttctataataaagcttagttcctgagtaactgtttttctccgtttccccgtctgctcttcctccagatggtctacaccaggaatggcacccgcacgacaagcgagggcagcaacggcgaagaacgcgctgatggtgtgcaccccaacagtgattccggcaatggtccgccaccatttcccgagaatctgacgctggcccaagtaatggcacatcagactcagatgatggcagccatgatgcagcagatgcagcagcagcaccagcagatgcaccagaggatgctgcagcacgccgaacagcagcaccagcagtttggtccccctcctcctcagtccaagctgcccgagtttctacgcgtcaggccacccaccttctccagcaccaccaaccccatggaggcgaatgactggctccatgccatagagaagaagctgaatctcctgcagtgcaatgatcaggagaaggtcgctttcgccacacaccagcttcaaggtcctgcgtcagcttggtgggacaatcacgtggccacccgcccgccaggcactgaagtcacttgggcggagttctgtcgtagcttcaggaaggcgcaggtgccagacggggtcgtggcacaaaagaagaggggattccgggcactccatcagggcaacaggacagtgacagagtacctccatgagttcaatcgcctcgcgcgatatgcaccggaggatgtctgcaccgacgccgagaagcaggagaaattcctagcaggcctggatgatgagctaaccaaccagctgatatctggagactatgccgactttgaaaggttggttgacaaggcaatccgtcaggaggatcagcgcaacaaaatggacaggaagagaaaggcggcacagttccggtccaaccaaggaaaccatcagcgaccgcgcttcactctcggacagcagggtggacctaccaccatgatcgtccgccagcaccgcacgttcaagtctagcaacttccaccagggcgccagtggcagtcagaaccaccatggaggtcagcctaaccacggtgcagctccacacccaccagtggcaccagcacagtcaggcccgtccgcgcaagccaaggagactggagcaaagccagggtcctgcttcaactgtggtgagcttggccacttcgccgacaaatgcccgaagcctaggcgtgccgggtcaaagtttgtccaggctcgtgtcaaccacgcgtctgcaaaggaggcgcaagcagcaccagaggtcgtactgggtacgtttcctgttaactcaatccctgcaacagtactttttgattctggtgcaacgcattcgttcatttcaaagaagtttgtcaggatgcatgggttaataagagaggaacttagcacaccaatgcgggttcataccccagggaatagctccacttcggtacaattcagcccttctataacaatagaaattcaaagatcaccatttctagccaacatcattcttcttgattccaaagacctagatgtcattcttgggatggattggctgaccaagtttaagggagtcattgattgtgcgaatcgcacagtcaccttgactaacgagaagggagaaacaatagtgtataaatcactagtctcaccaaagcaaggggtctccttgaatcagattgaggcggaaaccccagtggtcaccgaggggatgaattcgaggaaattggaagaaattcccatagtctgcgagtacccagaagtgtttcccaaagacctcaccaccatgccacccaagagagagattgaattccggattgatttggccccgggaaccgccccaatctacaagagaccgtataggatggcagccaatgaactagccgaggtcaagaaacaggttgatgagcagctgcagaaagggtacatacgaccaagtacctcaccttggggtgctccggtcatttttgtggagaaaaaggataagacgaagaggatgtgcgtcgattatcgcgcactcaacgaggtcacaatcaagaataaataccctttaccacgaatcgatgacttgtttgaccaactgaagggagctaaggtgttctctaagatagacctgcgatcaggctatcaccagttaagaattcgggaagaagatattccaaagacggctttcaccacccggtacgggctgcatgagtgcacggttatgtctttcggacttaccaacgcacccgcattcttcatgaatctgatgaacaaagtgttcatggaatttctcgacaagtttgtggtggttttcatcgacgacatacttatctattcaaagtctgaagaagaacatgagcagcatctccgtctggtactcgagaagttgaaggagcaccaattatacgccaagttcagcaagtgtgacttctggttgacggaagtcaaatttctgggccatgttagacttctggttgacggaagtcaaatttctaggccatgttattatagctcagggcatggcagttgatccatcgaacgtggagtcagttaccaaatggaccccaccgaagaccgtgtcgcagattcgaagttttcttagactggcgggttattaccgccaattcatcgaaaacttctccaggatcgctcgacccatgactcagttgcttaagaaagatgaaaagtttaaatggacagctgagtgcgataagagctttgaggagctcaaaaagaaattagtatccgccccagttctgattctgcccgaccagatgaaagatttccaggtctattgcgacgcatctcgccacgggcttgggtgtgttctaatgcaggaaggcagagtggtagcgtatgcctcgcgatagtcgcgtccacacgaagggaattatccaacccatgatctggaattggcagcagtggttcatgctttgaagatctggaggcactatctgattggcaaccgctgtgaagtatatacggatcataagagtctgaaatacatcttcacccaaccggatctaaatctccgacaacgaagatggttggaactaatcaaagactatgacatgagcattcactaccacccggggaaagccaatgtggtggcagacgcattaagcaggaaaagttactgcactgctctatgcatcgagggcatgtgtgaggaattgcagcaagagtttaagcggctcaacgtgggaattgttgaacacgggttcatagctgttggcggatggcatgagtcccttcgaccgaatctgccgaaacccatggcgaagaccacgagccaaggatgatgcgaggcgaagggtcgcgtgagtgcatgccgaagaaggacgacttcgccaggaccggttcgccccggcatccagcccagagaaggacgacttcgccaggaccggttcgcccccgcgagggccgaagtagccttctcggcccaccaagcttagaggccatagggccggcgatcgcccgatggcccatcaagggcccatgagcccccttgacgttatgtaaccctgtaaacgtccctttcataagggcaactatgtaaattcctcaatacaaactagaccctagaagtgagaatctgtaacggggctataaatagcccccaagggccatgtaataaagagagagaaatccaagaaatcaatatacttcgtttctttccaaccaaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccgggaaggggcttatttataccaagcattccttttatggctagatccaaccttctggtccctgcggaaaggaaaaagaatttcacgttcttcctttcaggaagggaggattagggaagtcctattgattgctgctttcttcagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacggggggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 13092 - DNA, 756 bp, Oryza sativa
ccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacagggctgcaggaat

SEQ ID NO: 13093 - DNA, 3045 bp, Oryza sativa
cgatttttggcggttctcgtaggccaattagagatgcaaggaatcggggacttaatctaattaattaatgaaatggcaggacagtagtagacccttaatcccggccctctggccaattattcattgataattttgataatgacacaatcgctaaaatttaactttgtccttatcgagtgtcctgatcatagtattatggaagtgttttagacaaatctactagcaccattatatttttcacatatttccatctttacatgcatgctcgtgtatatatatataccacaaattaaaatgaatatttgcttgtggttaattagcacctcaactctcatggttcattttctctcttgataaaaattggggataaattaaccgatattttccataccaaaattaagctaatatcgtcaacaatttttaaaatgaaaaaaaaatcgtcaaatattgcgaatatatcaatggatcaacttgcatgccctaattatgagcattcttaaaactccaaggaaaaaaaagacaaaaaagctgaagtgtgatgaatgcatatgtacatattgctcctcccaaatggccgggagtattaatttagaaccgaaagaaatcatttttgtctatctcgcatttttcatgtaaatccagtgtgcgatttcagttggtgaattgaacttggtcatcaggagcacctttccaaaaagtttcatctttgttcagactctaaaaaaactactccctccgtttcacaatgtaagtcattctagcatttcccatattcatattaatgctaatgaatttaaacatatatatctatctagattcattaggaacattataaatgtgagaaatgctagaatgacttacattgtgaaacggaggaagtagttggcaagtgaagttctttagtttcactactacgaaaaggattattcctaatgcatctagatccgaccacatgaatcagcatgatccatgatgtgccagaccacgttgagcacatttgatcttaacgtatatagttccgaccacgtgaagcagcatggttcacgatgtaccagacttttaaaaaacctagttggtaagtgggattttttggtcttatctacccaggaaaatacagcacgaatccacacagcatgcacattatgcatggacttttgaaacgaggatattccatcggtttctctgacaaaggcatgcatgctagtagtttggaataaaaaaactaaggataaattaacactagcaaagtaattaataataaattaacacacatgcttaattaggtactagctggcaacaagttaattaattaaatcagctccgtgcatgcagagcctctgactccatccacaaaattcgcatgcatggtgacgtggctggatagcatccaagaaaccaaagtgaatcaccgatctattagctccctctttaatgttgaagcagaggacgacaagccagcagcacagttagtagctgcaacgtgcaaaaaattttaggctagctaactctactagcctcttagacacacacacacaaacacaagtgtaggaagagaagattaagagaagaaggattgggttgggttgaatgtttcaaaatttgcatctactaggatccagttgccaactaggcacgcacacgctatgaaactgtgtgctgtatgtctcaaactgcctctctaatagccaaacaagccatcactacaagaatctaattatatgtgatgctcatttacgtcataaaaattgaattttaagtcatgctatgaaatctgtgacattcgtgtgacaaatatgattcgtcacctatcatgcgtctctaatggcgttctataaagaaagcttatctttttatcattaatctagtgataatctttctgtcgtcatagagtctatggcgtccattttcgtcgccatcaagcccagaaaacgtcataagatgccatttggccttttaacgcccatgtagtcagggccggctcaggggggagggggtgcgagcggtacggccgctctaggctcccaaatcgtaggggcccccacccacacaccttgtcgggtcccaaaattaaagattcggtaaccgacatatttaaactgtattaaccctggatcagtagattaatacatgttcaacaatctgaatcttcatcgcatacatttgattaaggctccaatggagatttctttacataaaataatagggtatttacaagattgtggctaactattactgtagaagctacaggatgagccaactctaatgttttgctatagaattaaaccatctatctaatctatacttgggaactaagttagaatgacactaatttatatgattaaactcctggcttcggcaaaaactccaaattgattctaaaagagggggttaaagcaagggtgataacaatatactcatcaagctattatatcaagtagtgaatgcatgaaatagtaatttcatgttttagggtaagccctaaaccctatacaacaaggtccctgggcattaggtgaattgcatttaggtccataagcccacatggcaaacaaagcaattttacaaaaagaaccttacaacatttcaatttctactaattaaagtccttagcacctaatgaagtggctaaacagccgggcccacgtgtcggtgactcggcggcaagacaagcagaggcagcaggagagcaacggcgaccgacggccttcgtggcggcgtattggcttgatcatatgtgggcgtcgttctcctgggacctaggcgacgtcagtggcgcaatggtacagccggagatgattcgagtcgacgggaatgacaaagtggggcgatggtggagctctagacaccgggaacaccgacgagcgcaccaccaagtgttcgatctatgccaaaaaagaaacaaagaaaatggatcgatcaagtagagaaggaatttcatgaatcactactacagaaacgattttcctggatagggaccttttagattccgtgcgggcggtatctcgttgcttctgggaaaatcggctcattttcgcgtgcggtcca

SEQ ID NO: 13094 - DNA, 4461 bp, Oryza sativa
ccgattttcccgtgcggacctattaagagagccgcatgcagaaatactaagtccctctttcctctctcacccactttaaaatttccactctttctctcctctcccctcccctctatccctttttccactttaaaatttccacgcagagcatctcctctcagtcttctctgtctcacgcctctcctctcctctctccactctcctctcctctcctcccgacggcggtagcggtggtggcgtgtggcgacagcagcggtgcgacggcggtgggagtaggagcgcgcaggcctgctccacgtggcggcggtggagggcgttggatccggcgggcggcggcagtccctacacggatccaacggtggtggccgtcaatgcaagaatccagcggtggcggccgtccccgcacggatccggcagccggccgccatctccccacgcgggatccagctcccctcctctccccttccttccctccctagatccggcagaggggaggggcgtcggcggcattgcggcgggagggaagcgcggatctgccggcgggtggcgcggaggccggcgggaggcaggcggcactatggccgtcgggcggaagcccactgccggattcttgggtttcgtttttttaaaaaaaattatgttatttcggatttttgttttcccgtggggatgcgccacccgcacgcaaaaatcatcattttcccagacccctaggtgcgtgtgggccgcctacccgcgcccaaaaatcattttagccctcacacaaaaatcttggttgtagtagtgaatggtaaaagtgaaggtgcaaagtgagagctagttgtcaacatgaggggtagaaacgatttaaaggagttggcagtggtttgaggctgtgatcctacttgtacttcactcaaccaagtatgagtggctgtctagtggcctcatgtagatgtttcctaggagaagatgagaggtatggtgaagtttgggtgtaaattggactttaactccctctctctctctttcattgtctctttgaaaatataatttaggatcaaagagatgattcaccaaggttgtttgtaggtatttggaaaacaaataggcccatatatagatgtttcctagaaggcttggagtggtagagtggcattttgggtggaaattcaatttaaacccttctctcaccttttgagaaataaaagaagatttaaatgagagaagagcagatgatgtgttggctagggttgtatgatgagtgggccccataaggacttggtcccacatttaagagagatgtagaaggagagaactagaagctctaaattttccatgtgttggcactatcacactaaactatattactctctttctctcatccatttaatttagaattaaggccgggggagggggggtgacagggagacagcaaggtagacaaggatttgatggttcaaggtgccaagttccaaagtttaattacttttgcttttaccatggtaatttagtaaagttgactagttaatctattgaccacagtccagaatactgtttacctaacttatggctctcattttatgaggttacatttcgaattagactaagccattgcaccagatgatagagtaaagtatgcttaacattttgacctagagattttgcaagatgagttatggtttaattttggtgaaggtgcaaagtaggctaattggtatgctgtttccagattttttagctgagttcaaggatttatttgggttaccaattgatgtgataaattattataactaaaatttctgggagcttagggtattgtttagtatttatgagaattttggtgggatttattgttgcctcatttatttttaggaattttctctttagacaaagcatgcatatgcaacctattatgagatgtaccaagaatatccaaaaacaatcttaaaagaataatatgcagatacaagcaagttctttttatctcaatttaggtttgcgtattttgatacctacctttcaatttgtttgatatttaacttaaatatatttttttagttaggttgaaaatgcaaaaccgagaagattaggtttctagtttatggtcaaagcaaaatttttgtttcaaaattttttaccacaagatttgtaaacttttacttttggacttagttttgatttggccagaaaaattatgtgttttattttattttagggagttatatgctctagtatgcttctatgttcaccaaaaacttttgaattcaaaatgttttaaattttccacaaaatttttccatggtgaaattccttgtatgttacaagttgatatgtgaaataaaattttaccttgtaaaatatgacttggaatagttttattaacttctcaataattaattatgctctcttaaattttcttgaaattttccgagctaaagaaataattttaataatactaacataatttcggtcattatttaaattgaaaaaacaatttaaaattctcttcatatcttttggctgaaaccaagccaactactatccctctccgtgcaggcccaaagccatgccaggtaaagtctatctcttttccttcctctccctaaatagaagccaataagtctagtttacatcggtctatgaaagagccccagttcctcccccccccacccgccgatgtcgttggtgctgatagatgtgatgcccacacctcagggatccgcgcgccatggtgagcagccgatgaatcttccgccatctcctgtccttccgtcgtctgacgaggtaaggttttcccccccgattacccccattgctacctaagttggtgattcattggtagatctacttgtggtttaatgtgcaagaatgcttggtagatctggttgttgttgaaagtgcaagaatgcaagaatgaatggtgtgaactaatgcatatgtcctggtatgcttatttcaaagtactgtgcatatgtgtattatacacaagttagcatgcacattgatctttgcctcttttgccgtaggccctagtatgcatatgtgtattataccatactgtattatgtacttataatgtgaaattatatgtggaatgctccactgcatatttgctcttggttaattagtttaggaaaaattgcaaatatgatcttgtgagaatttgtgaagtacatagaaggcaatttgttttgacaatgaagtatggtttgttgtttgttaatttagttctccgtaatactgcctaaatttaaatgtatgtttggtgaactgaaatagatatggttagtgatgtcattgttttttaacgactatttgtccttgtgagtaaggttgtcattcctcaggtttactgcctttagtgtggctatatgtctcccaaacctgagaaaacgaggaatgtgatagtagccgagaaattgatcatgtttcctcccccccccccgcctcttttgctttcctactaggttttgcaataatttttggcatgacaatcttaattatgtcccatagtctaaaactcacaaaaacatcagaaatccgctaagaataaattaagtaaagaacatgcatacacaaataatattaatcatgtcgtaataaattgctaaggtcagagaccatcggatgacacaatggacagtgctatggccttattaaaagcagcaagagaaattaaatatgcttgtgagcgcacacatgcacgacatacatagagttgagaccaacagatggatccactatagatcgccccatatggtcaacaatttattgaagataacattaacataacttggccataacttgaagcaaaacaacatattcttatgataggcattaagactggtagcaatgcaagcatgttgttttaggcttgtccttccatcttagcaagaactcccatttcgtccatcttagcaagaactcccatttcgtccatcttagcaacaactatgaaattaaaatatgaaaatcccattagcgcattagttaattttgtagtggaagtagagcataagatgtcttcgtgttgcaagatacatgcctgaagtcgtgagattggaagtgaaatcaacaaagcacattgaggaaaatgcatggaaggccacacatatgtattagtccacgatatgctacaaagtctgtatctacatgtaagaaatgcattaaatagagtgacattagtgaatttaccagaatcggccagaatacatgggaaacaacaagtgttcttgtagactgagtcggagccaccagcagcagtacaaccgaaacaacatgcttttgcctaagaggatatgcagcagccgcactgtgccgcggtggcggagtcgacagtgaggctcaagatgaccaggcacatgatcaccatcgaagtggtagtcctctttccctccattgcctcctgttgctgatgctaccttccctggttatcttgctatgtttcttagttttgtgttgagaggtgattcttgaatg

SEQ ID NO: 13095 - DNA, 3874 bp, Oryza sativa
  unsure (1)..(3874): unsure at all n locations
ctcaacaagttataccggaagaggaggtatgatgcatgatataaccaaaggaggctaggggttcttttgcataagctagcatttaaaaacagtagttgaaagtagtaaaacagttgtagtaattaagcagtactgaccaaatcactgtccaacgctacaccacgttgcaacaggcccaatcaaccacctgaactacaccagttcattaaactaaactaggggtgagactaatcacggtaaatctggttgatcgcccataaccgcgggcacggctattcgaatagttttactctggccagaggtgtacaactatacccacaagatacgattccacacatgtcaccatgccccgaagtatcaccatgatactgcaaagggggaaatcgtgacaagaccctccgcataaccctcccctaactatccacaccacgctaaggtttcactcccaccactcaaaaggcagtgggcggtcccctcttgcgccgcggtgaatccggcagctggacaaccggacaccccggctgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccacgggtgcgaccagcaaaaccgtgcacccacagcccaccattcagtgtattttaattaactaacaccattgcggtggcaccaatccaaagctattgccaataatcaaagtcaatgctttaatgtgattccctttttgtgtactagtagaactaagcatggctaagcatttcctaaatcaacatctagtcattttaaaacccaagttgccaatggcataaggaaatcaatatatggctgagtagtaggacccatcccacgtgatattgtaaaagaatgcaacatttaatagaaatgcgagatattggtaaattgggtacaatatgatcaacgtattgcatgacttgccttgctctcgcactaatgagacctcagcaacgtcttcgagaaaccgcggatcgacgaaacggccaaaatctacgcgacaaacaaagcacacaagcaaaacatgctataagactactgaaacaggaaaccaaaccatttttaatggattcttcgcatttttcttgatttactgagacttgaatggacttaaacggagctcggatgaattacttatgaattttagaagataaactgtgtttattactataaaagagaagccttgatgtatttattgcgcaataagtcccaggactgacgtcatccaaaagggggcggcgccgacatgcgggacccacgggtcagcggctcaagggggaggtcggtccaccgtggaccaagtccacggggccgagggtggtacccggcgggtggaccccaccaggcggtggctcaaaggggaggggagggaggtgccggcctggctcggctcggcttcaaagccgaccggcggccatggcaaccggcggcgacgcgcacggtcgccggcgacggcaatcggcggcgcgggaagcgacggcggacggtgtataggacggcggcgtcgaccgaaggcgacggcgagcgcatgaagagaggcggcgcaaacaagagagaggggaagagggaggagaggggatcctcaccggcgagtatggcggccggagcggaggatgaaggtggcggcgacaacccggcgatgaggaggggcggacgggcggcggcagcacctacggagggagttgtgaaggattaggagtagagagagtgaccacggcagccaccattgttggccggagacgaatgagaatggatagctcaccggcgtgcgaggagaaccgggctccggtggggttcagcggaaaccaagcggcggccgaggtggctcacgcggcggcaatgctaatggcggcggcggcttggcgcagcggcggctctagcggctgcggcgcgcgaccggaggtggcggcaagcggcggcgctagtggcgagtggcgcggcggcggtaggaggcacgggagagcgtagcgaaaaggggaaaagggagagggggatgcagggaagctttataggggctcgagaggggcggacatggccgggaaaccccccgatttggccggcgacgtgggggggagagagagagagagtggggggaattctaatcgaatcccgcccatttgcaggcgcgcgcgcgggcgagaatggcggggagggcggcgacgtggggacgcggagcgggggtgcggatgtggaggaaacgggcggcgtggggaggtgggggcgccggcggttgcagctcggctccaaccggctggaggaggaagacggggccgacaggtgggccccacctgtcggtgacccggagagaggagggagggagacgtgggtcgggcccaacaaggaggagggcagcgcgggaagagtgggccgacggcctaaaggaggaaaagaaaagaggaaaagaaaaagattttcctgggattatttattgcggtttaatgtttttaattggttaaaattatttcgagagctctgaaaattccactaaaaattttgttagcgaatttcgacatgtagaactcaagaaaaattccacatgccaattccgattattatttgcatttattaattaaggaattagctctaagttaatcaaacaatttcttcgcgcaattcatttaaccatttttttaaagcaaggaaaaagggggaaacttcagggcgtgacaatacagttgatggatgtacatgtttgttgcacaatctctgaacaaactcttcatatctagtcctgcgtaccaggcaattttacatttgcacgctttcgccgatggacagaatagaagattttcagatacacttaggtcgtacccgtcaaatgaaggtaaaaggcaacgagtaacattgttttaagtgtactattgagtagtccttcataagataacttagttgtgtttgtagcgtactatggcgtagtagacgagttagtaccatggctggcttgcattccatgtgagtccatgttagtttagttaggctccccaacgtgagtaagtgaccgaataggtttagaaatggtatatttctaggtctagctagcttgcctatgtaggttaatatgtgtgtatattatcgcacaaggtcggaaacttttttgaaattcgatactgtacttcttacaaatactacctncgtttctatgaataacacacatgctcgtttttgaccgaaggatttgagaaacaaagaataaatcttatatttagtaattggatgccccaataaagcttccacgttagttaattgatggcataatttttctaaccccttccaatgccccaggtgatgactagtaatacataaatagaatggtggatttcgtattgaaaaaacacgttgaaaatgatgccactggaaacggataccctcatctcaatcgggcggtaagccccatctcaatcgggcacagcgtccgtcacaggctagaagtcactgatgtgaagagttatctcaatcgggcaaacggccatcacgaatgaatatatctcaatcgggccctaagtaaagcccgtcacagatagctttgacccagacgaccagtcaaactatagcccgtcacagatgacctatctctatcggaccacaactagagcccgtcacagatgactactaacctttatcgggcctaaactagagcccgtcacagatgatactcatctcaatcgggcctaaactatagcccatcacagatgactactgacctcaatcgggcctaaactatagcccgtcacagatgactactgacctcaatcgggcctaaactagagcccgtcacagatgactact

SEQ ID NO: 13096 - DNA, 1704 bp, Oryza sativa
aaaattcatgagttaggtatatgtatatttggcataatcatgatgagacagcaaaaatcataaattagctatttacccacgggtacatgacatagcacatagcaagactagtgagatataggcatcacagatttgttggagctagacatatagctagttgaggaattttggaatagcaaaattcatgggtctacttctatcaaaacccactcccctccacagcaaaacaaactaacatttgcgccctaaccatgtacatttgctcccaaatccatctccaaacaaacagaacaaactaacatctatcctaactatgtatacccagtaatagtactcgccatatctattcacatgcagagatcgccatatctattcacaagcagagaacacatatatagcacactcatcctctgtgaacactgcacatccgttttaaattttattaccgttccactgctgcagttcagctagcaagcacacactgttcgaagatctcaaggagagtccagtcgtggtcgagatgccctgcgcgtggcgttttaaattttattactgctccactccactccgcatttccactacatgggtccatttattgcgactttttaagctcatctccctccatcgaggagagcctgcccatcaagtcgtcaactcttcttcttttttttatagaaaaaacaaaactgtcaatatttcagtgctccacgcataaaaaagaagaaaacatttcacagctccagtttttctatggttcgaggtgtcaaacgtcgaatatttcactacgacagaaactaaaattggagacatcactacaaacgtacacactcatgctcgtccggtgtatataaggcgcaccccctcagttctactataaatgtacgcactcttgctcgtcgttgcaccgcacaagtacatagagcacttgcatgtgtataataggtcagggggaactggacaatatgcaaataatctctctggaggattcatcaagatcaatgctttgctttgcttgcccggtctcctagctagctaacagtctccatttgattgatgcttttatactaattaactaccgctactaatgctcttataccaattaagtatatgtgtatcaacatagttaattaattcaccttggagactcttgcttatgggtggtttatatatatgtgtctcatgagatgatcaaaactgtgaaggcagattgatgtttatttatccttctggctaatatgttatggccgattgagaggcacagttggagaagattacctaccacaatcctctcatcttgcgatttttgtccgttctcgtaggccaattagggatgcaaggaatcggggacttaatctaattaattaatgaaatggcaggacagtagtagacccttgctaatcccggccctctggccaattattcattgataattttgatattgacacaatccctaaaatttaactttgagacctgatcgagtgtcatgatcattgtattgtggaagtgttttagacaaatctactagcactattatatttttcacatatttccatcttcacatgtatgctcgtgtatatatatatatatatacacaacaaattaaaatgaatatttgcctgtggttaattagcacctcaactctcatggttcattttctcgcttgagataaaaattgggaataaattaaccgatattttccatacc

SEQ ID NO: 13097 - DNA, 9081 bp, Oryza sativa
ataaagggaagcagcatggtcgacgatgtgccagactctaaaaaaaacctagttggcaagttgaattcttttatcttctctaccccggaaaatataaaactcatgcagacagtacgaatccacacagcatgcacaatacttttgtaacaaggcatattccatcggtttctctctctgacaaaggcatgcatgctagtagtttggaataaaaaaaactaaggataaattaacactaccaaagtagttaatagtaaattcacacatgcttaattaattaggtactagctggcaacaagttaattaattaaatcagctccgtgaatgcagcctctgactcatccacaaaattcgcatgcatgtcgacgtggccggacagcatccaagaagcagatcatttgaacaaatccaagtagcttagtccatgttgcatatgatcaccagaaacccaagtggatcgccgatcaattagctctgtgtgttgtatgtctcaaactgtctctctaatagccaaacaagccatcactacaatagatcttattataggtgacgctcatttacgtcataaaaattgaatttcaagtcatgttgtgaaatctgtgatattcgtgtgacgaatatcattcgttacctattatgcgtcactaatggcattctataaagaaagcttatctttttgttactaatctagtgacgatccttctgtcgtcatagagtctatgacgtccattttcgtcgccattaagcccagaaatcatcataagatgccatgtggccttttacggcccgtgtagtcagggccagcttaggggggggggagcggtacagccgcactaggctcccaaatcgcaggggcccccacccacacagcttgtcgggtcccaaaattaaagattcggtaacctaaatgtttaaactatatgaacccctggatcagtagattgatacatgttcaacaatctgaatcttcatcgcatacatttgattaaggctccaatggagatttctttacataaaataatagggtatttacaagattgtggctaactattaccgtagaagccataggatgagccaactctaatgttttgctatagaattaaaccatctatataatctatacttgggaactaagttggaatgaaaccaatttatatgattaaactcctggcttcggcaaaaactccaaattgattctgaaagagggggttaaagcaagggtgagtacgatatactcatcaagctattatatcaagtaataaatccatgaaatagtaatttctgagtagggtttagggcttaccctaaaccatatacaaaaaggtcactgggtattaggtgaattgcgtttagaaccatatgcccacatggcatacaaagcaattttaaaaaaagaaccttacaaaatttaaatttctactaattaaagtccttagcgcctaatgaagtggctaaacacccgggctcacttacggtgactcaacggctggagaagcagaggcaacaaaagggcaatggcgaccgacggcgtttgcggcggcgtattggcatgatcatatttgggtgtctttctgctaggaccttggcgacgtcggtggctcaatgattcggccggagatggtttgagtcgattggaacgacgatgtggggcgatggcggtgctctggacaccgggaacgccgacgagtgcaccaccaagtattcaatctatgccaaaacggaaacaaagaaaatggatcgatcaggtagagaaggaacttctcgaatcactaatatagaaacgattttcctggacagggacccttttatatttcgtgcgggcggtaactcgttgcttctaggaaaatcggctcattttcgcgtgcggttcaattaagaggacggcatggaaaaatctatttttccatgcggtcctcttaaatggactgtatgcgaaaatgagccgatcttcccatgcggacctattgagagagccgcatgcaaaaatactaattcctctttcccctctcaccaactttaaaattttcctctttctctcctctcccctcccctctatccctttttccactttaaaatttccacgtagagcttctcctcagtcctctctctctcacgcatctcctctcctctctctccactctcccctcctctcctctccttccaacggcggcagcgccgtcagcgcgcggtgacagcagcggtgcggcggcggtgggagtaagcgcgcgccggcctcctccacgtggcggcggtggagggcgtgggacctagcgggcggcggccgtccctacgcagatccagcagtggcggccgtcaacgcaagaatccagcggtggcggccgtccacgcacggatccggtggcggccgtccccgcgcgagatccagctcccctcccctccccttcctttcgtgcctagatctggcggaggggaggggcgtcggcggctgtgcggccggaggggagtgcggatctgacggcgggtggcgcggaggccggcgggaggcaggctgcactatggcaggcgggcggcgggcgaaagcctaccgccggattctagggtttcgtttttttaaaaaaaattatgttttttcggatttttgtgttcccgtgggttgcgccacccgcacacaaaaatcgtcatgttcccagacccctaggtgcgtgcaggccgcctacccgcacgcaaaaatcgttttagccctcacacaaaaatcttggttgtagtagtgaatggtgaaagtaaaggtggaaagtgagagctagttgtcaacatgaggggtagaaacgatttaaaggagttggcagtggtttgagcctgtgatcccacttgtacttcactcaaccaagtatgagtggctgtctagtggccccatgttgatgtttcctaggagaagatgagaggtatggtgaagtttgggtgtaaattggactttaactccctctctctgtttctttgtctctttgaaaatataatttaggatcaaagagatgattcaccaaggttgtttgcaggtatttggacgacaaataggcccatatatagatgattcactatgttgtgaactctgtgacattcgtgtgacgaatatcattcgttacctatcatgcatctctaatggcattctataaagaaagcttatctttttgttactaatctatgacgtccattttcgtcgccatcaagcccagaaatcgtcataagatgccatgtggcctttcaaggcccatgtattcagggcaagcttggggggggagcggtacagccgctctaggctcccaaatcgcaggggcccccacccacacaccttgtcgggtcccaaaattaaagattgggtaacctacatgtttaaactatatcaatgtcacaccctgaaaatcgcctaatttaataattcagtttttaatgcatttttagaaattattttaaaaacctacaagctaaactcctataatctaggaaaaatttcaacataaaattgaactagataaaattttattaaatactttgcttgtttatctattttctagatttttctgggaattatttgagcaagggaagtatttttaataaatgaaacatcatttcacgaattattttaattgaaaaagtctttaaaatcctcccctaggccgtttggccgtttccagcccaacatccttctccctcgcacgtggccgtgcagcccacgccgtgccaatccaagccgagccgcccctcgtctcctctagtcgtcgacatgtggggcccacatgtcggggtcatcccgtacctcgggccgggccgagccgagcccgagcgccgccgcctctcctccgattcctcctcaaccggtcgtccccgagtctgattgcttaaggggaaatcatctcctccttatcctctccctttcccctagagtttcggaggtcaattttgcccgaataaaccaaatcgaattcgttttgagtttatctctccaaactaaccctagtttttcccagctcgattcctctcggttggagtccgatctctctaatccaagcctatataaagcatcccctagtcgtcctcttccgtttgccccaagtcccgcgtctcaccgttgctcgtagcgccgccgctgcgtagctcaagccgccgccgtcgccggcgactctccagtgacgtcgcgcggctgctagcgtcgtcgccgtcgctgtccgtcgccgccgccgggttcgcacggtggaggagtaccttggccgccccttcgccgtcgtcgcaagccgctggaacgccgccgccgtcgtcgagctgagccgcgccgccgttggtcctcgtcgccggtcgccgtacgtcgtcgtccgtcatagtttcttgcaccggtgagttcgcgtcgtcgtcctcttcacgtaggtgtcctcggatagcccaaccgagctctctatcgccggtggtcgcgtggagccgtgccatggccggcgatgatgtcatcgatgacgtcataaatcctttttattagttgaaaatcgattaaacttcggaaattcataactaaatcatcgtaactcgtattcgagtggttcaagttgctaaattcatctaaaatcaagatctacatgttaaaaatatccacatgtactgtttattcttgtttttgtactgttttgttgattttgtttatttgctttagtttccgatgttccggaggagagcgtttacgttgaggaaggttcagaagtgtttgaagaagctcaaggcaagtcacacagatccgaaacaaccctttgagcatgttgaacccgtttaaagctaatattttatttcaacttatgcattattttcgaatgtcgtcgggtggtgagcctttcccagttaattaatggccgacaatgactttattttcctatgggtaataaattgaatagctttgaccttatatattggtttgctccagctaagtgctatataggtataattgcttagccatgcttagaaacattagctcattaatggggttaatcatattacgatattagttatggttatatttagtggtagctcacgatagttaattgtgttatgataattaattgatacataaacctgattaaaggtgggttgtgagtatatggttttgatggtcgtgcttacaacaattaaggaccggttcacgagctactgttgtgaaacatttaccgtgccaaccacaagccagcgtgggcaacggctttaccttttgtatagcatgattcattatggggtgccagactgtgaagcggcgagaagtccgtgggggtcgctggggagtccattgcctctggttatgagggggagattatgatccaggaacggtgcactgtggtgagttgtgttgtgtgagaggtattgtcacagttcgtttccaaggtaccgtggtggtactgaggcgcatggtgacatgtggagttgtgtcttgtgggtacagtggtacatctctgatcagagtaaaactattcgaatagccgtgcccgcggttatgggtgggtctaacaatgtttttcgtaccaccataaatgaaaatactatgataactaaattgactcctggtttggaatggtatattcctggtttggaggtttgatttgtacaaccaggggttggttgttcagataaggttgggcctatgcaacatgggtgtgttgtatagtgtttatttaatattgcttaattacttaactgttttgctattctctcaaatgtttattaaatgttgtttatgcgaatgagcttaattatgccatcctttgttatcctgtgcatttgcatatttgctgtgtggcttgttgagtatgtcatatgctcattcttgcaatattcattctttagaggaggagtgcttcagtaaggtgatgatcaggaggattaggctttgttcaggtcgagttgcttgtgaagtggagtcgccatagatgtttagtcttttgctttttttccgcggcgtagaactttattctttgagaggaactatccacctctgtaataatttactttgcgcatattaattagttatttgatagtactctattatcaatttgttattatgtgcctcggctgattcctagacgagggtttaacgcacatgtaagcgtttggaattttggatagaaattccggacgtgacaagttggtatcagagccaccttgaccttaggacaagccaaatggtaaaccttaagttgccttctaattattttggaaaatagaactgcccttctctattctcttataaattaattaagttggcagcacatgcaaggttatgtacaaaatttattaaattctactttaccaaaacagaaatttgttcttttattttgaaagaaaaaaaactttactgttcagggtattaaatagtttaattttctgaatttcattggttagtcggcactgtacatctattatggtatcgattcaatcaagatggcatcagtactactcatccctgttaatggtgacactgtaccgtgctcctggtagatcctaaatattttagttttaatttattcatttgtgtaaagttatttgtctctgttcaaggttgatttatgttccaaaaagaaaaaaaattgagtcatgtttgttccttttcttttattttctttttctttgggtccaatttaattaagtctagtttgtgcagctaacttaaaaatatgcattaattccttcctttccatgttgctttagatgcccatccgccgaaaaacttgatcgaggtgctaggattcgtcagggagctgagaatgatggcatttgaagtaggttacgaggttgcccccgagtatcgccagattccccatgaccccaacgaggagaagtgtcgtgttcgcgtgacgttgactagtgatcgtgaagaccttccgtcgataaagtttgaagctgagggaaaaaagtacagccatgtttgtcaggaaacagccttggtggccattggagagctacgtcatcgctttgatgaggagttagagtcatcagctttccagtatcacccacacaagccacatggtcaagactatagaacttacaactgtcccgaaggtgaaggtagcgccactgtgatgcacgccgtgtatatgcttagcgccatggatgcagtaggcgtggagcgagagaaagcagctcatgatagggaaaactggaaccgtggcaggatttgtaagttggagagcaaggtgtaccgtctgcagaaggaactagctgagcttaagggagaagcaccaccgccagcacccaagcttcgcctcaccgcaaggaagagaaccagtctaccacctcgtctccagttagcttcgaagactcgtgtggtgggagacgctgtgcctgatcatgctgaacctgtcatccatgtcttaagtgatgaggaagaagaggaagacccaaaagaaagagagccagctactccagaggaggaagatccatctcttcgttccgacgcaaggcgagagtagttgtctagttagaccgttgccgtagttcgctgtgttagtttgcttgcttaagattgcttgtgcgtgtgtgggtttagcatgttgcttacatcattggtgggatgtaactacataagtttagttcttttgcttgtcagagagtaagttagctggtgagatagtgttaattcaatttaaatgtaatcatacacaattaagagcaatatagaatttaaattaactaaagttctccgttctaagggtatctctctgtcattctttcattttgcccatgcttttcttcagatggtgaacacccgcactggaagtgaaagtggaagtggaaatggtcacaatgaaggagatcccacacttgcccaagttttggcccagcaaacccagttgattaatctattagtgcagcaagcgcagaaccagcaggcaaataacaacaatcaaccaccacctccgcagaacaagttggcagattttctacgtgtgagaccacctaccttctcaagcaccactaacccagtagaggcaggtgattggctgcatgctgtgggaaagaagttagatttgtttcagtacaccgagcaggagaaggtttcctttgcttcacatcagttgcatggtcctgctgctgagcggtgtgaccactttcttctaaacagagccgagggacagcctatcacttggcgggagtttactgctgctttcaagaagacacacataccatcaagtgttgtggcccttaagaagagagagttcagagcactcaactagggatcccgttctgtcagagagtacctccatgactttaatcgcttagctcgttatgccccagaagatgttcgcactgatgaagaacgtcaggagatgtttttagagggactgaatgatgagttgtcttttgcattgatggctatggattaccgggatttccagtagttggtggacaaggcgattcgccaagaagacaagtataataggatggaacagaaaaagcgtagtagccagaggccgcgcattgctttgggacctcaagctgcaccatacccacagggaggatcctcttcagttgctcgccctcaacgccagttctacaacaacaacactagtaatcacagcaacgataatcgtaatatggtcactcgtcatgtagcagctccaactcagaatcatcctgtcaggaaggaacagggaagcaagccaggggtgtgcttcaattgtggtgatccaggacattatgctgataagtgtccaatgcctcggcgtgtgaagaatgcacctgttcagaacaactccaatgctccagcaccgaaggctcgtgttaatcatgttgcagccgcagaagcccagaatgcacctgatgtggttttgggtacgtttcctattaactctatacccgcaactgtgttttttgattccggtgctacacattcctttttgtctaaaagttttgcgggcaatcatgggatggaagttattagtcttgggagacctttactagttaataccctaggcaatcaagtatcctcaacgcagtactgtccttccgttactatagaaatagaagaaatacctttcccatcctcacttatctttctagaatccaatgatcttgatgttatcttagcggggctgcaggaat

SEQ ID NO: 13098 - DNA, 13249 bp, Oryza sativa
acggtttggtttgctcgagtgtaccgttatgtcgtttggactcactaatgccccggcctttttcatgaacttgatgaaccaagtgtttatggaatatctggataagtttgtcgtggtgtttattgatgatatccttatctactccaagaataaagaagagcatgaagagcatcttcgtcttgctttagagaaactacatgagcatcagctctatgccaagtttagtaaatgcgaattttggttgcccgaagtgaagttccttggtcatgtcatctcaactggaggagttgccgtggatccaagcaatgtggagtcagtgctaaattggaagcaacccaagacggtttcagagattcgtagtttccttggtcttgcggggtactaccgcaggtttattgagaacttctcaaagattgctagaccaatgactcgactgcttcagaaggatgtgaagtataagtggacggaagagtgtgaacagagtttccaagaattgaagaaaaggctagcggctgcgccagtgttagtcttgcctgatccaaggaaaggttttcaggtgtattgtgatgcttctagacatggtttggggttgtgttttgatgcaagatgggaaggtgattgcctatgcatctagacagttacgcccccacgagaataactatccaacacatgacctagagttggcatctgtagttcatgcattgaagatttggcgtcattacctttttggtaaccgtacggagatgtatacggatcacaaaagtttgaagtacattttcactcaacctgatttgaacatgcgtcaacgacggtggttagagttgatcaaggattatcatccaggtaaagcaaatgttgtagcagatgctctcagcaagaaaagctactgtaagatgttagaaggtcgacacctaccttgggagttatgtgaggaatttgaaaagttgaacttgggaatagtcaacaaagttttgtgccgctttagaagctcagcctactctttttgatcaagttagagaggctcaaatgaatgatcctgatatccaagaaatcaaaaagaacatgagaagaggtaaagccatcggctatatagaggatgagcaaggaactgtgtggctaggagaaagaaattgcgtgcccgataataaggagctaaaggatactatcatgaaagaagcccatgaaactttgtattccattcatcccgggagcactaagatgtatcaagacctgaagcaacaattctagtggccagcatgcgacgagagatagcagaatatgtggctctatgcgatgtgtgtcagcgagtcaaggcggagcatcagaagccagccggtctgctgcaaccgttgaagattccagagtggaaatgggaggaaataggaatggattttatcaccggtctacccagaacatcggtaggacatgattctatttgggtagtggttgacaggcgtactaaagttgctcatttcatacccgtcaaaacaacctacatgggaaataagctcgcagagctatatatggcaagagttgtatgtttacatggcgttcccaagaaaatagtgttagacagaggtagtcagtttacttcgaagttttggcagaacttacaagaagggatgggtactcgtttgaatttcagtgctgcctatcaccctcaaactgacggtcagacaaaaagagtaaattaaattctagaagacatgttgagagcctgtgttctagatgtcggtggaagttgggataagaatctgtcgtatgctgaattctcgtataacaacagttatcaagctagtcttcaaatggctccatacaaagcattgtatggtcgtaagtgccgtacaccgctcctttgggatcaaactggtgagcgtcaagtttttgggacagatgtattgcgagaggcagaagaaaaagtgaagattatccaagaaaggttgcgagttgctcagtcgcgtcaaaagagctatgcagacaatcgtcgtagggatttgactttcgaagaaggggattatgtatacctacgggttacgccgctgcggggagttcatcgttttcagaccaaagagaaattggcaccgcgttttgtgggaccttttaagattgtgagtcggagaggtgaagtagcttatcaagtagagttgcctctgtcaatggagggaatacatgatcgtttcccatgtgtcgcagttgaagaaatgtttgagtgtacctaccgaggaagcagatcctgagcgtttagagattcaagaagatttaacttatgttgagaagccagtcagaattttggaggtgagtgagagaaacacccagaatcgcgtcatacggttctgtaagttttagtggagcaatcattcagaagaagaagccacttgggagcgggaggatgaattgaagtcagctcatcctcatctttttgccagttcttctgaatctcgaggacgagattccgtttaaggggggtaggtttgtcacgccctgaaaatcgcctaatttaataattcaatttttaatgcatttttagaaattattttaaaaacctacaagttaaactctaataatctaggaaaaatttcaacacaaaattgagctagataaaattttattaaatactttgcttgcttatctattttctagatttttctgggaattatttgagcaagggaagtatttttaataaatgaaacatcatttcacgaattattttaattgaaaaagtctttaaaatcctcccctaggctgtttccggcccaacatccctgtccctcgcgcgcggccgtgcagccacgccggcccaatccaagcctagccgtccctcctctcctctagccgccgacatatggggcccacatgtcagggtcatcccctacctccggccgggccgagccgagcccgagcaccgccgtctctcctccgattcaacctcaaccggtcgcccccgagtccggttgcttgaggggaaatcatctcctccttatcctctccctttcccctagagtttcggagatcaattttgcccagataaaccaaatcgaattcgttttgagtttatctctcctaactaaccctagtttttcccggctcgattcctctcggttggagtccgatctctctaatccaagcctatataaagcatcccctagtcgtcctcttccgtttgccccaagtcccgagtcccgccgttgttcgtagcggcgccgccgtcgccggcgactctccagtcgcgccgcgccaccgctagcgtcgccgccgtcgctgtccgtcgccgccgccgggtttgcacggtggaggagtacctcggctgccccttcgccgtcgtcgcaagccgctggaacgccgccgccgtcgtcgagtcgagccgcgccgccgtttgtcctcatcgccggtcgccgtacgtcgttgtccggcgtagtttcttgcaccggtgagttcgtgtcgtcgtcctcttcgcgtaggtgtccttggatagcccaaccgagctctctatcgctagtggtcgcgtggagccgtgccatggccagcgatgttgtcatcgatgatgtcataaatcctttttattagttttttctattagttaaaaatcgattaaacttcggaaattcataactaaatcatcgtaactcaaattcaagtggttcaagttgctaaattcatctaaaatcaagatctacatgttaaaaatatccacatgtactgtttatgcttgtttttgtactgttttgttgatttggtttatttgctttagtttccgacattccggaggagagcgtttacgctgaggaaggttcagaagtgtttgaagaagctcaaggcaagtcacacagatcccaaacagcgcttttagcatgttgaacatgtttaaagctaatgttttatttcaacttatgcattattttcgaatgtcgtcgggtggtgagcctttcccagttatttaatggccgacaatgactttattttcctatgggtaataaattgaatagcttggaccttatatattggtttggttcagctaagtgctatataggtataattgcttagccatgcttagaaacattagctcatcaatggggttaatcatattacgatattacttatggttatatttagtggtagcttacgatggttaatcgtgttatgataattaattgatacataaacctgatgaaaggtgggttgtgagtacatggttttgatggtcgtgctcataacaattaaggactggttgacgagctactgttgtgaaacatttaccgtgccaaccacaagccagcgtgagcaacggctttaccttttgtatagcatgattcattacggggtgccagactgtgaagcagcgagaagtccgtgggggtcgctggggagttcgttgcctctggttatgagggggagattatgatccacgaacggtgcactgtggtgagttgtgttgtatgagaggtattgtcacagttcttttccaaggtaccgtggtggtactgaggtgcatggtgacatgttgtagagttgtgtcttgtgggtacagtggtacatctctaatcagagtaaaactattcgaatagccgtgcccgcggttatgggtgggtctaacaatgtttttcgtgattagtctcacattactcattattaatgaaaatactgtgatgactaaattgactcctggtttggaatggtatattcctggtttagtcttttgtttttttttccgctgcgtagaactttgttctttgagaggaactatccacctctgtaataatttattctgcgcatattaattagttatttgatagtactctattatcaatttgttattgtgtgcctcggctgattcctggacgagggtttaacgcacatgtaagcgtttggaattttggatagaaattccgggcgtgataatcatcccctgaatcagtagattgatacaggttcatcaatctgaatcttcatcgcatacatttgattaaggctccaatgaagatttgtttacataaaataattgggtatttacaagattttggctaactattactgtagaagcaataggatgagccaactctaatattttgctatagaattaaaccatctatctaatctacacttgggaactaagttggaatgaaactaatttatatgattaaactcctggcttcggcaaaaacaagggtgagaacaatataatcatcaagctattatatcaagtaatgtgtcacgtcctgataaattcatcccgaaattaaaaatcattttctaaaaggaataatagaattaattaaaattcgaaaagaaattggcaatcactaaaatacgtacaagaaaaattcgaatgtggtccggagaatttttgttaaattctccgtggtctaaaaagagccctcaaattttacttcaattttcagagcaccggaaataattattaagcaacaaaaacaattatcaaagtttactaaaaagaaaaactaaaaataaatcctccttcctcctttgggccaagcccagcccaaagtctccctctcctccctctctttccctcctctcccaggcctctcctcctcctcccggcccacctcttctctccccctcccagcccagctccctcccctcccctctctctcccgggcctcccctccctccactcctcctgggccggccgctcggcccaagccgcgcccaagccaggccgagccgagccagccgtgcacacgcgcgccgcgcgtgcgctgaccacgcgcccgacagcgtggggcccacgcgccggtcgtctccttcctcccgcccggctcctctctctcccgtgaaaccctagctcgctccctcctccaaatccgcctcattcaaaccggggattccaaaattaagtggggggttttaatccccattgattcctcttcaattccccccaatttcccccttgaatggcgccctcaatcgtcgggaacggacgcgtctaccccggccgctttccatggccgccggtcgccattcccgcctccgttccgacctcccccgtggccggctccctctcctctcctataaaatggaatccccatcctccgttctatcgttttagcctcatcccgagcctccccgtggtcgtatcacccctccccgccgtcgcccttctctttcccccgcgccggccgcctccagccgcctctccctcctcgcccgagcgccgtccggccgtgccgtcgcctcctccagcgtcgcagccgcctcctctccaccggcctgccctccgtttcgcgcggtgaccaccggaggcgcgttcccgccgtcgtccagtgccgttgccgccactgtaccacctccagccgcccctgccgcgccgctcaggtgcgggccggccgcgccgtctcctccttcggcgtcgccgcgtcgacctccaccccggcctgctctttgattcgtctggagaccgccgtcgcccgcgccggcctttccatcctcttcgtcgccggcgtccctttggccgccccttcctcctccccggctcgtcggcttgctgcgccacaaccacgtccggcatcgcaacggcaaggtcgccctcggcctcgcctcccctttgtccaaacccctcctcggtccatcgtcgtcgtctccgttcgttctcgtcgtcgacgtcccgtcgatcgcccggcttgtcgtctggctgcgctgccaccatcgtgggcatcgctgcggcgtgtcccacgccgtcctcacctccgtgcagctgctgccggctgccctcatcgcctccccgtcggtcgtcgtcttcctccttcctcctcgtcgtggcgttcgtccctccgtcaagccgatcgcgttcgccgcccgcgtttcgtcaagtgtgcagcagccccgtcatcgtcttcgtcctcggctccgcgtcgtcaagccttgtgccggccgcgtctcgccttcgtccaaggatcgctgccgaagtcgttccctcgccgttcgcctccgtcgtccccgagctgtctccgccgcgcccgtttgtcgttgtcgttcccacgcctcgtcgcgtggtggtaaggatctctctcctttcgctgccccgtcctcgtcctttcggtgtcgcccgtgcccgttgtgcggttgtcgaccccggtgcctgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtggaccgtctctgtgtactcggtctactgtggtcccttaggttgacatgtggggtccgcatgtcaacagcgcagccttcctgtcttttccaggctagcgcttccacatgttttatagttgcaaagcctaattataataatccgtaaatctccatgtaacagcattaaacttcggatgaccatgtcttggtcatacgaactctaaatcgacccgttcaagtctcctaatgtttgttataacctaaagaaccgtgtgctttctttttatgtattgttatttcttctttataggcttgtagctttgcttgtgtgcttcgcgtagcttctatcgttccggaggttccagaagcgtggttcgcgggtgtcgccgaaggttcggaaggccgttctctctgagcaaggcaagtcacatcatccttgagcatattgaatcccagtttataaaattattttgatttaaattaatgcattaccgctttatcactgttttatttagccatttatatttacctttgttaagacattattattgctattgttattattacctatttcaccctagaataaacaaaaccccaactagtgggtactctattcatggttccactagtatgaatttaggtagatgcttcgctgattaataggacaacattaggtggtttttataactttagactttgtgaatattcatatctcttggatactatggaatggttggcttatggtggaattggacatacccctctcttcctctttcaaaacccctaaaacctgttttctggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggatgaagtcggggctcgatggacatctctaggacaaatgaaggctacacgagctgtggcccggtagtcgagatgtcatggcacagggttggtgccctgctgctaggggctcagtcctaccgacctgtcccggaggttccggccgtaggtggggttgggtcggtactcttgtctatggctaggatgggttggaaactatgtcatgtcttccgtccatatgccgtggtggcatgtggcacgtggttgcacgtgaggaagacgtgtcttgtgggtaaagatgtacacctctgatcagagtaaaacctattcgaatagccgcgccctcgattatgggcaagcctagcaatgtaccaaagttagtgtttttaattcttaaaacctgcttaacaactaaaatgtggaatggttggcctgggttggcttgggatgagctgggacccagggtcgggttgccagttcggtctgaatcatcgtaggccttgggttaaggcaggttcgtgtgggtccacggccttgattaataatactgtgtagctctaggatcatctttataaaatagctttgggcaactaaatgacttttaaatgctatttactacaaaactaaacccctattattatctccttgtactcccttgcattaatcatgcatctcccggtgtgacttgctgagtacggtggttatactcattcttgctctatctttccccccttcagtaggagaagctttggagaagaagtcttaggtggagtcctggcttataccccagttgagcgcctgtgaagatggagccgtaggcccgctagtccgctgctgtttatttttgtttgtcaggcctcaagtgcctttgtaataatgtaaatattatcgacataataaagatgtgccttttgtatcatgtttgtttggtgtaccccggcttttcctgggacggggattaatacactagcgttcgggaaaaggtaattttctcggtcgcgacataatgaatgcatgaaatagtaatttcatgttttagggtaagccctaaaccctatacaaaaaggtccccgggcattaggggaattgcttttaggtccataagcccacatggcaaacaaagcaattttacaaaaagaaccttacaagatttcaatttcaactaattaaagtccttagcacctaatgaagtggctaaacagccgggcccacatgtcggtgactcggcggcaagagaagcagaggcagcaggagagcaacggcgaccgacagcgttcgtggcggcgtattggcttgatcatatgtgggcgtcgttctcctgggaccaaggcgacgtcagtggcgcaatggtacagctggagatgattcgagtcgactggaatggcaaagtggggcgatggtggcactctggacaccgggaacaccgacgagcgcaccagcaagtgttcgatctatgccaaaaaagaaacaaagaaaatggatcgatcaagcagagaaggaacttcatgaatcactactacagaaacgattttcctggacagggaccttttagattccgtgcgggcggtatctcgttgcttctgggaaaaccagctcattttcgcgtgcggtccattaaagaggacggcacggaaaaatcaatttttccgtgcggtaactcatttcttctgggaaaaatcgatttttccgtgcggtcctcttaaatggacagcacgcgaaaataagccgattttcccgtgcggacctattaagagagccgcatgcaaaaaatactaactccctctttcctctctaacccactttaaaatttcccctctttctctcctctcccctcccctctatccctttttccactttaaaatttccacgcagagcttctcctctcagtcctttctctctcacgcctctcctctcctctctccactctcctctcctctcctcccgacggtggcagcggcggcggcgcgcggcgacagcagcggcgcggtggcggtgggagtaggagcgcgccggcctcctccatgtggcggcggtggagggcgtggattcggcgggcggcggtagtccctacacggatccagcggctgtggccgtcaacgcaagaatcctgcggtggcagccgtccccgcacggatccggcagccagcctccttctccccacgtgggatccagctcccctcctctccccttccttccctccctagatccggcggaggggaggggcgacggcggcgttgtggccggaggggagcttggatccgatggcgggtggcggggaggccggcgggaggcaggtggcactatggccgtcgggcggaagcccaccgccggattctagggtttcgtttttttaaaaaaatatgttatttcgaatttttgttttcccgtgggggtgcgccacccgcacgcaaaaatcattattttcccagacccctaggtgcgtgcaggccgcctacccgctcgcaaaaatcgttacaaaaatcttgcttgtagtagtgaatggtaaaagtaggtggaaagtgagagctagttgtcaacatgaggggtagagacgaattaaaggagttggcagtggtttgaggctgtgatcccacttgtacttcactcaaccaagtatgagtggctatctattggccccatgtagatgtttcctatgagaagatgagaggtatggtgaagtttgggtgtaaattggactttagctccctctctctctttctttctctctttgaaaatataatttaggataatgagatgattcaccaaggttgtttgcaggtatttggacgacaaataggcccatatatagatgtttcctagaaggcttggagtggtagagtggcattttgggtggaaattcaatttaaacctttctctcaccttttgaaaaataaaagaagatttaaatgagagaagagcagatgatgtgttggctatggttgtatgatgagtgggccccataaggacttggtcccacatttaagagagatgtagaaggagagaactagaagctctaaattttccatctgttggcactatcacactaaactatattaatctctttctctcattcatttaatttagaattaagaggggggtgacagggagacaacaaggtagacaaggatttgatgcttcaaggtgccaagttccaaagtttaattacttttgcttttaccatggtttgttgtcactaatgactccatttgaaccaggataataactatgttattttatgcatgtggcaatttaattaacaacataataactatattcatcgatcttaatttgtatttctgaatgtcgccgtagcgttagcacgggcagattactagttaataataaattaacacacatgcttaattaggtactactccctctattccataatataaggcatgcatgcaagcatgcaattaactatgacatcttcttcattaagttattacttttttaaatcctttactctcatgttatctaatcctattggatgcatgcattatatttattaggatgattcaaactacaagatgataataattttttcttggtctttgagttaagggtggttatactttatattttggaatggagggagtagctgtcaacaagttaattagggcctgttcactttgatgccattttcaaccatatcattttttgccaaagttaccaaaaaatatctacgtttagttgttgccaaatctggttaatacataagaaatcctgccaaaattttggcaatgcatgaagaggaagtacagaatgatgccgattattattcaaggccccaagccacttgataatgacatcgatgtgtacctaagaccactggtcgaagatctgaaactgttgtggaagaaataaggtgtccccgtgtgggacgaggacaaacaggaggagtttaacctactagcgctgctattcgtaaccatcaacgactggcctacaattagcaacctatccgggcagtctaacaaggggtacaagacttgcactcactgtatggatgaaacagaaagtacatatcttaagcactgtaggaaggttgtgtacatgggtcatcgtcgattccttgctgcaaaccaccctgtacggaagaaaggcaagcactttgaacataaggcggaccaccgtacgaagcctaaacatcgcagtgagaaaatagtgtttgctatggtgaaagctcttaaagtagtgtttggaaaggggcctagcagccagcctattgatagcgaacatggtcacgtggtgatgtggaaaaagaactctatattttgggagttaccctattcagaattcttgtacgtcctccacgaatataaagcgaataataaacacgaaggagaagaagttcacaaacctaaagtctcatgactgtcacacgtgtggatgacacaactgctaccagttataattcagggtatccttccagacaatgtccgggcaacaataacaaagcaatgtgctttcatgaacgcaatttcgcagaaggtcatcgatccggatagattggaagcccttcaaaatgaggtggtgcaatgtcttgtcagctttgagttgatatttccaccttcatttttcaatataatgacgcatctgctttgtcaccttgtcaaaaagatcggtattctcgggcctgtgtaactacacaacatgtttcctttcgagaggtacatgagcgttttgaagaagtatgttcgtaaccgtgctcgtctagaggcaagcatcgccaaggggtatggaacagaggaggtcattgaactctgcgtagaatttatcgaagaccttcgcccaatcggggtgcctgaatcacgccatgaagggaaactacggggaaaggggactctcagaaggaacgcagtaatgacggtatacaacaatttattccgtaaagcccatttcacggttctgcaataatcttcattggtggctccttacatcgaggagcacttggctctagttcccgccagaaacatcggtaagtccgatgcatggattacacggcatcacattgataaattgcccgtgtggctgcgacaacatctcatgggtaacgaga

SEQ ID NO: 13099 - DNA, 657 bp, Oryza sativa
cgtatgcgagtatgcccacttcctatcaacccaaatctacaccacacgagagctcggtatacgtatatataaaccattcaaaatttcattgcgtatcgatttgctgtttattaatttcatatattcatatgtcattatttttcgaatgatagtgtattcacatgagggacaatctcccacacaaggattatatcacggctgttcaagaacaactgatgagattcatcaacgaagaagtccttaatcccgagggtgaattctactacaacggatcgacaattcataacgtcggtccttcttcttttgacataatgccggcgtcaaagtcgtagctagctagtgagcaaatgaattgtactatacatgcatgtatatgtttatagatgtacacatttactttagtgtaaatatatattttggtaatatatatgcacataaaatgttaagtgctttaaattatacatgtgtaatatatgtatttatacatatgcatatgcatatatatatatatatatatatatatatatatatatatatatatatatatatatatatatatatatatatatatatatatatatatgtattccatatatatatatgtgcgtaatatatatagcgtaagactattgtacatatagaataactattctatac

SEQ ID NO: 13100 - DNA, 459 bp, Oryza sativa
atatatatatatatatatatatatatatatatatatatatatatatagagagagagagagagagagagagagagaaaaactattctacacccgggtatagaataactattctatacccccctacctccagggggcaaaacccaccccacacctcggtcaaagctccccatctcggtcaaacccgcccttcactttccccaccacctccactcttatcagctctcgtctcagaacaacgtagtaacgcgatgttcatcgtgcagtaacatcatgtcttacttgcagtaacaatattgaaatgtagtcataatataatcatgacggatctacttttgataagcactttttttctaacatcatggtgcaaatggtttttaaaagtagtacatgatgtgagagatattacccttcaaagattggttttttaaaaatttggctctccacgatactatatcataa

SEQ ID NO: 13101 - DNA, 1093 bp, Oryza sativa
gcctctcccgtgaccggcactccatccttgccctataaaacgaagccctcctccttcctttggtccattttgctctctcccgagcccctagccacctccccatcacctgcccctctctcctgtaccgacggccatctccggccgcccctgccgcatcgcccgagcgccgtccggccgtgccgccgtcttctctggcatcgcagcagcctcctctcccccggcctgccctccgttttgcgcggagaccactggaggtgcgcccccgccggcaacagtggcgttgctgccactgtaccacctccagccgcctctgtctccttgcctgagcgccggccgacgtcgccaccacctccctcggctccgcgatgccgccatcatccccggcatcacctcctcctcgcccgaagctcgccggagtggcctcctcgtcggcgtccagtacctcccggtctccggtcggctcctgtacgtcgccggtacgccgatcgacgtcgccgtctcctccgtcgacgtcgcagcgttgtcctctcctccagctgctcctctgtttcgccggaacgccgtcgcccgtgccggcctctccatcctcgtcgtcgccaacgtccattcggccgccccttcctcctccccggctcgtcggctcgctgcgccgccaccgtcatcgtcatcgcagcggcgtgttcagcgccgtcctcttctccgtgcagccgctgctggctgccctcgtcgcctcctcaccggccccggtggtcatcatcgtcgtcctctcgtcgttcccggtcgtcgtggcgttcgtccctccgtcgagccgttctcgtccgtcgtccgcgtccgccaagcaagccgcggcagccccgtcctcgtcttcgtcctcgactccgcgtcgtcaagccttgtccaaggatcgccgccgaagtcgttccctcgccgttcgcctccgtcatccccgagctgtctccgccgcgcccgttcgtcgttgtcgttcccacgcctcgtcgcgtggtggtaaggatccgtcctctcgcttccccgtcctcgtccttttggtgtcgcgccgtacccgttgtgcggatgtcgaccccggtacccgtgt

SEQ ID NO: 13102 - DNA, 1483 bp, Oryza sativa
aatcatcgtaggccttgggttaaggcaggttcgtgtgggttcacggccttgattagtaatactgtgtagctttaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcagtctttccccccttcagtaagagaagctttggagaagaagtcttaggtggagtcctggcttataccccagttgagcgcctgtgaagatggagccgtaggcccgctagtccgctgctgtttattttttattgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtgttactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatcatggcgttactgtatgtgtgcagtaacaactataacttttaaagtaacactgcatgttactgcaatttcttaatagcattactgcaataagaggtggtaacaaccaaacacaggtacaggacctatcacccactttgaactagtaaaatgtaaatgcaagtgatatcttttgaattcacatctttaaacaataatatctctcacaccacatattatatttttgaaccgtttgcaccgtaatgctttaaaaaaaaagctctacaaaactagatccgtcatgactatattttaactatattttattagtattactgcaagtaagg

SEQ ID NO: 13103 - DNA, 5944 bp, Oryza sativa
ttcctgcagcccccgtaataaccggaacccttttgaatagctcgtattaaaatctcatgggtggttgtaaacagaatcgatagatcgatccgcaggttatctcgatcagcgattcgaaggcgacggcggcgcgacccatcggctattcgaaggtcgtggcatctgctgatgtctacgccggcgtcttccattaccaatgccttcggtatgactatccgcaggcgactggctggccgaagagctatgaccagacaacgacgccgttgatcttcgggcaagtcagtgtggccgtgcggcgacggcatcgatgcaggcccatgctacgatcaagacgacgttgagcgtcgtccggaactggaacatcgactatactgcaggcaagtccttccttcttccgattttcttgatttgctttttctacgttgcaaatcgataatgcatgcatgcagatcgaatttgtttggtgcatgcaaatgcgagatgcatgtatcgtggacgtagatggtgctgatgacagaacagcccagcatgtgtggccgtgcggcgacagcattgtcgtcggcattgaaccgtgattcctagctaatggtgttaatccaggaagacacattcttgtccacctctctccggcgtgcggtcagcgtgatcccatcgatgttaaccgagatctgtctgtggggatgcagagattcttcgatgagccacatcgaggggtgatcccgttatgttttgttcttagtttccgaaagtctgcgttgatctttttcttggtctggtaatgtccattcagaattcagtgcccttctagggtatttcattaatttaggtttattcataatgcaacagccgatactttgccagtgattcaggcatacatctgaatttgcacgtgaaaagcatattaattattctattcaactgaaaagcatatgcatccagcttccatggatagcaaatatacgacttatctaagaaatactggtacatacttatttatatactgagtgaaaaaaagtagtatacatagtatataccgatcaaacaagaaggcagtataacctcctttagcgaggacgatgcagtataccgaccaaacatgacaattagtacatgcagtatactgacagaacaagtagtgcatacaatatatactcaaataataacaaatgcatatactgataaaaaaaagaagcagtatatactccttcaatgaggaatgtagtatatatacactgaccaaagagcagttcataccgattgtagaagaaataagtatataccactccgagtagctgttcataccgattggagaagaaataagtatataccactccgagaaaagtcagtatatatactcgttccaaaaaaaaaatcagtatatactcattccgtgaaagaacagtatatactcattcgctcgttgcagtagtatatactgcgcgtaccaataaaaagacataatcagtatatatatatactcgttagttctggagtaagtatatgatgtgcactagggttcccgatcttccaaaaggttctgataaacaacgatttgggcggagtcgccacacaaatcgatccggcttcttgaacgcgcacgctcttgagccccgcaattgcagcaccacgtctcctctggttatcacccgtgtcgaaacgcgaatgaccacaccgagaaggctaatccctgtttgccaatcgaagaacacaaagaagaacgagatagaaaaacaaccaaaattgcagatgaatgattaagctcacgagttggggtcttacaaaccgaactagcggcgaaactgttctcgacagattaatctaagcaaaacccaaaaacctaaacatgatggcgggtactgatatatagagtttagggtcgtgcaaacccctctcgatgcaaccctaatgggttccaacacgatacacgggccaaaggcccaaatacggtgacgcagcactgggacagattttggacgtcaaattgttcggtcaattcctgttgactcggaaagaatttggatgtgggagcaaaaccatttgaaaggttaccttcttagctttccatccatataaagaacgccccaatctgagcacgtatgcgacctgggcgcccgttttagtgcagactggtcctggactccgaattgcacccgacgtcgacttggtttgggcctccaccttgacttggacgtccccgatggtcctccatgactctaagtccttctccaagtgtctctttgtcccctccattgttcctaagcacaatataatcattaggttgcaatctattctcgaattcatacaaagaagaacataggaacgaactcacctctaaatttaattgtcgcgcacgagctcttgttatcggtccttgaatgaccattggaggattgttgtgtgtatccgaggtagtgatgtccgcatcatcctccccctcttgaattgatgtcgtcctcgactcaagctcatactcttctcccaagtatggcttcaaatctgaaatgttaaacgtgggactaaccccaaactcgggaggcaactcaagtttatatgcattatcattaatcttctcaacaattttaaaagggccatcagcacgaggcatcaacttagactttctcaattccggaaatctatcatttctcaagtgcaaccaaactaaatcacccggttcaagcttaacctcttgcctacttttactaccagcaattctatacttttcagtcatcttttcaatgttgaacttggttgactcatgcattttcaaaataaattcagcgcgtgccttagcatcattatgaaccctctcactagtaggtaaaggcaacatatcaattggagcacgagggttgaaaccatacactacctgaaaagaacttaccttggtagtagaatgtgttgcccgattgtatgcaaactccatatgaggcaaacattcttcccacatcttcaaatttttcttcaaaatagccctcaacatggtacctaaagtgcggttgactacctccgtttgtccatctgtttgtgggtgacatgttgtagaaaacaatagctttgtacccaacttgttccatagcgtgcgccagaaatgacttaagaattttgcatcacgatctgaaacaatagaaggcataccatgcaagcgaacaatctcatggaaaaatagatcagcaatatgaacagcatcatcacttttatgacatggtatgaaatgtgccatcttagaaaaatgatccaccactacaaaaatactatccctccccctcttagttctagacaatcccaaaacaaagtccatagaaatatctgcccaaggaatagaaggtacaggaagaggcatatacaaaccatgtggattcaaatgagacttagctttctgacaagtggtgcaacgtgccatgaacctgtcaacatcctttctcatccttggccaaaagaaatatgtcacgcccagaaattcactagtaatttccgaacttatttgtgcataaaatcctcgtccagaaatcagccgaggtacacaaactgacaatttaatatacagattcatcaaattaactaaaacgctaaatacttacttaagaggcacttagtcctcaccatgaagaaaactgcagcggaaaataaaatctagcgaatctccggctccactcccacaggcagctcaactcgggtataagccaaacgtcttctccttctggatcctttttcttcaactgaggttgattgattattgcaaggtgagcatatgacatactcaacaagccacatagcaaatatgcaagtgcacaaggataccaaaggatggcataatataggctcatttgcaaaagcagcatttagcaaaacttttaagagaagtaaaacagtggagtagttaatcagaaattttaatcaacactgaacagcacacccatgctgcacaggcccaaccatcctgaacaaccatacccggctgtacagatctaactccaaaccaggagctaagcaaattattaccagttataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcgaattataacccataggaaaataagatcatcttcggccattaattaacggggaaaggttcaccacccgatgacattcaaaaataatgcatagttgaaataaaataatagctttaaacgggttcaacatgctcaaagggttgtttgggatctgtgtgacttgccttgcaataatcggtcttcaattaatcttcttgaatacttccggcgtactcgcgaaccttcgcaacgacggaaacgactaactttcacgcaaaacgaagaaaaagactaataaaaaccaaataaacaatacataaaaagtaaacaaacatgtagatcataattttagatgaatttagcaacttgaaccactcaaaaccgagttacgatgatttagttatgaatttctgaagatttaatctattagaaaaacaggaaaaagaaaaacgatgatgacgtcatgatgacctcatcaatggcggccgaaccaagatgacgacctcgccggagattggatggtcggctgcgactttggaggacatttacacgtagaggacgacgagacgaacccaacggtactcaccctcgaaccaaacgacgaacgatgacggccggcgacgaggtctagcggcggcgcggcttcggtcgacggcttcggggctccggcgatcggcggcttcggggctccggcggccgggcttctccacacctcggcgcaccttacggcggtgacggcgactggcggcgacgacggaggcgacggcacgacgcggatggagctcggccggcgacgacggcggggtggagcacgtggcggcggcgctacgaggcacgggagaggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacggttagctccgatttttgagggtaaagatagaggaggataagaggaatatttcccctcaactaaattggaaaaaggagcaacggggaggcgagatttagaaggaagagacggcggcactgtgcacggcacggctagctcgggatctgcctgagctggaagatgaacagtagctcagggaggaaaagtagacttttccggcttggctgagaggagaggaggcggctcaggttgggccggcgaaagagagaggaaggaaaggaaggaatgggccgaaaatggcccagctgaggagg

SEQ ID NO: 13104 - DNA, 16193 bp, Oryza sativa
  unsure (1)..(16193): unsure at all n locations
atccatccatgctttatatttagaaattttatttcccacatttaacttcacttgtaaattaatgaacatttaatataaattctaataataattcattaaataatttataaatcctgaaacaaaaatcaggatgtgacaaatacatggccaaaacatcttccgtcttcttagctccaaaatgtcccatcaactctcctccatgcgcttcctgtatcaacaaaagacgaacggaaccaactggaatgcatagacggttagctctataaacaaacccaccattgatcacaaatttgttccaagtacgtccctctttacaatttatcatcacttcattaaaatcaggatcaagtgcatattgttctttaattgattcaagtccaaaaatccgacattcaagttgggataagaaagtatagcgcctagacaaagcatctgcaatcacattatctttccctttcttgtgtttgataacataaggaaaagattcaataaattcaacccattttgcatgtctacgattcaaattattttgagagcgaagatattgaagcgattcgtgatcggagtgaataacaaattctttaggccaaaaataatgacgccacgtttctaaggaacgtacaagagcatacaattccttatcatatgtggaataattcaaaataggaccatgcaacttctcgctaaagtatgcaacaggcttaccatcttgcatcaacacacctccaatgccaactccagtagcatcacattctaactcaaaagtcttaccaaagtttggaagttgtagcaaaggtgcatgcgtaagcttctccttcaaaatgtcaaaggacttctcctgtgtctttccccaatggaagaccacgcctttcttcgtcaactcgttcaatggtgcagcaaaagtactaaaatctttgacgaaacggtggtagaatcctgcaagaccaagaaagctcctcacctgtgtgatggtttggggaaccgaccaactcctgatggcttcaattttcgactcatccacctcaattccctgtggagtaacaacatatccaagaaaagagactcgttccatgcaaaagatgcacttttcaaggttagcaaacaaacgtgcatcgcgtagagcattaaaaacagcacgtaaatgatccatgtgttcatccaaagacttgctgtaaatcaatatgtcatcaaagtacactaccacaaatcgtccaataaaaggccttaaaacctcattcattaagctcatgaaagtactaggtgcattagtcaaaccaaaaggcattactaaccactcatacaaaccaaatttagttttaaaagctgttttccattcatctccaagtttcattctaatttggtgatagccactacgcaagtcaatctttgtgaaaataatatagccacacaactcatcaagcatgtcgtctaacctaggaataggatgacaatatcggatagtaatattattaatggctctacaatcaacacacattcgccaagaaccatctttcttaggaaccaaaattacaggaactggacagggactaaggctttgacgtacatacccgcggtcctaaaggtcttgaacttgccactgaatttccttagtctcatctgggttggttcgataagcagcacggtttggcaatgatgctcctggaatcaaatcaatttgatgctctatccctctcatgggtggcaatcctgggggtatctcagctggaaagacatcctcatactcctgcaaaaggttagtaacaacaggaggtatcgaactagcaatatcatctaaagaaaccaaggcttgtttgcatatcaagaaatagcacatatcatcatttgaaatatcaccaatgtcacatttcgttgcaagcataacaccacccttcaacttaattccctcaaccttagaactaggtgaaagcttatcctttttaggtggaaaaacagatttagccacttgctgattttcagattcatcaactttcaaactagcagctcgttctttatcagcttctacaatttcagcaggggtcaaaggtagcaaagtaattttcttcccattatgcataaaagtgtatttattactcctaccatgatgtgtagcatcattatcatgttcccaaggacgccccagcaaaagtgaacaagcttgcataggaaccacatcgcaatcaacagaatctgcatatgagccaatggaaaacgaaaccctacaaacctgtgttacctttgctcttccggaatcgtttaaccactgaatatggtaaggatgtggatgtgtacatgtagtcaagccaagcttattgaccaaatcagaactcaccaagttgttgcagctacatccatcaatgatcacacgtgcacgacagttgttgatgacgaaaaaaatctaaaacaaattatggcgttgcaacctgtcatgctgctgtacctgcgtgctgagcacccgctgcacaatgatggttctgtagtccgttgtgtcatcacgaccaaaaacttcgccatcctcgtcctcaacttcttcttcctcctcttcctcttccatgtcggaggtggtgatgtagccatcttctgtagcaacataggcccgttgactagggcaatctttttgcacatgcccaaatccttggcaacggtggcactgaatgcgtcccgtcgaggtgacagatgaggcactcttggcgggtacctgcgaggaacctttacttgactctgctggtcgtggtggtggagatggttttggtgccgcagaagctccggatgctgctggtcgcttgcccgctggctgggacgcccgaaaagagacggccttgggcagtcccgcagatggcgtcgtgtcacgtcctgataaattcatcctgaaattaaaaatcattctctaaaaggaataatagaattaattaaaattcgaaaagaaattggcaaacactaaaatacgtaccagaaaaattcgaatgtggtctggagaatttttgttaaattgtccttggtttaaaaggagccctcaaattttacttgaattttcagagcaccggaaataattattaagcaaccaaaaacaattaacaaagtttactaaaaagaaaaactaaaaaaaataatcctccttcctcctttgggccaagtctggcccaaagtcctccctctctctctcggcccagcccaaagtctccctctcctccctctctttcccctctctctcccgggcctctcctccccctcccggcccagctccctcccctcccctctctctcccaggtctcccctcctgggccggccgcccggcccaagccaccccctgcccgagccagccgcatgcgcacgcgcgccgcacgcgcgctgacgccgcgcgcccgcgtggggcccacgcgccggtcgtctccttcctcccgcccggctcctctctctcccgtgaaaccctagctcgctccctcctccaaatccgcctcattcaaaccatggattccaaaattaattggggggttttaatacccattgattcctcttcaattccccccaatttcccccttggattgtgcccccaatcgccgggaacgcccgcgtcttctccggcggctttccatggccgccggccgccattcccgtcgccgttccgccctctcccgtgctcggctcgattccttccgctataaaatggaaccccctcgatccgttctccagttttagccccctcccgcgttctcccgtggcctcaccacctctccccgccgccctcctctctctcccacgccgccggccgcctccagccgcctgtgccacctcacccgcgcaccgtccggccgtgccgtcgcctctcccggcatcgcagtcacctccccttccccggcttgccctccgtttcccgcggagacccccggagttacgttcccgccggcgtccagtggcgtcgccggtgcgccgatcgacgccgccgtctcctccttcgacaccgtggcatcgttccccggtcgtcgtcgtcgtcgtcctctcgtcgttcccggtcgtcgtggcgttcgtccctccgtcgagccgttctcgtccgtcgtccgcatccgtcaagcaagccgcggcagccccgtcctcgtcttcgtcctcggctccgcgtcatcaagccttgtgccagccgcgtctcgccttcgtccaaggatcgccgctgaagtcgttccctcgccgttcgcctccgtcgtccccgagctgtcttcgccgcgcccgttcatcgttgtcgttcccacgcctcgtcgcgtggtggtaaggatccgtcttctcgctgccccgtcctcgtcctttcggtgtcgccccgtacccgttgtgcggttgtcgaccccggtacccgtgtaccggtgtcggtagtcgttcgcttgtgcgtgtggtgaccgtgttagtgtgcccgctcggtagccgcgtgatttccacgtgtgcaacccgtgtggtgtttagtggagtccgtttgtcggccactcgcctcggttgacacacgggatccacttccgtcgacccgtggaccgtctctgtgtacccggtctgccgtggtcccttaggttgacatgtggggttcgcatgtcaacagcgcagccttcctgtcttttccaggctagcgcttacacatgttttatagttgcaaagcttaatgataataatccgcaaatctccatataacatcattaaacttcggatgatcatatcttggtcatacgaactctgaatcgacccgttcaagtctcctaatgtttgttataacctaaagaaccgtgtgctttctttttatgtattgttattgcttctttatagggtttagctttgcttgtgtgcttcgcgtagcttctgtcgttccggaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaactaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggtcttcgggcccctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagttgcggcccggtagtcgagatgtcatggcacagggctggtgtcctgctgctaggggctcaattttgcctgcctgtccgggggttccggccgtaggtgggttgggtcggtactcttgtctatggctaggatgggttggaaactatgtcgcgtcttccgtccgtatgccgtggtggtatgtggcacgtggttacacgtgaggaagacgtgtcttgtgggtaaagatgtacacctctgatcagagtataatctattcgaatagccgtgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcatgtgggtccacggccttgattaataatattatatagctctaggatcgtgtttacaaaatagctttgggcaactaagtgacttttaaatgctgtttactgcaaaacttaacccctagattattatccccttgtactcccttgcattaattatgcatctccagtgtggcttgctgagtactgtggttgtactcattcttgctcaatctttccccccttcagtaagagaagctttgcagaagaagtcttaggtggagtcctggcttatacccccagttatgcgcctgtgaagatggagccgtaggcccgctagtccgctgctgtttatttttgattgtcaggcctgaagtgcctttgtaataatgcaaatattatcgatataataaagatgtgccttttgtatcatgtttgtttggtgtaccccggcttttcctgggacggggattaatacactagcgttcgagaaaagacaattttctcggtcgcgacacgtcgtgcgcagagtgtatgtgcttgccttgctcttgccctgatggtcgcgcccctgtaattccttctctgcaagcatagcaaatcgaaacaactggttgacagagttaaattccttataatcaacaatgttctgaatttcctccctcaaactagtgtagaaacgacaaatagcatcctcgaccccctccactataccacagcgtctcacacccttctgtagctcaccatagtaatcctgtacagatttatccccttgttccaaacgcatcagtttcttacgtaaatctctatgataagatggaggaacaaacctatcgcgcatagctaccttaagttcttcccaagtagtaggtagtaccccctcatcagataacccagcccaccacataatagcaaaatccttgaactcactactggctcgtctaactctatgttgctcgggtacaaggtggacattaaacttttgttctactgtcatctcccaatcaaggtattttttagcatcatcatatcccaaaaaagatggtattttaaacttaaccttagcataaggatcatcgggcacacgatcattattattaccttgttggtggcgagtgccacccatacctgtgcggtttgtgcgtagacgacgtcgtagccatgcttgccttgtagccggtgcgtcaatatagccactggaatcatacaccgtgtcttcaggatgagcatcgtcgtcaccactcaccacttcctcattggaaggtgtctccaacacggcgacccgatcagttagagtggatatccgcttgtccaacctctccatgtggtttaggaagccgattttagtgaaggcatcttggacagactttgcaacagcctccgtgatgtccttttgagtattttgttggagagttcgtagttgctcttggctgacacagtcagcaaaatcctggggactcttctcgccttcgttacctgacattgaaacaccaaaacagaaacaaaacggtgaaggttatccctaataatctactacgcaggtgtagtggtgcctctcaacgattctcagcaatatggagttcctaaccatggtcttataaggttcttaccagcaaagcaaaggatacctggaaggcgtagtcagcaattgcagtgatcaagaacctgtgctgttcagaagtaatatgtggagctaggaaggccaaaaatatgtttatgagtggtacacaatccaatgacagatagtaatgctgaataaaaatcccaagtcacttgcccttagttgctggtctactcgtgtcctagacagtagtgataacaaagatggctcaaagaatatgacactagtaaacagcaaagaaggactgacaggcaagcttcagcgagtttcagcaaaaactacaaaaccgaactggcagataagctcaacggagcgcgtcgtgagctcaaagcactagtggaaatcaacttttcttttttttcttttatttttttgatattttttttctttttttagaacacaaaaataggcacacctccaagttaaagctcaattggagtaggtatgtggcctatggatttttctgaaaccactataaacaaggtgcaggaacttgtgagctcgaacagacaattttgcaagccaatttttggaattttggattcgccaaaccagccaaaggcggggataaacggatataaaattttttctcttatccgaaaagttaaatttttcctgattccgagtccgtatgcaaaagttatggctgtttgaagtttcggcttccggctaggttttccagaggggatataacctagtctattttgcggtggaattgggatatggtggcagcggagttgtagggtgttctggagatgcttggttatctggatgggtgtttatgatggcggaaacggctctcaaaggatgaagcctaacacacggtgaaaggtagcggctagggttacaaaggacaaacacatgactagactaaaacacacactagaccagcaacatgaacttaaactaggactcaaactcaacactacggactctgagagagaatcatgcaaaggctaaacacggtctaggttaaggtaactaacaactaatttttttttggcttttctgtagactctaggataattgcgaaaaaaaaaactaatcaagggcaaagaaactgagcgaacctgacggtgaacctagagctctgataccacttgatgtgcactagggttcccgatcttccgaaaggttctgataaacaacgatttgggcggagtcgcgacacaaatcgatccggcttcttgaacgcgcacgttcttgagccccgcaatcgcagcaccacgtctcctcaggttatcacccgtgtcaaaatacggatgacctcgccgagaaggctaatccctgtttgccaatcgaagaacacaaacaagaacaagatagaaaaacaaccaaaattgcagatgaatgattaagctcacgagttggggtcttacaaaccaatctagcggcgaaactgttcttgacagattaatctaagcaaaacccaaaaacctaaagatgacggcgggtactgatatatatagtttagggtcgtgcaaacccctctcgacgcaaccctaatgggttccaatacgatacacgggccaaaggcccaaatacggtgacgcagcaccgggacagattctggacgttaagttgttcggtcaattcccgttgactcagaaagaatttggacgtgggaccaaaaccattggaaaggttatcttcttagctttccatccatataaagaacgccccaattcgaacacgtatacgacctgggcgcccgttttagtgcagactggtcctagactccgaattgcaccagacgtcgacttggtttgggcctccaccttgacttggacgtccccaatggtcctccatggctctaagtccttctccaagtgtctccttgtcccctccattgttcccctctattctcgaattcatacaaagaagaacataggaacgaactcacctctaaatttaattgtcgcgcacgagctcttgttatcggtccttgaatgaccgttggaggattgttgtgtgtatccgaagtagtgatgtccgcatcagtatatacggctgctaattaaaaaaagaaatattcactgctacaacaaaaatgtaaggtactccttattatgcaccgctaatacacaaaaaactagtatatagtactgctcatcgcttcaaagagtatatatactgcggcttaaaaaacagtatatactgttgcatactagaaaaggtggggatatctaaggtacgttatcaaatttgaaagcaaatgcatgccaacgatcttgttcaaatttgcacccaatccggtgtgcagctatgccacatgcatgcagtcatttggaaattaatattattaatttttttcacagctaaattgaatgctaatggatcatccattaataaaagggtgtacatacacctgggtgtatgaaagagccgtcctatatatatatatatatatatatatatatatatatatatattatcacctatcatgcgtctctaatggcgttatataaagaatgcttatcttttcgtcattaatctagtgatgatccttctgtcgtcatacagtctatgacgtccattttcgtcaccatcaagcccagaaatcatgataagatgccatgtggcctgttaaggcccatgtagtcagggccggctcgggggggggggagcgggatggccgctctaggcgcccacccacacaccttgtcaggtcccaaaattaaagattcggtaatcgacatgtttaaactgtatcaagccctggatcagtagattgatacaggtttaacaatctgaatcttcatagcatacatttgatcaaggctccaaaggagatttctttacataaaataatagggtatttacaagattgtggctatctattactgtagaagctataggatgagccaactctaatgtttaaactctatagaattaaaccatctatctaatctatacttgggaactaagttggaatgaaactaatttatatgtttaaactcacggtttcagcaaaaactccaaattgattctcaaagagagggttaaagcaaggctgagtacaacatacttatcaagctattatatcaagtaatgaatgcatgaaatagtaatttctatgtagggtttaggacctaccctaaaccctatacaaaaaggtccattggcattaggtgaattgcatttaggtccataggcccacttggcatacaaagcaattttacaaaaagaaccttacaagatttaaatttctagtaatgaaagaccttacgcctaatgaagtggctaaatagccggggcccacatgtcggtgacttggttgctggggagcagaggcaataggagggcaacggcgaccgatggcgttcgcggcggcgtattggcttgatcatattttggcgtctttctcctgggacctaggcgacgtcggtggcgcaatggctcagccagggatggttcgagtcgatgggaacgacgaagtggggcgatggcggcgctctggacaccgggaacgctgacgagcataccaccaagtgttcgatctatgccaaaatagaaacaaagaaaatggattgattaggtagagaaggaacttcatgttcccgtggttggagtgcggtgaagctcaccagagaatacgtgacatggatgaaactccttcgggtgaaaagagtaagtggaagttcttggagattccgaggtagtttttggtggtttgcatagtggaacactatgagaaatagatgaggttcacagtggcgagttggcttgattaatcactactacagggacccttttagattccgtgcaggcagcaactcgtcgcttttggaaaaatcagctcattttcacgtgcggtccttttaagaggacggcacggaaaaatcgatttttccgtgcagttctcttaaatggaccgtacgtgaaaatgagccaattttcccgtgcagacctattaagagagccgcatgcaaaatactaactccctcttttccctctgacccactttaaaatttcccctctttctctcctctcccctcccctcaatccccttttcaactttaaaatttgcacgcagagcttctcctctcagtcctctctctctcacacctctcctctcctctctccactctcctctcctctcctcctgatggcggcagcggcggtggcgcgcggcgacagctgcggtgggcgtaggcgcgcgccggcctcctccacgtggtggcggtggtgggcgtgggatccggcgggtggcggccgtccctgcacggatcctgcggcggcggccatcaacgcaaaaatccagtggtggcggtcgtccccgcacagatccggcagccgggcgccctccccccgcgtggcatccagctcccctcccctcccattccatccctccctagatctggcagaggggaggggcgtcggcggcagtgcggccagaggggagcacggatccgaggcgagcggcgcggaggccgccgctgacgacgatgacgacgacgaggaggcggcagcggcaagcaggagtggcggcgccaccactagattctagggtttcatttttaaagaaaatttatgttttttcaggtttttttttcccgtggaggtgcgccacctgcacgcaaaaatcgttattttcctagacccctaggtgtatgcgggccgtttacccacacgcaaaaatcattttagccctcacagaaaaatcttggttgtagtaatgaatggtgaaaggaaaggtggaaagtgagagctaggtgtcaacatgagcggtagaaacgatttaaaggagttggcagtgatttgaggctatgatcccacttgtacttcactcaacctagcatgagtggctgtgtagtggtcccatgtagatgtttccaatgagaagatgagaggtatggtgaagtttgggtgtaaattggactttaactccctctctctctttctttctctctttgaaaaaataatttaggatcaaagagatgattcaccaaggttggttgctgtgtttggacgacaaatgggcccatatatagatctttcctaaaaggcttggagtggtagagtggcattttgagtggaaattgaatttaaacccttctctaaccttttgagaaataaaagaaaatttaaatgagagaagagcagatgatgtgttggctatggttgtatgatatgtgggccccacaaggatttggtcccacatttaagagagatgtagaaggagagaactagaagctctaaattttccatgtgttggcactatcacaccaaactatattactctctttctctcatacatttaatttagaattaaggggggggggggtgtgggggacagggagacggcaaggtagacaaggatttgatggttcaaggtgccaagttccaaagtttacgtaatttatggctctcatttcatgtggttacatttcgaattagactaagccattgcaccagatggtagagtaaagtatgtttaacattctgaccttgagattttgcaagaggatttatggtttaatttcggtgaaggtgcaaagtaggctaattggtatgctgtttccagatttttagctgtgttgaaggatttatttgggttatcaattgatgtgataaattcaaactaaaattgctgggagcttagggtgttgtttagtatttatgggaattttggtaggatttattgctgattcatttatttttaggaattttctttagacaaagcatgcatatgcaacctatttaaaatcctcttcctatcttttggctgaaaccaagccaactcctatccctctccacgcaggcccaaaggccagccgggtaaagtctatctcttttccctcccctccctaaatcgaagccaataagtctagtttacatcggtctacgaaagagccctagtccacccctgccactgccgatgtcgttggtgctgatagatgcgatgcccacacctcagggattcgcgcggcatggtgtgcagccagtgaatcttccgccgcctcctgtccttcagtcgtctgacgaggaaaggttttaattctcctccgattccccccattgctacataagttagtgattcattggtagatctgcttgtgcttgaatgtgcaagaatgcttggtagatctgattgatgttgaatgtgcaagagtgcaagaatgaatggagtgaactaaagcatatgtcctggtatgcatatttcaaagtactgcgcatatctgtattatacacaagttagcatgcgcattgatcttttcctcttttgccgtaggccctagtatgcatatgtgtattataccatattgtattatgtagttatgctgtgaaattatatgtggaattctccattgcatatttgctcttggttaattagtttaggaaaaattgcaaatatggtttgttgtttgtcgatttagttctccgtaatactgcctaaatttaaatgtatgtttcgtgaactgaaatcagatatggttagtgctgtcataattttttaatgactatttgtccttgtgagtaaggttgtcattcctcgactgtattgcctttagtatggctataagtctcccaagactaagaaaacaaggaatgtgatagcagccgagaaattgaccatgtttcctccccccccaccctatgccttcctagtaggattcggaatactctttggcatgacaatcttaattatctcccatagtctaaaactcacaaaaacatcagaaatccgctaagaataaattaagtaaagaacatgcacacacaaataataataatcatgttgcaataaattgctaaggtcagagaccaacagatgatacattggatagtgctatggccttattaaaagcagcaagagaaattaaatatgcttgtgagcgaacacatgcacgacatacaaatagttgggaccaacagatggatcgactatagatcgctccatatggtcaacaatttattggagataaacattaacataactaggccataacttgaagcaaaacaacatattcttatgaaaggcattaagactggtagcaatgcaaatatgttgttttaggcttgtccttccatcttagcaagaactcccatttcgtccatcttagcaagaactcccatttcgtccatcttagcaacaactgtgaaattaaaatatggaaatcccattagcgcattagttaattttgtagtggaagtagagcataagatgtcttcatgttgcaagatatatgcctgaagtcgtgagattggaagtgaagtcaacaaagtacattgaggaaaatgcatggaaagacacacatatgtattagtccacgatatgctacaaagtctgtctctacatataagaatgcattgaatagagtgacttcagtgaatttaccagaatcggccagaatacatgggaaacaacaagtgttcttgcagactgagtcggagccaccagcagcaatacaaccaaaacaacatgcttttgctcgagaggatatgcagcagccgcactgtgctgcggtggcgtagtcgacagtgaggctcaagatgaccatgcacatgatcaccatcgaagtggtagtcctctttccctccattgcctcccgctgctgatgctaccttccctggttacctagctatgtttcttagttgtgtgttgagaggtgattcttgaatgtaagctgctgctcttatatataggcagaagcgttatgtgatgatgtggataatgtgcaaatggatcgtcctggtatgcataaggtgtggatggctgcctactagtatattatggatatggtgcaaatggctacctgcattgtatgtatgtatcctatgcatgtatatagttgatggatgtacatgtttgttgcacaatttctgaacaaactcttcatatctagtcctgcgtaccaaggaattttaaatttgcacgttttcgccgatggacagaaggagatgattttcagatacacttagctcatacccgtcagatgaagataaaaggcaacgagtaacactgttttaagtgtactattgagtagtccttcataagataacttagttgtgtttgtagcgtactatggcgtagtagacgagttagtaccatggctggcttgcatgccatgtgagtccatgttagtttagttaggctccccaatgtgagtaagtgaccgaataggtttagaaatggtatatttttaggtctagctagcttgcctatgtaggttaatgtgtgtgtatattatcgcacaaggtcgaaaccttttggaaattcgatattgtacttcttacaaatactacatacgtttctatgaataacacacatgcacgtttttgaccgaaagaattgagaaacaaagaataaatcatatatttagtaattggatgcaccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13105 - DNA, 2531 bp, Oryza sativa
  unsure (1)..(2531): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatccctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgatt

SEQ ID NO: 13106 - DNA, 683 bp, Oryza sativa
ccccgaccaggacttcggcaagttctcgccgatgcccaccgtcacgttcatgtcgctctacctcaactccttcaatggcagcttcccggagttcgtcctcaggagcggcaacatcacctacctcgacctgtcgcagaatactctgttcgggaagataccggacacgctgccggagaagctcccgaatctgaggtacctcaacctgtccatcaatgcgttctccggctcgattccggcgtcgctcgggaagttgatgaagctgcaggacctgcggatggccggcaacaatctcaccggcggcatcccggagttccttgggtcgatgccgcaattgaggattcttgaactcggcgacaaccagctcggcggggcgatcccgccggttcttggccggctccagatgctgcagcggctcgacatcaagaactccggccttgtctcaactctgccgtcgcagctgggaaatctgaagaatctcattttcttcgagctgtccttgaaccggctctccggtggcttgccgccggagttcgccgggatgcgggcaatgcggtacttcggcatttccacgaacaacctcaccggtgagatcccgccggcgttgttcacgagctggccggagctcatagtgttccaagtgcagaacaactcgttgaccggcaaaattccatcggagctcagca

SEQ ID NO: 13107 - DNA, 671 bp, Oryza sativa
agcaaggatccaaactctagttgtcgatctgatgttctcgccggcgcgccggcggcgggctcgccgtcggcgagccatcgtctgtcctcttgtcaagtcgccatccgtcatcttcgtcaagttgcaggcacagcatcgtcgttcgtcgtctcatcaagtcgtcatccgccaagttgcaggcagcagccaggagcattgtccttgcctcgtccacatgcatccacgcgcatcggcgacggcaaccccgtccatgtcatcagcccagtcgtcccccagctgcggctcgtcgtcaatcgcaactccgtcctcgccggctgttgtggatctggctgtcgtcatcctcaccggtgcgcttcgcagggccaaccgtcgtcgttgtatgccctcattcgccgcatcaagttgacaagtcgtcgtcccacgcctgttgctcgtcgagcgtgtcatccgtcttcctcgtcgcaggtcgtcacctgcctgccactcgtcgcggtctccacatgccactgcctgttgccgccgctcgtcgttgcggccactgccgacagtagatcctttagtcttgagtgttgttgcctctaaaccaccaagtccaagttgcatacaaggtgttcgacaaaatgcttcaaagggttgctcacagtttcctgatcatacttttgctatctaaa

SEQ ID NO: 13108 - DNA, 1328 bp, Oryza sativa
cacatatctctcatctggtcttataaactagagaaaattccttgtatacccctaaaaatttagctaatctcttctatacccttgaattttacttacttccttgtatacaaccaaaatttgattttgatcccttccatacccctcccgtcagttgaccgttagttgaccatctaatttctataaaaatgaccattttaccttcagatgaacatataaatttatgaattacattattaaaaaaaataaaagcttctcgcatgagactatcatagttatgagtttgttgtgcgatgcattatttatcccaaaattatttttatataatgaaataaaaatatgtatttattttttaaaaaaaatcataaaaaatgaggagcattcatacaagataggaccaatgttcacaataatggttttatgaatcctcccgataaaaaaaatccattgtcctattaaaatttcaaataaaaactttaatttattacttttgttttattttcaaaatttatgtcaaaattttctgcattaattatttagtctcattagtttcataaaatgcacatactgcgcactcaaacaaaattttcaattgtttctgaaggttatattcaaacctaaagcatcaagggcaaaaaggtcatttgcaaccaaacgtcatagtgaaatgatggaaaatgtaacggtaggggcatggaaggaatcaagttgaaatttcaggggtatagaagggatcgggtaaatttcaggggtacggaagggattgggtgagttttcaggggtacacatggaatttactctataaactataacacagatatgtaaattttgtgaataatgttactaacactttatcggatgaagaaatgacaaaaataaaagttatagatcttgatgagttatacaactttgttgttgatgactttttcagttgaaatcatttagtatttgaaaatattgtttgaagttgtcatattttcaaattcaaattcaaactgttcaaaaaaaagttatatagaaaaatgaccaaaataaaagttatagatcttgatgagttatacaactttgttgttgatgactttttttagttgaaatcatttagtatttaaaaatgttgttttgaagttgtcatattttcaaattcaaattcaaactgttcaaaaaaaagttatatagaaaaatgactaaaataaaagttgtaaacattgataagttatacaactttgttgttgacaatttttccatttgaaatcatttactatccgaaaaattattttgactaataaaatgaattattatactacagttaattattttggtacaggtcaact

SEQ ID NO: 13109 - DNA, 657 bp, Oryza sativa
atttgagaatgaagggcacctatatgtgggtacagcgtgaagttgccttaaactatttgcttacctgagctgtacatcctttccgcctacctacatgatccatactcttaatgtccctaacccagtcgtgtgctacaagctgcatacggtccttggttgcaggaacctgtaaacgcccgtaagaaatgcactatgctttagttgcctgctatacttcagaattaagaaaacctgcagtgccacttttaatgtttggacctttgatttgtcatgtggaaagctctcactacgaactttaaagagctcgctctcatggactgtccagaaggtacggcttttctcatttgcatgccgacgagtaatgcccgaactacatcacaaacctattggatctgtatcaaccattataatgacgatggatacagttgaaaaatgatgcttcatctaggcagattatgcacatatcagactaatagaacctgcctgtgtacttatcatcactggcagagctggtaggtgcctcctgtacatgaatcacataacacttcagtgtgaagtgaatcagcaataaaactctcttcaaactacaagcttaggacaaatgtaagtgttgtatgtatttttgacctcaagattagcttcaggaacttgatagtc

SEQ ID NO: 13110 - DNA, 11925 bp, Oryza sativa
aatagctcactgcagtgacatgagcacaggcacattgaatccatatcagcattcatcattgttcatattaaaactagatcaaaatgcaccacttcaacatttcatcaacccaatgcaaagttggtaatggtaataactactatatgcttaatttgcttaggatataagagtgagcaaagaatcaatcgaacagcttaaacggacatactataagcaaagatccgtgtacgttcatctatcaataaatcgtgagagcaatagcaaatcaatcccaatgagcagggcagcaaagagatcctgtcctgaaagaagaaacaaaaaaaaaagaaaaagtcccaagaaagcacacgcgcacacatatataaatttttctcagatttgaatacccaagcatgaagcaaacaagagatggaccatttgtggaaaaaagatggagagagagcttacgagaggggtggtggtggtggtggtagaagggcgcggcggcggggttggcgaaggagtaggtggcggcggcggaggagtgggggcggattgggaggaggagatcgcccgggacggggacaccggcgacgaggtacttgtaaatgagcgcctgctgctccagctccgcccactgcgccgccgtgaagaccgccgccccgcgctgcggctggtaccctcctatccccggcgccgccgccgagggcgacgagctcagcatcggtcgaaccaggcaggcaagcgagcaggcaagcaggaagaagaagggaggtcgccggcggcgaggtcgggagggggagggggagggggaggggaggaggaggtcacgtgggggttggagggttcttggtggcggccattaatggaggagggggaggagtcggtgggaaagctgctgctgctgctgctgctgcagcgtgtgagtgtgagagggagaggagagggggatctgcttctttcttcctcctagagtatctatacctatttaggtcttgtttagctttctaaatttttaattagatattataattttaattattttttaaacgggtagttacataatcctagaaaatactccatccctcttataatataacgtcttataatataagagattttaacgggatatgacacattctagtactacaaatctggacaggctcgtagtcctaggatatgtcaaatcccaccaaaatcccttatattatgggacagagggagtaaactactaaaatagaagctagaagttactcactccgttacaaaataatttaatttaggatgtccataatcgttggacacatctaggttatgttattttaggacagagtagaaattgatatgaccaattctttttattattataagttgtgtcttaccatctttggccttgtttagatctcctggtaaaatttttcaccctgtcacattgaatgtttagacacatgtatggagtattaaatataaacgaaaaaataactaattacacagattgcgtgtaaattgcgagatgaatcttttaagcctaattgctctatgatttgacaatgtggtgctacagtaaacatttgctaatgacggattaactaggcttaataaatccgtctcgcaatttgcaggcagattctgtaatttgttttgttattagtctacgtttaatacttcaaatatgtgtccgtgtatcggatgtgacacgcaaaaactttacaccccttatctaaacacagtcttaatctcttcaagcaaaacctacatctatatggatgttaagttaggccctgtgtagatgggactaaaacttttaagtccctatcacatcggatgtttgaaaattaattataaatattaaacgtagactattaataaaacccatccataatcttggactaatttgcgaaacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacaggaactaaagttaagtccctggatctaaacaccaccttagtattaacttggttctaacaagaaattattattattccatcagtcctataaaaaacatagtgcggcatcagtactacgaatctatacagctcgaaacgtgatacatcctaatactatgaatttagatatctctggtccaaattaatagtaccgtatcacatctcgtattatatttattttttattgaacagaaggagtaaataatagttcactaatactactgttagtataataatatggttgctgggttgggttgccccacattggccggctgcctgtctttacttgtaagctgtaccctccctttggttcagttgccttgcctgcctcctcatgcccagcccacccttgcaggggcaatctcgagttttccccttcctgaaatgaactgcactcatccttatctagggctgttaggacagcggtgactagtgagtggatcttgttgcttgctcctacgttgagttactccctccgtcaatttttttaaaatttttagagttttaattttattccacagaaaactaacttctatcattctacctgctttcagcatgtaaaatgagaagttttatctcttcaataccctttacatacctactactcttactacttttttctagtgattaagggtattttagtcattctcactcttcaccaattccacattgggatgctaggattggaatttttttctagatggagggagtgcgtcccaaaaatctatcttaaaataaacaaatgtatactgtaaagagaaattttttaaaaaaaataaataaatctaatataaaaataacactgatactataaatctagataaataagtctagttttatttattttgaaacaagatgggtacaagttaatccatgcttatagctcatgtgaagtatggtaggagacgagtactactagggaactcttttagaatgtatgatatattttcgatttttggtggaaaaaacaagctcatgaaaatcatataaagttttatgccgcattgaacctttatagcccctttaatcaaaggatttagaatcctatatgaattttttctatgtgacaatttaatttaaagaattgaagttttccaaatctattgaaattcctatggaatgcctcatcgtatatagattttgaggaaacttaacaagagctccaacctcttggaaattttcgttagtctacctctttcatccgatttctatgttttttctgcggtacaatcaaatggtcctccgtgtatttctctttgtttgatgcttacatttccatcagaatcatgtgtttcttattccaccctttttacaatcctgcaattcaaatgggcatttaaaatgaagcactacaattatactctttccgttccagaaaaaagtcaaccttgtaataggatgcgatacatccttacatactctgtccagattcgtttttttttctgacagacagggtactccctccgtcccaaaaaagaacttaatctaggaggggatgtgacctctcctgtccaaattcattgtcctagcaggagtcatatccccttctaggccgagttttttttttttttaacagagggagtacgtagtactccgtatcatatgttcaggcagtggtgcttccgagtactacattcccaactcggcgtctaggattcatcgtatcaagcacaaacttatactatcaattattatggctaatatgcatcattgcaccatcaaaacggtgtgcaacgagaagcctaaacaccagtcaattatagtcatgtcaataaaattctgatgattcatgtattaagattgtctagatttaccacattttgtttactaagcttatcaaaggtgagaccaccacccaaccaaaaccctaaccacattttagctaacaaagtatcggcctcattttttttttcttatgattatacttatcagctaaaatttaaattttcaaccttaaatttagagctgattttggatttttcttttcatcgaagtttatttttcagcctttgcttacattgctaagaacacgtatataaaaattttattcacaatttatttttcgtttgtaaatatatcgccaaacgatggggacgtaaagccttaccactctttttagagtcgattgtgctgtatatttgtcgacatatagtatatattaaatgtacatatagtataattgtagtgtaattatactatatatattaaaaatttatcaaatgtacatatagtataattgtagtgtaattacattgtaatttgcatgaaactacaatgtaatttgtatttaattttcacataattttaaactgttaggtttactttaaaatgtaggaatactataggaatacatgtgcaaacctatggattgaaaaacataggatttttttcctatgttgttgagcaagctaaccaaagaaatgtaaacattaggttggagtggattattttttcctatgcttttccttcaaaaatgtttccttcaaaaatggaggaatggaaaactttcctgtagttttcctatggtgcattcatatgaaacgaataatagtttaaaacccattcctattcctatgctttttctttgcaattcatttgaaacgaataggccctaagattcatgcaagttaggaagaaaaaaaaatcatagcatgcagacaggctaggagattcggtctcacggcctccgcttcatgaaaatagtgtgttatcacggatttttttaaaaaagatacatacaaattatattgtagctacatgcaagttgcaatgtaattacactgattatattatatttacatatatcaaatttatagaagaaaatttaacgacaaattataaccattcccaagttgcgtgacgattgcaacaaaagcacgtaaattaagttccaaaattcaaaattggctgcaacttataaacctaagctgaaacaagcaaggcttgaacgctcgatcctccgcttcatgaaaatagtgtgttatcacggttttttttaaaaaaaagatacatacaaattatattgtagctacatgcaagttgcaatgtaattacactgattatattatatttacatatatcaaatttgtagaagaaaatttaacgacaaatgatagctattcccaagttgcgtgacgattgcgataaaagcacataaattaagttctaaaattcaaaattggctgcaacttataaacctgagctgaaacaagcaaggctcgaatgctcgatcatacagtatatcagatcaaagatccattccactaatcagttgaagtatacggataagatccaccaagtacaaacttccaaagcatgatgaccaaaaggacgggcctcaaaaccattcaaaccatttcgttcgttcaaaagataaagaaacaccattcaaatcccaagcccttgctttgacctgacatgtacggatgtacccaaaggcatttgcttcgagctagtagtactgcacgtctacaagctggaaagattttgtacagatcctaataaatcttattagccccctaaatcaaacctcatactactcctaacctaagctaatctaatctactcctatcaccactctccagctctggagagagccaaagggacggtacggcagaggcagagcattcaagatgatgaatatgtacgaccagtactgatattactactagtaccctacaacatttgaatatttcatgccccccaaactcatcatcttcctccctggtacaactctcttttctctctctatgttttatacactcctacagtatggccctgtttagattcccgcaaaattttataccctgtcacatcaaatgtttggacacatgcatagagtattaaatatagaaaaaaaataaataactacacagattgcgtgtaaattgcgagacgaatcttttaagcctaatcgcgccatgatttgacaatgtggtgctacattaaacatttactaataatagattaattaggcttaataaattcgtctcgcggtttacaggaagattctgtaatttattttgttattaaactacgtttaatactttaaatgtatatccgtatatccgatgtgatgcgccaaaacacagcctatatgttactcctactagtaccttgaggtaggaattctgtagggtatgcccctagtaggggtacccataccagggaggtgaaacaagctatagaaaagaaagaaaaaacctaagttaggtgcccaataggagagacatagcctcctgtccaagttgcagcaaacagctgaagcaaccagagcctatggccctgtttagatccaccctaaaatttttcaccctctcacatcaaaagttttaacacctgcatgaagtattaaatataggctaaaaaataactaattgcacggattgcgactaatttgcgagcaaattttttaagcctaactactccataatttgacaatgtggtgctacagtaaacatttactaatgacgggttaattaggcttaataaattcgtctcacaatttactgatggattctttaattagtttttttattagtgtgtaaacaccccttgctacaccttatataatatccgatgtgacccgccaaaactttttacacccttgatctaaacacccccataaatgggggcaaagggacacagagagacactaggggagattaaattgattacatgtagggcacagaaaatcctacatcaccaaaacacagtacatgctgcatgatttgggaccaactggtcaaaatgatgcaatcggagcaagaaaacaccacggcctgcagacctgagttatggaagaggttgagggagtgagtgaatgatggccgacaggggatccatcacctcttgattcttggctcccacctcaaaagccaagcaaaaccttccaatttagcagcagcacagacaaataccaaagtgacagcacccccatgcatgcatgccgacacctgaaaaacaaaactccacaattgtattttcagtaaaatattcagatacaagaatcaatggctaacagaccttcacatacctataaaatgttttctactatcagattgaaaggaaaacaaagttagccaggtacattatagccagtaaataagtagaccgtgtgtgagaaatcgtaatcgagaccgaaagtggagctactttttcttcaagaattggatgatagtacaactttgtacagagcatacaaaaccaaacctggctgctccaatacaaacaggtagggcaaattgtgtcaacacaactcttaaaaaaaaagagcctcctatgaatatgatatctctacacttgcagtgctgcaaaaaaatgtggaagactgaagagagttgcaggcccagcaattatggatatgggctgaaccgtctttgaattttgagatcagtaaactgtaaacatgcaactgaactgcagctgttccagtacgcaggcactgcataatcactcagcgagtgttgttcacttggaagccatccatcaaccataaagaatatatatatctatgtcagaaaaggatcttctttaaaatcaggaggactatcatgatgaagataagaatgacaagggtagtcgcacacatgaccatgccccctttcttctgtgtcctctcagcctgcataaaagagaccagatgaagatgttagactgaaaactccaggaattgaaggtgcgccttatttctcttcctctgcagaaacgctttgatatataaggtaaaggtgctgcaggtggaaacactgaggacttctcctcaactttttatgataatatctagcacacagtagcatatgcatgcacaaacacacacaggcacgcaaaggcacacagcagtacttgcggagacctgaagatttgacctagtattactacctctagtagtcacaaaaaaaaaaaactttatgatctgtactatttattggacaccatttacatgctatgagatgcttgactgtccacagtctgggagatgcaaaatcaagcactgaatttttatcaccagataactgctgaagttatatagtatacctttttaaaatttcatttaatgcctaatctacccataccattttctttcaatggacaaaaagatagatcaggtgggaagcaattttttagggttaacattatagtacaagttttcttaaaccactgtgctactccgtaatggacacaaatcataaaatatcatataagttaacctggcaaatgaaacatggcatagaagtttttccatcttaactacagaaatctgcataaaaatactctaaagatagaaaatgggttgggggatgaaaccttttgcaattgtttataaccctcttcaacggaagctgcaacattctgtatattgtagtctatccgatctatgatagttccctgttgagatgaagtaattatgagtctggagtttgaaccagttaacaaaaccaatcattgataactcggttatttagggtttttcttatacctgatctatcacaagaactgaaaggtccttcatgatctgtgcaagctcgttaactgattcgacaaccttcaagtagaatgcagataatataaaataaagttgtgcccatgattgattttttttaattcaaataagagagtatgtatatagcattgtgcatataagcaaataacaaacaaagaactcacctgctcgatttctctttctctttctctggtgaatgcttcgcttttcttaagttttgacatctgaacctccgtgaaaccctgaaattaaaatcatggaataaactacatcatcgatcaattacttaatttaaagggtatgctggaactttaatcctcctctttgataccagcaaatctattcccatacattgatttcaaatccaacaaaaaaacatacacaaacatcatactcccgagaacactaaaaggggatatatacataatgaagcatataatttgttaatgttttctttgagcatctcacttaagactctttttcacactaaaccagtttaaaagcagctgcctggataccatctaagtatgtgcatgaactatactaagaattcatggatgcaaggccatggtgtatggatgcttggattattgtggtgttcatgacaatgcaaagctactcaaacttctttgattttattcatgaacataacctatgttactaaattcatgatatgattaaaaaaaaagggcagtaacgcctgtatgtttcttgcctgccatctgataacgcagaagagaaaaatttaggtaagtggatgcaggtggagcacgggactatagcacttttacttagaaagccttgtatttttttatgattataacttctgcatcgggagccagttgaaatgatgtacctaaattcacttggtttaaaacgcaattgaaagaacccggcctttcttgatcagtacagcaattacaaagtgaaagggctgggaagcttggaaatgcaagatcttcactacccagtactgccataacaatagcttaagcctcaaaactccatcccacaagtgtgcgttactttcttattatgtttattcaagcattacagattcacaggccaaaaattgactttctggacttgatattaagatccacaatgtcatcatgtggtcaaaaggtaggagcaaaatgaaatgctataaacatccaacagctacatcctataatgcaatcccgtcaaattaaaatgcctagaatagaagtataacagaataagaattccaactatgtaactagattgtgctcattcttgagctagattcctaactcacacctgcaaattgatccaagcaagccaaatacatactatcagatttatgttgccttattctaagccactgtaaccacccaaacctagacatggccttcattgcacataatgtgtgccgctattcattttgcgtttttctcttcacaaattttgtgtatacttgtgggtctgaactctgaagtgaagcaagtcgggcaaacccttgattctgattttcaagtcagttactagcagatagggaggagcaatacacaacaaacaataaaaataataattagaattgagtgtgttactagttactataagccaagctttcaggataacaatattgtaaaatcaagtctgcaggactaaggactaaagataaagacaaagtaatagcataccacatcctcaaattcatcatctccaagttcaaatgtcgacttagaaccattcatgttcatttccaaatcaactccatcttgcccctgtaaacatgattcattaatcaagcatctcaattagatcgatttaagtagcaaaagtatctggactttgagcagattgacgtacgaacctctttctgttggcgtagctgctttaaataagttgactgttttttacggaactccatcgaaaggctttgcaggtctgtagcgagtgaacgctgcatataacaatcaaagggcatttcatccatcaaaacaaaaatcccttatgagtcctgtagctgtttaataagtaaagataggagcccatcatcacctggacattctttcggacatttgaatcctctgaagaatctttcatggatagcttctgaagtctcttctccgacctcttcagtaagtctgttacctcatgtgtaagaatctcaattgctcgctggtcatctctaccatcaccaaaggatggcatcaaggctttggcatgtgccttagccagctctgccatcttcgttcttgcccgctgcatgttggcagatatctcttcggaaacatcaacccatgccgggggcagcccgaccgtcacagcacttctactgcaccacatacaccacatgtgagtgccaagtaaggttcccaaaccaattggtggactgctaccacacctcgatgtttatactcacaacagttttcaacttctctacttgaactaacaaaaccaattataaatatctcgcagtagatgacgcctaaacaggctagctaagggaatgagttcagcgatctgcaattctactgcttcgtttgaatcacaggctaattggatcaccatcgtaaaagattttacgggacatcgctattcactcgcacggaaaccgatctaagtctagcaattgtgattcccatgtcgcaattccgcatctcgcgcccccctcgcatcacgattaactagcgcactgatctaaaggtggggttcagattagacggcacagggtggtggaaggggggttgttacctggaggcggcggaggggtcgtcggtgctgaggggggcgtaggggcggttggagcgcagcagcgaggccatctcgatcaccggccccccgcctcctcctcctcctcctcctccggacgatgacgacgacggagcccccgccggcgcgcggacgtggcgcagcgcgtcgcggtacttgcggtacagaggcgtccggttccgcgtcgccatggcgcgggagagctccggcggaggcgggcgcgggcgcggcgagatctcgacggcgaggcggaggaggaatcggggagagagaagggagagagagagagagttggtgcgagagacgagacgagacaacgtgggagttgggacttcaccaccaaggcattaaacgggcccatttgggctccgaattctggcccggaaggcccattacacggacagaacggcccgtatttttttcgcagtataagcaccgggaccacctatacatttgtcgacaaattttctcctaaaaatttgacagatgtaattatagtacaatcgtagtgtaattacactgtaacttgcacgtaactacagcgtaacttgtatataagtttcatataagatttgttttggtgaggaagaaa

SEQ ID NO: 13111 - DNA, 8737 bp, Oryza sativa
tatagttacagtgtaattacactacgattgtactgtaattacatctgtcaaatttttggaagaaaatttatcgacaaatatatagaaaaatcgataagcaccttgtttgaagttaacgggaaatttaactatttgccactcttgtgacatgacaattaacgatttgccacaccctgtcaatgacatgtgggctctcatgtgtctataacatgtgggcttagtggcaaatcgttaagcactactcgtaagagtggcaaataggttaaagccccaaagttaatgccccatcgtttggcttataaacggtatatttgcaaacgaaaaataatttgtaaataatacatgcttttagtgatctaaaagaaaaggctaaaaataaactttgataaaaaaaaacccctaaatgtaagattgaaaattcaaattttagctgataagcataagcataacctccgatttgtctccgtttactacgtacaagttcagtctgtgtaattgattgtttgatgtataagccgtggaaagataaaaccatgaacagtttatggacaacttgtatatctttgtttttaatggtttgaaaactaattcagggaaacaaccaatgttgaaaagaagaccttcaaaatcaagtttaaaataagtttttaaattacttttctggttatggctgataagacagcaagcaaacacgaagagttcattcaacagcagcaatcatacatcatcttatctgcggacaaggcgactgtttggttgaatattttaaccagctcttatgttcagttttttgttcttcacaggttgaattcgatatatacattattatttgatcccagttccagacttgtccttgatttgccactgaagaactgtgtagcaaattcgcattctgcgtcacctgctgacgatctggtgtcccaaatttgccaagatagaatttctgaacaagcagaggaacataatgtgcctatctatatcagcatctcaaaatctatcagggttgtgaatggaaaccacaattcgatacagacatacagtacatctcactcaagtacaaagtgtcagctagcaactacaaatgacacaaaaacagaatgacagaaatgcatgccagatctcctagacacactgaattactcttaaccaatctttttaatttccaagtacaagaaatacatttgatgtgaatcgttcttaaccagtcctttttcaagtacgtgtaatacatttgggtgacaattaacacatgtttactcatcgcagatcacctaagcaattctcagcaaagcatttttttttcttgtgaactaaacttgaattctcctggatctcaacaatgcaacatttgcaaaattctcatggcatttttttttcttgtgaactaaacttgaattctcctggatctcaacaagcaacatttgcaaaattctcatggcagattcctacagtggaggcagtggaagcttaacaatggcgaagaagaagaaggaggtgtcgcgagggatgcggatcagtacaagctaaagccgagagactggctgatgaggatgccgaggcccatggagatggccacgaacgaagccacccatgttaactttttccggaacctggaaaccttttcttgaccccctccgccaaaaaccaacaggacgggttacttcccttgggaccccgggccaacaaggaacattcaagaaaccccgccggggaccgccacgggagggcagccccgcaggaccttattaacgcgtcgggctgcagcccgtgcacgatcccggtggcgaacgtggcgaaggtgatcttcttcctggtggctggtagagcatcgagcgggccacggtgcgcgccgccgccgccgccgccgttctccagcgcgacgcacggcgtgggcacctcggtggcctccctgatgccgagggcgccgatgacgagcagcgtgaggccgacgacgcgggtcccccacgttcggatgacctcgatgtggaggcggtccttgaggctgaggaacaggaggccgaagatgacctggccggcgtcgtggccgcagccccagagcgcgcccacggcggcgctctccacccgcgacctcccgatggacagcggcgccagcgcggcgaggtggtccggcccggagagcgtgtgcaggcagccggccaggaaccccgtccacgcgctgctgagcagctccgacttgaagatgccacctcccgccttcgccgccgagtggaacgacgccaacgccggcggcgcccacgccggctggatcagcgtcagtgcaatcgtcgccaacagagtggcagccgcagccgacgccacctgtcaaaccaaacgcgtgagctcaataatctccgctaactcttggactcctccgaccacaacaacatcacaaaacagaagcaattcttggaagaagaagaagaaattcacatcagtaatcatcacacgagacatgcaagaacgagtgaggcgcgacacggaaaactggcgggcaacgaggcgctcaccttctggaggaagcgccggctggcggtggcggtggcgggagggacagcctcgccggcggccacatcggcagcaggattggccgcgaggaccggaggctggtggtggtggtggtgcctggagaggaggagcgaggcgagaggcggcctggagccgtacccggaggccgcaccgccggcgcggtggtggggtggcgcggcggcgagggagggcggcgggcgggagaaggcggcgcggggaggccggcgcgggaggagcggcgaagagataagcctctccattgccatcgctgctgctgcggcttcgggtggttcgtctcgggagaagaagattttgctgggtcgggagggccagcctacggccgctcggaggggatcgcgtccgtacgttctcccacctcgagatccgtgctcgtatgacgtggcttgggccgagcccatgtttcttcggctgggcttcttccttgtttgggcctaaatctgagcacttcggctgatgggccatttggatcataagttcacaacagtgttaaatgtaataatgggctaatgacacctggaactgcaattaagttggcatggaatatgcatcagcaaactgctgcaagatattatttgatgagaggatgagaagaatatgccttgctgagactaattctctggaatgtcatgactgctttgtactagtaggtggggtctccttatcgtatcattgtgtaattgttgctttttttttttgcttaattatgctgtgtttagttcccatcaaacttctaaaaattccgtcacatcaaatgtttagatatatacatggagcactaaatgtggacgaaaaaacaattacacagtttacatgtaaattgcgagacgaatcttttgagcctaattgcgccatgatttaataatgtgatgctacagtaaacatttgttaataatggattaattaggtttaatagattcattctatagtttgcaggcagaatctgcaatttattttattattagtctatatttaatactttaaatgtgtgttcgtatacttaataaaaattggaaagtaactaaacacgagctaaattgttctttgctgcttgattgattgcttcctgggttgtcctgtccatccactagccaattaattacttgcagcatacacacgtaatttaattgattttaggtgaccattaaccaattaaaaccgtttgcgagaactactcatcacacgaaaacgtaacgaaagattaccgatactccgagaggaaagttgctcggtttttttctttcttcatagccattaacacgagttatgagcaaactgcagatgctggttaattagctgtgacagttttttgattgccagccacgttgtggatgcgtgcatctgctgctggagattcgctagctgcagaccagcaagcacgtaggacaggagcactaccagcattcatccgtcagctttgctgtccataattactcattaatttggatacatcttgatctaattataccctatatgtgacatggagttattctcaaacacatgctttacaaaaagattgtgacatggagttgttcttaaacatatggttaattatacaaaaagaatctgcactgcacatattaatttccacacttaagaactggctgaataacgcctagctagcctctgataatcctccagaaatcacatggaaacgcgagaataagatggaagtcaacgtgtccctggataaaaatatgtatacgttctgtgggttaattagtatttgagcacgcaattactaatcgctaatcagtccgtcctaaagacagcgagatctttccacgctaagcacatctcagccgtccacgtgtcgggaccacgtcgcacggatggcgtccagcgcacggcgaggggtaaaatgggtagctttcaaacacgggagagcgttccagcgcggaccgtggagtgggcgggggatttcccgccactcgctcacgaactgaagcttacagcatagccccttcaaatcaagataattacaaatggcccctctagctctccgaggccagcacatgatacacaacttaattattaaactgatgccattgagaatttcagatggaaggctctgttaatcttttgctccttttcagttcgaatctagtaaagtttaagtagtatagaagataccactactccgtatcagtgcttttgccggtggaagttgataagaaatattttgacggcctgcatttcttgcctacttcaagttggtactacataagtttttcaggaaaaagaagttggtcctacgtatgcaggttggaacattttcattttatatgacatctagtgacataataatccattacaagattattaaaatattaaataattatgcatccgttccgaaaccaaactttcttcatggtcataacaaaactttgaatcgcaattctttgtgttgttctagtgcagttcattttaggccatttgtatattgatgcacgtgaatggtgtttttctctacaaattattttttcatacactgattcgtttattctataacatctatttcccctttttttatttgaataaatattaaactccacaagttgtgtgttttgagcaccattcctgtctggcatgtgacatttttacataatcaataaaatcttgaatctcaaaggaaaaaaaattacatgtaagatgatatcagatgttcatattggtaccatgtcaacatagatactgtaatattgtaatttttcgtttttctggttacgacttatcagggttgtatcaatatgaacttcgcactatgttacgtgagtcgttaaaaaaaacttagatgttgtacacttaacaatcgaaaattcaacatggtgttttagtgaagggtatttcaactagtttgagagttttttttttggttaagagtgttctagacttacgggttacggttttttttgttagagtggcttatctaaccatcactgttttctcttatgactgtggattacgacgtgcacgttttccaaacctctaaatgggaagagtatcactttctatatataaatgttttacaataccttttttaaaacaacatttaacttgctatattcaattcattcttttgtaccattgaatatgaacaaaacaaaagttgaagaccaagaagtggtcatattcattttcaaataaatgaaaatgtcacagaaaaggtggaaaaccacaaattcctttaatgcttgtactattgtctttcatatttaaaacagtactatctccaaaattacaaaacttcaatggactcaaaagaccccccaagtcaacaataagtaatttagacaaaacacaaggtctagaccagaaatttcctcgaaaaaggcaaaagccaaatatttgaaataaaaatgcaaagtagtagttggggatttaatagtggcttacaataataattaatctctcgtcttctctctccgcctcccccgcctcgaaaccctcccctcctcctccgcctgtcgccggccacctcgccggctccggccgccgtgattcggcggggcctgcgccttgcctaggcctccacgttcccctccggtgccacctcacccgctggggtatggctcattgacgtggcggcccgggggacgtgacgcgacccagttggaattcgaaatcaccgccggagatgatgatgagctcgtcgacctcgaggagggaggcggcggcgaagagctccgagctggggcgcgccggcggcgtggatcccccgaggccctccgcggcggcgatggcgcggagcggggagctccccaaggtctcggcggcggcgacggccgcggtgcggcacgaggggtggatgctgcggtacgggcggaggaagattgggaggtcgttcgtccgcacgcgctacttcgtcctcgacaacaagctgctcgcctactacaagaagcagcccaaggacaacatggtatacacatcatcatcctgcaacttatgctcttgattttgctgtcatactcgcgaactcgcgatgcgattcatttgtcgtagtctcgcagaaagctgcgctaccttttttttttcaagagtttctcatgaatttttagcgggatttcgtgacttgtggtttattctgtccaattgggtggagtggaggatcggaggatgttctagttacgataactaaatctgaatgtaggggaatttgcctgcatcatgatgcgatgcacatgagttttctgccgttattttggatttttgagtggtttgactagcacatagaaccacctgccttattttaatggtatatgattattgcaaactgatgccaactatttaaccgtgaagctgagttggaactgtttaccatctgtatctccggatgcttttaatttgaggctaggaagtgctaattaatgacatactgttgttaagtaatggagttttgtctcttcagctctgggtcatttagagtagcgtttgctgtaaatgtactgcttcggtagatgtaaagcatatcgttggagagtaagaatgtctgaatgagtcatggattatgattcttgaataagattcttatagctgaagtactctttattgtagagtacttcagctgaagtactcttgattgtacgccttattcggaggattttaacctaataaattgccatactgatacacgagtttagattggaaattctgcaacaggagcatggtggctgctttattttgattattcatttaagatttgtggatgggcaggtgccagtgaaggcgcttcaaatagatggaaattgcagagtggaagacagagggcttaaaacacatcatggtcaagtaagttccctcttctcatatttaattcatctagcatcataacataaagcataaagcataaagcgtatcatttaattccttcaatgggaaagtttcttgatacctttttcttgaataaattcactatcttttagtttaagaaaaacaccttacttttgaggggtactgctgtactgttgtgacgttaataccgtcatttacttatttgtagtgatattcttgttttgcagatggtctatgttctgtgcatatacaacaagaaagaaaaggagaatcatatcacggttcgttacgatgctaacttgccaaaccagaatacactctatgtttgagaatttgcttttaaacgcacttgctgatattttgtctgcaatatatagtttttactactgcagtgtattggaaaaagcaagtatataagctggatgttaacccttttcttgccatccttttttgtgtactttgtttatgggtcatatatttctgttgacctaaaaaagggagcgatgccctttctacatcattctggttttatagttaaaagaagacgctactttcactagcattagtgtagcttttggatatagttaaaagaagacgctactttcactagcattagtgtagcttttggattccctttctctgcttgataattgactaatgctatgcaattttatttgctcaagtttaattgacaataacagtgtaacactacatatgggagagatgctagtggtccttttgtgtgtactctttcatttagtatcctatagcctttttctgtcacatatacctatacagtaagggtaattttaccatccttgaaaaagtactgagaggtaccacactttctagtataaaatttggtacctccaggtattaagtaccttgagatacaaaaaaaattagtgtaaaatttaggtacatcgaggtacttttttaaggaccataaaatttctcatacagtaaacttgtcattattcaaataccatcttaatcctagtattgttcttctacagatgggtgcgcatgatatcgaggatgccctggtctggaaaaagaagctagagctccttattgatcaggtgtagtaagtccaacagactgtaacaacatatggcaattgttcgaagtaataaggatatttcagcccctttttcattagtttcttgtttagctacggtgtaagaaggttctcccttgtacatattagattcaaaagaaatctataacatccattttttcaataattctatgacacaccaatgaactgtcctaggcataacatcggagatattcattctgcagcaacaagacactatgacggctaaaaaccgcaaagcttttgcttcactggactttgacatggagtttggaggcccattatcattctctgatcgtgaca

SEQ ID NO: 13112 - DNA, 9504 bp, Oryza sativa
tttcatattttatctagctgtatgtaagtccttctggttaaaagtaataggagattttactctattatagaccggaagatgaagaagagccccggcctactttgcttcgtaggacaactatcgggaatggtaaacatacttttaattttttattaatattttgtaatggctacacgagagaacttaaatacaccatttctttttctaggccctcctgattcggtacatgattggaccaaggagcctgatattgggctgtcagatcagaatgacaccaaccatgcttactcaagaaagaactggcggctacttagatgtcagaatggtaagttcacagccctttacgtagattatatataggcatgcatataaggggtactttaaaattttgaattcaactttaggattgttcaaatgaagttacaattagagtttcctggctttatgattggcaggcttgcgcatctttgaagaacttgtggaggttgaataccttgtatgtacctctcttacctatatactgtcaaaggcagacacgccaatgctatgagtaaccttttatgccttgtgcacccttacaggcaagaagctgtagccgagcaatgagagctgttggtgtggtggaagccacatgtgaatccatttttgggctaataatgagtatggatgtaacacgatatgagtaagtgtgtgctgtttaagtgttttacttcctaattgcttttctatgaatgctgacctcagtattatttatgctccactgtaggtgggattgtagcttccagtatgggagtttagttgaagaggttgatggtcacactgcaatactatatcatcggctacagctgaactggttttcaatgtaacaccttttcttgtactgattatttatgtgcacatatcatctggttctgttataacttgcatgaggattgcattttatatcttattgaaagtctaaataaactatttgagcacgaacttttttcatttggacttgagtgtagaatatttatgcctggcatatattgtacaattcacttgttggaattgcctctgcacccaatagggcaatgccaactgccaaattcattactgtttttgctgtttggacaactgttgctaaattaaaattgtaggatgagaacttctatatggcagtatcatactccacaagacctgggttctttactttatatcgatatattattgcattacctcagatttggaataacatagctacatctaatttaatagataactgaacatgtaggttggtctggccccgggatctttgttatgtacgatattggcggcgcaatgatgatggaagttatggtaatctttggatgtctccttgttggtcactttcatcattctgaagcaacttgtttgattcaatgttcttaaacctgcagttgtactgttccgatctactgagcatcagaattgtggtccccaaccaggatttgtgagggcgtttattgaaagtaatttgccttctgcttatcaggatgcttgatatattaaaacaagtgttgcacaacttttgttttttaaccttaacttcctactagttcaggtggaggttttaaaatttctcctctcaaatgcgtcaacgggagaccacgcactcaagttcaacaccttatgcaaattgatctaaagggatggggcgtcaactatttttcatcgttccagtactactctttgttgcagatgctcaactgtgttgctggtacaaagtacaaaccattcttttaacttttgatgacatgtcctaatttcccgtgaatgctaaaaatgacaaataaatactgttaattaatcacaacgttctttcgtgttgatagtatgtgtctatgttggtctaacatttgcatttatgtccaggattgcgtgagtacttttcccaaactgatgatattcatccagttccgaggattcctgtgatgagtactatggctactgtgtccaaattgaaaaaggataagaaactccaagaaactgacttaaagacaaaacaagctgattttggacaagtcgataacaaaaatttggatatgatagatgaagagtcagaagaagatgatgactatcaagttcctgaagctaatcttgaggtcaaaatacatactacacttacatttgtactatttttgtagtttgaagaaagttttactgctgattcatttaacactgaagtcttatgtgattcatgtacaggaggcacctaccagatctgacagtgatgctaagtacacaggtttgttcttttagtctgatatgtgtataatttgcctagatgatttatcattttttaaccttatcctttgtcattatattggttgatacagatccaatagatttgtcttgtttttcgggcattttcgtcgggatgcaaatgagaaaagccgtaactgctggacagtacctgatagcaagctctttaaagttcgtagtgagagctttccacatgacaaatcaaaggtccaaacattaaaagtggcacaacaggttttcctaattctgaagtatagcaggcaattaagagcttagtgcatttcctacctgactttacaggttcccgcaacaaagtaccttatggagcttgtagcaatcgactggcttagggacataaagcgaatggatcatgttgctaggcggaaaggatgtgcagctcaggtaagcaaatagtttatggttacttcatgctctacccacatctaggtgcccttctttctgaaatccactattacatgattatgtctatgcttaaaattccagtgtctaatatgcaaagtagcacttgaaaattggaataatatagaacgattaccttttgcagaactgtttgttctaccagaattgtacttgtaaacaaatcggttttccaaactcttttcatcaccttgtgtgtgctatcaatcttttttcattgcatattaaactttagctgtgtagaagcttcattgcttcaggtagttactctgcgttctagtagtgagcactttgaatatgtacctaattacttatatgtatcctgtgaacaaataacctgctgtaagatctacatatgtgtaaaattatgaacgttgatacagtttgacagaattatctggactgtattttaattgatctttgttttagactttatcttgcatagtttgaaattggaagtgcgcgtcacttcgccattacttaggataggaaagttgatgagaatcagtgagatggtgcaatcagcaagtatctcacaattatgttaacagagttgatggtttttgcttgaaactttgttgtgatgttaagtgttttccagtttgactattgataaaagagatccttgcacatgcatattatatatatggtactgaagacaatcttccttatctgcatgaacttaagtgaggtcctaatgaagtatatctactatactaatagtatgatgattctcattgaacttttaccaatgtaggttgctgctgagaaggggatgttcacctttgttgtaaacattcaagtaagatcatatttcttttatggtctctcctccatggctagtttctttctgctgtgctcacggggttccttacaggaagagaactcctggttttcactttgacaaattgtttacgctttgacaaactagttccttgcacaattgctattagaagaaaaatagaactccctggttacactttgacaaaaccctagctcagaatctcttgtttttttttgtttgattaacattgccaatgagagcagatgcagtgacctgctgtgtagttttcaatgatcataccagttttgttggcttgtttatagcttaggccggattattttgttcgcttagagaaaaaaatcattattgctttcagttttcccttgaaaaataccagttttcattctgtgattccatcagggctcgtcttctttattttggtcacgctgatcaggtctgtttgcatttgcagattcctggatcaagccattacagcttggtcctctattttgttacaagaaccttggaaaaaggatcactgttacaacgttttgctgatggcgatgatgatttccgaaatagcagattgaagctcatcccatctgttccaaaggtctggtctaactttcggagtgtatagccctgttgatttataatgaaggcctttctcacttgagcatgttgatttcttcagggatcttggatagtgcgacagagcgtcggaagtaccccttgcttattgggaaaggctgttgattgcagttatatgcgtggtcaagagtacatagaagtgagacactgaatataggcaccttaaatattaacacaacacaactcctattattttaattactggagaaatacattattcgagcatgtaaatacctggcaaagttgagatatgactgaagcagtagaacattaggttatttagggcatctcttgaacaaacaaatttatttttgatattgttatgcaggtagatgtagacattggttcctcagcagtggccaatggtgttctgggcttggtgtttggcgtcgttacgactttaatagttgacatggcttttcttatacaggtatgtatgctcagtggctccctcattttcttcagtctttactctccaagagcacccttttggctcagccgcagccaaaactaaaattttgaaacttaattttagaattgatcttgaggtttttcttaacatagtttatttttcagcatttgcttttaagtcggtaatgatatataaaagttttactcaaattatttttgattcctaataagccgttttacggtttatcagctgtaggccaaatgattaaactgcaagatccagtttgaactttgaagacttatgtttctatagctaataaacagtagtatatctcaactggttcacatttctctacctttacacttgcaggcaaacacatacgacgagctcccggagcaacttctaggtgctgcacggctatccaatatcgaacccagctcaccaatagttcctgtacttgataaatagctcttcaagggaatgaaatcaattgaagcagattctttaattctttgctccgaactccattttctgttgattagctgcaccagtttgcagtttgagacggcaaaagtgtcatttcaggactggaagcgcgaccatatcctccaatctgtctttacagttttcagatttttctgacaccatgctagtaggtatagataacatatagtatgtgattatacggcattatacatacagaaaaaaccaattcatgtacaactcaacgtggtaccttgctttttttttttctctttgtagccaattgttgtcgatctgacacctcaattagatgctctcttcctctcctggatgtaaattgaactcgttatcacttgcttggcctttgagattcctatatacttcttagttttatattcaatagagtgtacttcctccgatttctaatgtatgatatcattaatttttgtgatatgtttgaccattcatattattcaaaaagtttatacaattatcatatatttagttgcgtctttatttatcattaaaagttctttaagtattacttatattttgtatgtttgtaaaaaagatttgaacaagccaaatgatcaaataaatgtctaaaagttaatggcatgatatattaaaaaccggatggagtatatagcctttttacagatctgtaacctacacgtttgagtttgaatttttcgacctgtaaattactcggatttgaataatgtcgtaaaagacatcctgaaacttcataaacacgccattgctcgcattgctcagtactatcagccaccagtgtgatgtttcattcactgggcttcattcgtcctcaaatacggcctactaaaagcccatctaaacacgaacctcacttcaacgccacgcagctttaaattcgcgattccaaaccccagccttcgttgcgttgtcccttctcccttcactccgctagggttttaccccgcgatggccgccgccgccgccgccgccgcgcggaggctcctctcccgccgcgccacctccttctcggcctccgctctcctccgccgcggcggccccggtgcgccggagtcgctgctgcgccccaccgtcgccgcggtctcgcgcgtcggcttccttcgcgggttcgcgcggcggccgggcggcgatgggtactccccgatgcggtccggtggcggcggaggaggaggcggagaccgcgcgccgacggagatggccccgctgttccccgggtgcgactacgagcactggctcatcgtgatggacaagccaggcggggagggcgccaccaagcagcagatgattgactgctacatccagaccctcgccaaggtcctcggaaggtgaagcctctctctccgccgatttgtctctcagtttgtgctaaccttgccatgtatttgctcctcacttccagttagttggttcggaggtcgatttcttatgtggttgtgtttgctgcagtgaggaggaggcgaagaagaagatctacaacgtctcctgcgagagatactttggtttcgggtgcgagatcgatgaggagacgtccaacaagctggaaggtttgttccttgcctatgttttggttttataaatacctggaatgagaatacttttagcgcactgtgtgtgttcatgtatctgatgcactatgtatgtgttgtatgacagggcttcctggtgttctgtttgtcctccctgattcctatgtcgaccctgagtacaaggactatggaggtagctttcttgcacaacctcacaacttctgcaggttttcttaggagatcaatggctttgtcatttcatatgatcactgattgactgatgttgtagatactatatcctaattggcccccctataggcatttgttgcttccatttttacaggataatgcgatcgaagttaaagtatattttaatagaactgcatcaaaatgaaatggaacattgtctggataccgtatgtagactgttttcatggcatgtgagcctattccgaccacatactgatgttttgctagtagtccatcttggcaaagctgtgaagccatataggcaatgccctgctttgaatgctaatggactgaaaaaaatgtctctctaacggttcggtaccttggtaaaatggggttctgatcagtggagatgagacattaagaacactttaccacctcttcagtttttgattaattcaaggctttggtctgtttaccaaacctgtagtccatcttggcaaagcggtgaagcctaatcggcaatgtcttgctttgaatgctaatggactaatagcaaatgtatctcacggttctgcaccttaccaaattggggttcagatcagtgtagatagagacactaacagtgtatttactgccacatcccccttgagtcttgatgttttactgttttttaaggatttagtatgttgttgactcaatactaaattgctgttctagacatactagtccatcttggcaaagcggtgaagcctacttggcaatgtcttgctttgaatgctaatggactaataacaagtgtctctccaacggttctgcacctcaaatgaatggggtacaggtcagtggggatgaaacatgcaatatgatcatgccattaacatagggaaattgaaatttatgctatgatgagttagaatccacttcccaatgttccttgactagaatgtggcaaatttagctattaaaacaattttgtgtttctctcgcttgcttgtttcataacgatttggtatgttgctgactcaacagtaccaaactgctgttctagacttcacagtccatcttggcaaagtggtgaagcctatatggcaatgtcttgctttgaatgctaatggactaataaaaaatgtctcttcaacggttctgcacctcaaatgaaatgaggtacaggtcagtggggatgaaacatgccaacatggtcatgccactaaacatagggaggttgaaaattttccctatgacaagttagaatccgctttctaattttacctgatttgaaggtggcacatttagctatataaataatttagggtggctttttttatcatatcatttatggtttcttactgaatgtgaatgaatttatgcacttccccatggatttgtgccatgttatgcagtccatcttggcaaagcaagatagctatttaggcaatgccttgttttgaatgctaatggacttaaagagaactcttctttttctcttctgctcttcagtacagtgaagctgtgtggatcagttgagatgaaacatttagaacttattcgtggtcactggctttaactgtttgtatttgagacatcagaggttacattaaatgcatcattgtatttttggttaatctagtttgtttagagtagatattacatgctgaacaaaatctgaccattgtgtgaatctattggcttgaggttggtaggatgagttgctctgctgcactctgatttcttggaaagatattatactcatgccatataatctatttctattttgttttacagctgagctcttcgtcaatggagagattgttcagaggtccccggagaggcagaggcgggtagaacctgtcccacaaagagcatcagataggcctaggtacaatgacaggacccgatacgcccggaggagggagaaccaacggtgatctgattatcagaagccaaataacaaagccgcctgggtggcttgaggccttactagcatatgctgaatggaacaatctaaaaattgctttaatagttttgtcgctggtattgctatttttcatgctggtgattctcacatctttggatgtatcgcattctgtaattactggaaaacttgaaagtacctggcttggaatgcattgctgctgctgaactcttcggccatgtgcacacttgtaaatcagttagatgattttcacagcgagctacatgtcgtctactctgaatttgttttgttatgttttttggtaaaatgttacgcgtgaaagtgtgattgcatttcttgagttagaactcatcagtgatcactggtcgagaacttgtgaccccaaccaaatcaactcaatttcaattttgaagtttaactctcagtgtcagccgctggactctcagtgatcagtggtcgcactgcagttaaccctcagtgttagctgctgatttgaagtataactcgacgattttatcctgcgaataatcagtgaaatatcccttgccgacggagaggccctcgccggcggcgagccgctccaccatgccctgcacctgctcggccccgaccctcgccgggtcgagcaggttgcaggcgacctccacgacgccgccgccgtgcgcgagccccatcgcctgcacggacgggagcccgccgccgcgctcgctgacggcgcgggcgatccgcctcgccgcctccacgtcgccggtgcggacgggcacgttgtagttgtcgacccagccgg

SEQ ID NO: 13113 - DNA, 12788 bp, Oryza sativa
tcatcctcctcttctccggcgatgtggagatgaacacgagaccagcatttgctgtgtgaaggagagcgtgtggacagaattcagcaacgcatgcagcctttggattcgacgaattttggagttctctttttctacaaaaagcgaactaattcatttgaaaaatcgtgtaaaatttcataggaatctcaaaaaaaagagtgaattgcacattggtccacctattttcaccaatgttgcagtttaggctaggggcaaatccatattttcaccttgggctagctatgtttacaaattatttcagtttgaacctgtcctccagttctctcgattcctcctctctttcttctccaattgcccaggcatgccgatctgagcaaggaaggccatgtttagtagtgtagcatagatcaaggtcaagctcagctcccactgcagtatgtgctctacttccttgatcttcaccaaagcctttgcagtactatatccactcgtcggtggggctgcagtcaccaagatgtgcatttgcttcgtctccaccgaagaggagcaaggctagaccaatcaacgagctcgccagcactacggggtacgtacgtggggtagtggttgtgcttgtgcttgaccagctctccttgctggcactgagaacctcgagctccccccatgtgggaagagagcagctcgtcgagcaacaccacatcaagctaagtgaggaagaagaacacattagtcactaacgcatgggcccactagactaaagtgcaaattatggtaacaaagtctggtccaagttgaaaagatgtgttattgcctagtccaatttgcaacttgggtaaataaaactagtccaaagtgaaatttactccaaaaaaaaatggcatgcaagaactgcagaattcgtccgatccatcctcagtcacattagtcacgacgacgaattatatgcagacagaaatgcgagacaaatatttggattgttttttaagcaagttaacaaattccaattcagcacatcatctgaaatactaattcggtgccagcatacaatgcataaaaagatttatgaactctgttctgttccagtgtcctttccagcaagaattgctgggaacaaaattgagaacctgaaaaatgaatagagccaatatcaactcaacgagtggcacgagtccagaggttggtaccgtgagttccatactttcttaacacacaaaattatacaatacaggatcctgccgcctgtctcactgatgctagtgacattaggagattgcaaacatcaggcggcgtggtgtatattattcccagctacaaaatttgaaactgctatatgtcggcatgtaaaattccatgcatccaaccaaactatatcttcttgcccctgcaaatttcaggcagcagcctattctatctcgcgatatatgatgagactaaagcactaatcaaatgtacgggtcgctcctaaaatcagctatcccgatgctcctgctgcctttgcgtctttctcctcttcagcttgctcttccttcgcaaattcctcgatcagcacgcgctgtctcggtgtcaaattcctgtgtataagtaatacatgaatatttgaacagaagtactagtaacagcatagggcagttcagtaagttccgaggagagcttacgcagggatgttgacattgaagtggacatactgatctccatagtacgatgaatttctcgtcttgattcctgcaggataaagtgatgcttatcactataggcaaaatgaaatgtatcaaccgctacaaatttatgagccatgacggcactgggttttaataaaacaaggcccttgcagactccatttttacttggatgtgtaactgagcatgaagtattaaacatgcagccatatgcaatttatgctaactaaaaaaaaaattttgccccacgaaaaggtaaacactatgtagtgcagtttaccttttcctctcagaaccaccttttggccaggctgagtaccaggcttgacctgtaatatgcaaggcagatggagaattccgacataataaacaaaggagaagattgaaaatgagggtaaactgattttggaggtacctttagaactacatctccagagagagttggaacctgaactgtcccgcccaaaattgcctacaaagatgtttgcagttaatcttaatctgaatactgatgaaatatgagaactgtggaggagatgcctactcgacaacattacaagttttgtttagtatcactagagattatcagacaatcaccacagcatcgttactcgctagagataacatactttagctagttttaacattcaaactactgtgaaaaacaattgttgtttgcctgctctgtggcaaataaggaacagtctaataacaacagtttgttctaagattaaagggaacagacataatctgctaacactaacttgttatcacccagccctagaaggctatgcacaatcctgcttacagaccactaccacactcccactcagattaccagctcagccaaaacagaatgtagtgacaacgaagtatggccggtaactgagtttttctgttttcccgctagggatgtccattactgagctgtgcagtggcaaatataagcataggatgcagaaaaaataatcaggctcaacttacctgagtcacgttcaatacagcatctacatgaatatcacctttctctcttcgaaataccggatcctcacgaacctggaaaaaacagcattacaaaggtcatctgcttatcatctttttctcaaatatgcaggagagccgtgcatcattgcatcaaggggaaaagaattggaacaaatgaccagacactactcttgcactgggatcaacctacagctagttgcaccgagtgcttggtcctgtctgatcccaaagtaaggtttcaactgcctattaccattcattggccaatggtataactgctaatgtgcagaggactaaccttcagagttacataaagatcaccaggactaccaccatctggatctgctccacctgatctaaccaactttataacgtcaccatcatccgtacctgaatgaacagaataatgctcaaggacatttagtaacacaaaataagagtatatgcgtacaaataacatgaatgctgacaatttgaaaactaccaggcactatgttgagtcggatgttttttgttcctggcacaactttccttcctttgcatgacttgcagaattcctaacaacacaagaacattgcaatcaccagctcatcgtgactaatcagaatctagacactgtacaaaaggtatataggagcaaatataacatcagaggtcaagtgcatatttatttcataaagaacagcatggttcagaagttattgttgtggctgatttcaattcatatatctaatatcagacaactggacttaggtgcagtcaacaaccacctgcatcacaagttaaatgaccacaaattgaaaaaaatcagaggggttgatacacgtaatgaataaggattgtaagatggtcaaatttagaaataccgaaccctacatcacaaagcaattctggtcaggtaggtacggaattttatgtcctaaggacaacaactctaaacagttaacctcctagatgatttattgaaggctagataactgatttatcctgactgcaggttatcaacacaaagggacatcataccttcacagtcttcccactaccaccacactgtgtgcatgttgattgcatcctgaagggaccagtttgcatgaagatcttccaacagcacatgaaaaacaaagacaaataagcacagtactaacatttaaatgagataccacattaaatagaaataattgtgctagaggaagaactaacaaatcctgaacccctgcaggctaggcaagtttcaggtttggttccagggggtacgccagctccctctgggaaaacaaagaactctcattagatgattaggaacaattcaaaggacatcgatagtttgatatgtgcagtaaatagaagcgcatctacatactgcaggtgtcacatgtaacagcagtctgaaaattgatcgtctttgtgcacccctgaactgcttccataaatgatatttcaagtgcaacctgtagaatggaacatgaaactgcgattcacagagcaaaaacatgataggtgaaaaaaaaatgagtatagagctaaccttggcatcatgcccgctaaattctctctctctgaatatgtttctaaagaacttcattatacacacagacaacaaaagtcatattagtgccgttatactcatatgattaaagtatacgagcatgtggttatgtgatcagcatctataaaatgaaggatgatgagatgccatttgtttatcaagctgtaaaataattaaataatgcaatgaaagaaacagaaaaccacttatggaaaaagtatcaaagaggcaatgtcgcagtatgtaggacacaagtttctgctaaaactcaaacaattcaataactataaaactacaaagataaaatgaatttccagacaacagtatcttttttctgtatatactcagcaacatgagtgatagaaaacaatacaaactaaatgggagcagaaccaccagaataaaaccagatgacaaataattaaacaaaagatagcatacatcattcattccaccgccgccgccacctccaccaaaaatatcctcaaacggattgccaaaacccccttcatatgcaccaccaggtcctcctccagcggaagctttctcatactgatcagggccaacctgtaatagatcatgtcaaggacaagtttgtgttcaaaagcttgtattgtaaacttctaagacatagcttctgaccctagggtatagcaacgaaaagcaataatcacataatagtcaagttgaattattactaccactaattatgagaataggataactaatgaatctgggcagtgctctacaaggtaattgaaagcttgcggcttggcagcaccttcctgtctagcctacctaggcaggcagcctagggccttggtaaacactaaattgaggttccagacccatggtaatttaaataatagaccttaggcattgacagctaaaatgttggcatttgttcaattaaataggttgaaattgttacctgatcatataatgatctcttctgatcatccttcaaagtctgcaaagaaggaaaaataagtatgtctcagtatattatcagaaactaataataacctttacctatgtattccatgctgaaaactgtacctcataagctcgctgaacctcttgaaacttcctctctgcatcagaatcacctttatttgtatccggatggagctttttcgcaagcttttaggacaacaaagaaaaaaaaagggattgtgaggtaaacaatacgcgatgattttttttttctttcgatggtgcataaggaaaggaaatgccaatgttttctatattaacacaaggctaatacataactaaaattgaggatgagaaatggtaaatcaaacaacctcaactgccctttactcaagagtccatcaaccacttttcagaaacattctggtagacaaaaaaactggtagatacccatcaacttgcggttaacattactgttccaaaatccaaatgggtgatgatctttctatgcacaagtcctgaagtgtaatgatgggaacttccaaagtctatcactaaaattagcaactaaaagtttagtcttcactttataattcaagacttgcgatatagaactaagatgtgccgcgttggtgtgctcaatttacaccctaagcatgacatagtcttgattccagagccaaccataccgcgtaatacgctttcttgatctccccctggctcgcgttcctgctcacgccgagcacatcgtagtagtccctcgctgccaccggcctcgtccctgcagagccacacgaatccaacatcaccaatcgactcagccaagctcaccaaaccagaaacagcagcatctcccttcttcccctttttccccattgttgtcctcaccgtggaagagcctggcactagtcggcgaggagaacggcgacctccacgcgggagccgcggcgcgaaacgcgtcgccccacctcgctgcacaccaaagcaaccaaccagaaagaaagatcagtcacactggaaggaaatcccaggaaatcgggagagccacagtgcggggatgagggcggcggcggcggctcacctccgtgggcgcgcgagccgtggaagggggacgccgacgcggcgggcgaggaggaggggagggcgcggcggcgagcgaggaggagggcgaggcgagcgtcgccggggagccgcatggtggcgaggtgaggtcgtgtggcctcgccgtcgcgtcgcgtgcttgcggcttaagaagtccagagcgtgcgaggccagcggagaaccttctcgaaggcctcctattgggccgtgtgatctgatgggcctcttggcaggccaaggcccattgagctcatctcttatttcacgggcccttcacgtttccagtttgggttttggagcacaggttctcgttgatttaggcccattgtttgatttagggctcgatgatatatattttttagttcagagtaaatttgacaaaactatgtatataactttgatcaaactatcataaaaactataaatttgagacgttgtatcattaaacacatatttagcactaaagttatcataaaactataaatttagagccaagcatcacaaatccacatatttaaaaacaaaattatcccaaaattacaagtttagcatattttgataatgatcaatttatgtttagttaaacttgaagttgaaactttatgtatagttgtagtacgtgcacacgtacttgtaagtatgtttagaatttttattacttgttagctgatgtgtatggtaattgagcgtgcactctaaacttgtgtgtacaatacatgttatcgggttgaacgtggcaacaaatcaaaatgcctttagtttccactttttcattgttcaagcacaatttaagtttcagtacacaacttcaatacaattatttcttcaatttgtaataaattagttaattacagtagcatctggaaatcaaattacaccccgcgaaatgaaattagctgatcgatcaccccttgatgccggtgctattattcccggagcagttaccggagttcttgtacggctccgggcaagggccgccgatgcagcggtcgtgggtgaggccggcgaccgccgcctcggtggtgtcctggctgcacgacgcctcgccgccggacacctcgtagtagctggagatggacaccggccagcagtggaaggtgaagttgtggccgcgcctgccggcgctcacgccgcgcgcgccgccgatggtgaagctgagcgacgccacggcctgcaccaccacctggtcggtctcgccgtcgtagagcctcgcggcgagcgacgccggcagcgcggaggcgttcaggaacgcggacttggtgacgaagtgcgactcctgctgcggcacgacgaacgcggggagcgtgaacgcggcgagctccgtctgcgccgcggcgccgtagatgaggcggacgaggttgtcgccgccgaagtggaccacggcgcggccgctcgggttgtaggcgcggagcgtcaccttgtacttgaccagcgacgccgccgacggcgactccggccgctccacggacaccgcgccgttggccaccgacaggtccagctccaccggccggagcaccatcctgatggccagcaccaccgtcgccgccaccgtcgccgcgagcaccgcggtcaccgcgtacctcgccacgcccagccatggtaacttggtgtgcttgccgtcgccacccatggtctgcactgtacactgtcaagcacacacatcgcctatacctgttgctagctttatatatgtgcatcacgaattcgccatttccattgctatgtcatctctcctatgttaagaacttgttctgctcacatgtggtttctgtgactgtgatcgatttgacagcccacccactaaatgcaatctgctaatcacgagctgtttctgcagctgcagctgcatgcaagaacatattctgctcacatacattgatttctcagcttaggatcagagtattgttcattactctacctcatggtcctaacagaaattatacgcactgctaatatataataatgactttattcgtcgtcgctttcgttgggccggagagcggagaggtccaaatttaaaaagaaaccactactctaaaaggtttacaccgttaaataatctgtcgcgctctgcgagaggaattgctgtccgtggacggcctgcaagttgtgagccgtgcgtcgattctcgccgtcgtctgcgatacttgacgtcaatccagtactgtaacatcctgaaaattaacaattttctaattatgcaccacgccgattcttatgtttttaataacttcttaaacctagaatattataattagagagacttcctaaaactaactcaaaacctctccttttatttaatttccttttgcggtttctatttaaaaccatcttgggttatttcttgatttgattcaatactttcctccgaccataatttctttaaatttagttcgaaaaccctttttttttgttatgaattatggtccaaaaatcctttccatattgcccttgaacctaaacaaccgtaattccgattccattggaattaattgttaacccatcctttgatcttaaacctatgctttgattccaaacctatacttagttccctttccaaattttaaatatccaaattcctccctttgatctagccatcgttaatctctatggttggatttcctatttggcagaagaatagcaatattacaaatattgtgaatgattgctcttgtgctgagaagaatagatttttattttatcctcctcttccaaattgattccctattagccacaaataattcttcaaatattcctgctatcaaatttaggattcaaatcctttttatgtttacctccaaccattttcctccaaatatatatattgaggaattatattgttaattcccctctcatttgagtgctttgatatttagtccattatattctatatccaaaaacattgcactcaaataaattggaaaatccctcctttgccaaatttccttccaaaacttcctattcaaattctttgcaaaacctagccatccaaatcaattattcaaattagacttcttcctttttgtcattgggctgaaatccccttctctctcccttcggcccatctcccttctcggcccaaaccggcccatccaactcccagccgcaccaccgtcgcctccttttctgtgggcgctgccgccggcgccatgggcgcgcgtggcgcgcgtacgcttgccgccgccgctgccttgccaaccacggcaaagccatctccgtgccgtgcactccactgccgccgccacccaaccctcccgcgaccgccgcgtgtatgcgccgccgtcgccgaccaatcacaggccacagccggcgccgtcgtcttccttctcacgtcgccgccaccaaggccaactccctcttcccctctgcaaaccgccattgaccaccgcccttcgccgcctataaatagccggcaataccccatcatttccccacatcgagcttgaagctcttttctgtctccctccatccatgtccggccgtcgccgccgtcggccgatctcctccttcgtagctccccttcctcttcccttgcgccactatgctggctccactccagcgaatccattttgcccatctctccttcctttcccctttgtatcaagccaccaccccccctctctttaccaccgaagataaactcttctactcgccgttccggccacatccctcttcctctcttcgatacaccaccctccccgggtgcgcgtcgctcgggaacacaacccaccgccaacgtcgcagcctcccagccaccggagcaccgccgccccactcggcctctcctctctcttctctcggctcactgtgagacagagaggaaaacgaaaggaggaagaagaagaagaaatggaaaaagaaaggctgacaggtgggcccccgtacagtaccactttatattttctagatttaattcaaatcctattctttagaagcccatatctcctaaaccgtagatccgattccagtaaaacttggacctaaattcatctaaattcaaaatctacattttgatgccaaatttgctattttaagattttatttgaatttccttaatttattcaaataccatttgaataaatatttgatttaaacttataattgaaacttatatttaactttcaaatatttccttttattttaaaaataccctttagccactaaaagccactggttagaactttaccccttccatggggacgttcgcggtctattgactccgacgtcgaaccgttggttgttaagtccggcaaaaccaaacttaaggtcgaaatgctgctcctggcaccttacgccttaatgcgtacaatggtcggagcttcactattccctcgacctccactacacaccgcatagttagctcttaagctctgtgtgatcctaaccgctccgttgctactcacggttgtcggagtaacacttcctacacaaacttcctattcctctagtcgttatgctgtatgatgacactggctagagaagatatcaaatttagtcattatgctgtccaactctagcaacgactagcaaccaaaccctaaccaataccttcctagttaattcccgtcatcacccaaattccatacccacctatccaccatactctcagccacctactctccacctaccaaaacctatacatatagagcctagccgatatgctgtcctactccacaatcaactcccatataactaaaccctacctattatactacctaaacctaccaccagcaaatactagccatatacccacttaaccagtccaattatccaactacttcctatccttccaccaaccaaaacctgcacataaaatacaagcgacaatagttacttaatcctctctaccctaacctccaacccttaggaacctatacatgatatattagcccaataatccccataccctaccaaaggaatagattataccctaaaccctagccttcctaagtcgtttatcgttcttttgatatttcatagatttttattgaatttggctcttcctcttcttcagtagagtctattttattctggatggcaacctgtggtatttcgaggatcggataatcaggttgcctatctcggatttatttgcgttggagtaaggcaagttattattcctcctttttgagcataaatgccctatattctatacctctattctatgcattagtcattcatgatttcaaatgcataacctgaacatagcaaaccagatatgctagcttttgcttagccctgcctagttagactgcataaaaatataatgaacttagattggaacggtacggtagaattggttgatttccgggtggctagtactgttccaaccgacataagactggccaagtacttgtgaagaacgaacgggtacgaccatagttctaagtatggggatagatttagtattatgttaataacaaggtagtacctctgtacagtggttctttttttaagtcatcgagtaggaggcaactatatgccgagcagggcaattattatatgagagaatccactcagtggcactgagttttccccacttctacaatttaccactgactttgtcaagttgaataatatgccatcgtgttttcccgaacgtctactaagtgccatcgccgtccataagccgttagttagacatctgttagagctgtaaaaagacctatttgcccctgttctcgttgagccaagcttcttccacacagtcagcgactcgccgccaacgttgtcctggcacgggggcgcgaagccgtcctcgttgcagcacccgttcacgtagtcacactcgtccaccaccctgacaacgacagaccgtccattcacggcggcggcggtgacgacgacgcggatcctcccgttgcagcggcggcagcgtgcgccaccaccgccgtcgtcgaggcacagccacccagacccggagtacagctcgacgaccagctccatgttccggcggaagcacatatgcagcgtcgggatcgccggcgcatgtccgataccggctgtgagccacatgaaccgcgggtagcgcttgccgacgacgcagcagtccgggcttcccttggggcaccgggcacctcgtctcgtttccgtggagtaggcatagccgctgccgccggcgtggcagctgccagcagcagagatgccatgccgccatggataatgggggaggcagaaagcaagcacatgacctgcaagaggagagcacagctagtagcacatgacctgagcgagtgggttggtcgtgatttatggatcgatccagaccttaacccatggattgaatccattccaacccgaaaaatcacgccaccattcggagtctcgggcggctggccttccatcgatgggagtcggcgctgccacacactgggcagatcaaatggggattgcacggctagggtcttcagtcaaagtgctaaggtaagggtattttagtcattaagaaaaaaaatcaatacactaaacggatgcatcctaacggcttgtggatggcgatggcacttagtagatgtttgggaaaa

SEQ ID NO: 13114 - DNA, 10669 bp, Oryza sativa
atgtgaacgtggttgtgttaattatattgatggttgtgtatgtgaatgaatgtataacttcttttccggaagcagatctccaaagaactctgaggttaagcgtgcttggcctggagcaattttgggatgggtgaccgaccggaaaattttttcaagtgtgcagcccgggtgcacacgagtgagcccggcttgggagcatggctagcaaaggtccgaggctagccaaaaaacaaaatttattttttttgtggattatactcatccgtgacaggctataatttaggcccgattgagatgaaagtcatccgtgacgggggctataatttaggcccgttagagatgagagtcatctgtgacgggctatagtgttggcccgttagagatgagagtcatccgtgacgggctatagtgttggcccgattgagatgtgtgtcatccgtgatggtcggatgcccgattgagatatgttctcacatcactgacctttgctcagtgatggggggcctacccgaaagtgatgaggtattatgcccgttagagataagcgatcccgttgtagtgtttataaaccctgatcgagatgacatggtatcatacgatcagtcccccttaaatacctcggaaacgccagaacttctcacgttgctgataacgtacgttcagagcgcatggggactagagttaatgaaacaggtgccacaattgttagtaatctaatactaggccatgacgaaattgatgattatcaacaagtcatgggctgtgggtaaagcgtacatctactgcagtatgaatattcatgaaactattcgaatagctgtgctcacggatttgagcatcgggactcatatggtatttggttagaaacttaattccaaactttattaaatactgttgcatttaaaacattacaggctttcttcctctatatcctctgctttccacaagtaaacctagctctacacagatattaccatttcatgcattcattattgattaatataatagcttactgagtacgttgtactcacccttgcttcaacccccctttttcagagtcatttttggagttcttatcgaagccgggagttcaatcacataagttagttcccttttaacttagtcctcaagtctagattatttagatggtttaagtctatagcaaaacagcagagttaggtcattctatagcttctgctgtaatggttagccacaagcttgtaaacgccctattactttatgtattaaaatctccttcaaagctatgtttaaatgtatgcaaagacgatccagattgttgaacttgtatcaatctactaatccagggcttgatacagtctaaatatgtcggtttcagaatcattagttttgggacccgacagaactggtatcagagtatatgttttcctatagtcttaaacccataggttgtctaacccctttatgaataacttcccatttatataggataattaggttaaaaactaaaattttgcctaataagtttgctaaggcctttattagaatgaactccccttcattattggttttattttttgcttttatttgtgcatcatacctcctttcaaaagaataactattttactataataatataaccccctccgaagactctagtccttggtatttccagaagggcagtaaataaaagcctttggttatgttagcatgagtcaaaattattgcaatccaagcaacaagatgtacaagatttgaggaattactagtccacaagacattctacatgcctaagccatgacaaagatatttatgagaaatatgttggactaaagaatttgcgagatcaaaagaaaagatgtcccattttatgctttgatttcatgcaaggtaaaggatagttttaatctcttaaaccctaacaagatctatcgtcaacgtctatatcatcaagaagacttacggtatgaagccaagtgacaattcaaatacttgagggctatgaaggtacgttcaaccgatggagcaatttcaaatgaagaactaccgagataatagaaatccggttgaagaacctatgactgtggaaatttaagaaatatatggagatcaacagatatgggatgatggcaaccattccaattcatggagaacactctgaatacactcagccaaccgagaagattcatgaaagccaccggaaccagttataagccacctccacttccaaaccttctgaataacctgtacaaattctatagtcaaggccaaaccccattgaataacctgtacaaacaagattttgtacccaaaccatcatctaccctacttagaaatatatgtaacctagaagagaatgacctcttccatccatacaaagatctctatgccatcataaaccataggtagagccaattttcagaagatgcactaatttaaagctatagaagtacaacaagaggtggatatacctatagataccacattatgattgagcagtatatggagcgacaaatccaagaagctgagaactcctattggttaaggtaatttcggactttaaggtcaggtataggagttgcatactctgtatgacaaataacttgaagatgaacaattcgtcgtggagaagaataagtgaagcctcgaaaggtacagtaaatattggattttgaaaaagattgtcagcacatgtactcttgcaaccaacactttatgctaaggagttaagcaagagattttatctacctagcatttaccaaattaaatacaagacaataatcattatggaaacaagcttaggactaggcagcaccccaagatattctatgaacaaaatattcatggaatatttatcgctgcactttatggagacatttccatagagtatacatacatctacattattaaagatagctttctctgccaagctaaaagcgtgactgaacggaaaatatcaagacctacaaaaggagtctgaatggatgaacctgagtcttattacgataaggtgtagaaagaatagaatgaaggcttatacaagaaagtagattagtgacttatgtgccatggtaattacaacacataagcatgattattcataatttagagattataagttaaggttaagacaaagaaggccagagataaccaattatcaatgcctgaacaataatagagatattttattcaagaccctgaactggaaagatggatctgaacccgctaagagtcaagattgtaatgctgaagaaaccaattatactcatttataccaaaaatataaatgggtatatcagaacaggagaatagatctgaagaaatttaaggatacaaaaatattagttggagaagtacaaaatcctttctagacatagttgattatgtcgctactcggaaacgtatgattaaaggaagaaaatttgcaatttcaacaagtaccaagagtctgaacggatattgacaataaaattgggataaaaggatatggattatctacgagaaatttcttcatcttcaattaaagattgaattcccaatttctttgacacgaggagaaacaacatagaagctcatgaatcaacaaggataaaataattagacaacacaaaattattgattgagaatatttcttgaacaagatctctcctaggtattgatgactatacacaacttgaagattcatgactagagctagaggtttgcactctagatatgtacaagaagtttgaatggataccaacaatatatttggattagaaggacacaaatcatttatgaaaaattttcttactcacaagttatcaattttctagataccaagaaaaccatgaaagaaaagtgtcttgttaaacactttcaactcaaagagctatactacaggccaatcattttgaaggcaagaatttcgatgtacaggaagaataaaatagcaactaaaagtgcgactgaatggaaataattctatgcaaccatggaaataaattcactaccatttaaactacatggattttgaaatatctcacgatgtttcttaagtataggtagtgaattatataccaggattgctagcatagacctctttatatgtaactccaaataagcagccaagacacgaatttccattaaagaaaataatcagatacagataaagaatatgaagttcaatatcggatgttattcaaacaagggagaaattttagttaccataaggaatacaatatctagttaaagaatgtagtaggggaatacaggagatcagttactacaaagtaattaggaaattatgagatagtaaagacaaagattctgaaatctaagttaagaaagaaattacaaaagattggaagaaaatattgtctaggaagatgttgaatccaatagtaacatacaaagatcattcatcagctttattccgaagatatgagaagaaatttgaccacttcaatgttgagaagaaccagaaggtcataatttaacctcctcgacaagtatcatcgctacacatatatgtgcaaggaagattgaatcctagacagaaataccctataacatgtttaagttattaagtgttggatcctcaaaccttgaatcacatgagattgaatcaagtgatctgacgctgtccaggtactgcgcttacctggtggtgttccaaccggatctcctccccgactacagtgagaatgcggaggacctgttccaggacatgaagacggagctcaaggatatgctcggctgttaccactactatttctctcgaggccgtaagcgggccaacgccatcgtcaatccatcgccggctaacaacaacgacgacgacaacaacaacagcaagaaacagggaagcgtgcgcaagggcgcagagttggccacattattgctacaattacaaaaggacatgtggaagcttctggcggaggtgtggacggagatcgtcgtgtacgtggctgcgtccaacgaggtggagcgtatcatggcgcacaggaatgtgctatgccaaggaggcgagttcatcaccgtgctttgggctctcacgacacacaccggcattacccgagatcgccacgaaatcgtggttgaacaccacccgtagtaatcccccaaattaaagcagcacaaattcgatcaatattattggggtccatgtccatcccaaggccctagctatatatatattatgtgtatttgcttgctttcttaattatttgcttaatttggatgcatatatatgcatgcatcaaagtgattgtttttcctactctttctttaattctttctttcttttgttgtaataactaatgtctctactactgtaattgcgtgagtacgtgtgcttatagagtgtgctactctctacctatatcttcatgaattaataatataattccatgcatttttattatgtccgtcggtcggaaagtatttctaacgctgcatatgtatcgtacctagtactgcagtgcggctatggaaattttcactgagctaggtggaaggggaagttagaggaaattcatagtgtgatgagacaaagttggtggcgcaagatgatggaagaagaagaagaaggagaagaaatgaggggccacggattgactgggttgtatagttggccatatatggcccagcccaagcatggcacggcctgacagttgggccatgcctgggccgctgccttggcacagtgggctggcccggcacggcacgagacatgagggaggcaaaatagacttacttcaagcacccaacgaggagggactcaatatagacttatttctgctatatataagacacgacccatagagaagggaggcacaatagacttattcaagccatatataaggcacaactcaatgaggagggacacgataggccggtccggcacaacacaactcttattgggtcgtgtctgggctataagtggagcccgtgggcgggcatggcccggttcggccattgagagagccatgtcggctccactggtgtcggatcgtgctaggccaagtggcccatttgtccatctatactggattgggctgagaccaatggaaggataaggagtcgtggcctagtagaggaaggaataagttcatttgaggtcccttaactttacaccgaatccgatttttgtccttgaacccaaaaatttgatacaactggtccctgaactgtcaaaaccggagcaaacgaggtccgttggttgtttggaagccatttttggctgacctggcgcatacatggcttttttgactaggtcttcgtcccacgtgacattgatattgtgcttacgtggcaattcgatctcaaaaaaataataaaaatcgtgggcccacatgtaaacctcaattctcccttcttccctctcccctctctcttccctcttctctcgtcgccgtgggctacaggcggggcagatcggccggccggcggagcggcccgagcggtggccggagcgggcgtagagaaggataaggcaaggaggacgttgagcggggtagggtagggagggaggaggtggggcgcgccgcgacgtccggcgccacctgccgcgtcaagtccttccacagtgcgtgcacctccagtgcccaggcccacgctgcggcgctctctccctatcccctctctctctatctctcctgcaagaataggaccggagtaggcgaaggctggggtgggtggcgggcggagctggcggcggtcgtggtacaggcgaggggcaaggtggctgaggacaacgacaacgacgacggcgctacggacgacgctgagcaaccggtggccagcccacagatggcggtgcctccttctcccctctcccctctcctctcgtcgccgtgggtcgaaagggaggagatagagaccttgtccccctcgtcgacttcgtgttggcctgcgtgactgcgtcatcccagacgaccacgcgtcgttgtcggcagcggcaactgggactaggaggaagatgaggcggcgatggctgtgaggcggtgctgcggcgcgaggagaagcacccgaagacggccacaaccttcgtgctgtcgggccgcctgccgcgagtgtgcgaggaaggggaggaaggcgagctggttccatggctggaagaaaggagaggagtgaggttgagaaagaagagggaaagggaatgatatgtggggtccatgtgggccccaccatttttattattttttgtgtgtagctgacatatggacctaaggtttttattatatttccaggatagaattgccatgtaagcgccacgtcaataccatgtgggacaaagacctaattaaaccagccacgtaggcgcacgtcagccaaaaccgccgatggacctcgtttgcaccggttttgaaagtttatggaccgagtatatctgattttggggtccaaggacgaaaatcggattcgttgtaaagttaagggacctcaaatgaacttattccatagtggaatgtaaaggagcaaacaggaaggaggggttgggcttatttaggagaaaggaggaggggaaacggtccagatgaatagtgatactttactattttcagggatttgtttgaatggttggtttgaatacctaattaatacggcatttggattcgatgaattcaattgatatttgggctcggggaaaagaaagaggagtcaaggatgagaaccaaagtggacatttggatattttgggaatgaattaattttacaggcttgagactgtattttgggaagcattccacagggagtgtaaatttggggagttcaaacctgagaattgaatttacagaagtgtttaagggggacaagtgtggaacggatatcagatttgaatatgaggaattttgcggataagtttttagggaagaaattcgaatatacgggaattaattcaaactctagcattattctggaataggaatattgaggagtactagttgatttttggcatcaagaggaaaggatctggattggcatctatggcacaacttatacgacataaaaaccaaagagtgtttttttacggatggagtttcattagattagtttttaacgcctcacgaaggatagacgttacagcagcccatcatcaccgaccagtgtgaaggtcgaggacggccatcgtctcgtgctctagcatgtagtagtgttataatccctgcatgaatggaaatcaccagaaaaggcgtggatcggatctgaaaccccatgcaaagaaaacgtcaaactacttttcgcagtgacaacaacaataacaataggcaacgaagctagggcaaagttctgggactccgcctaactgcagggaaaaagactgaaagacatggccctgctagtgtgtgcagcatcaagaaaaagaatagatcactacagcaggccatcaggaacggtcaatgcctccttgaccccgacctactgaccggtgttggctggacaactaagatgatcacccaaattgtacaactcatagagagtgaagaggacagaattacctggaagcttacaaaccacagtgagtacaagacgacgtcgatctacaatgcacaattcttgcctcaacaaaatcggactttgacgtactcatctggaaaccctgagcgccatgaaagtgcaagatctttacttggctagtgatcgaaaacagggtctggacatccgacagactcgcaacaaagggatggcagacgcaagagaggactgcacctctagcagagtgcatatacactaggagaatttggggggaaattgtggattgggtttcatgtcacaatctaaaccgcacaaagtggaggcaagccactatagtgcaggagtggtgggaggcgattgcaaagacgagagaggtgttgaagcaagcaatacgcaccctaacactactgatcaattgggagatctgaaagaaaaaaaacaacgaatcttccaacacacgaagctgtcaacaatcgggctagtcagtaaaatcaaggaggagaccacaacatggtcccttgtgggaccaggaagttagcaacatgtctaccttgccgctagtgggcttttaggttttttttttcggtacagtcttctctgctccctctttttttaggggctattgcattcttacctttactttacaatttaattgttgttttgctcatactttttagggtttttgtctttgtcccagttttttttttaaaacgaagtagtgttttgtccctggtttggatggtcagtttaacggtgttatgtcaagcgcgaaaagacctttatatcattgcttgctattgcatatttgcccctactttgaactactcttttttactcctattttgtacgtgacatttgcatttgttatgaactgagatttcatgcaaaatatttcaaatctattctgatttctgacaaattatgataaatatgacaaatttaacattttttttgacttaaatggcaaacgggagatcaaccaaagtatgcctgcatatcacatcagttaaatccattcataatctgctggttaattagcagcaagcatcaaacccacacatgctacagagtactgatgctatacacgatacagaagcaaaatacttaggaagaagtcagtcagtccaccacctctggcgcgtcttactccaggctagagatcgcgatagcatcagccatgacggcggtctgcgtgagcttttcgtccaagaaaagcctcaccagcaaccagctggtgctctcgctgaggagacgtcgtcggtgctgccagtgccatcgacagaaacttctccaccagcgccgccgcgtgccgcctgctggcatcgccgggcgccatcattggacggagcttctccacccgccccgccgtcgcctggtgctcgtgccgatgacgcgagggccgccgcgccgacgagttacgttgttgccacgctgctgctcgcgtcgctagcgccaccattgaccggagcttctccacccgcggcgccgcctcctggtgctcgtgccgaggaccggccgctgtgtggaagaatcgccgcctcctcctcctctatctcctccccaaccccaagggtttgcggataggaacagtggggaacaaatctgaccgaataggtatgaatgaatcagtatgatattgcttaaggatagaacggtaatctaatatttcctaaactaattttctcttttgatgacttccaattctctaactcaatatagtggaacccacctaactgtcattgtaggggtaaatggtgatttcatttcaaaatattaggggtaaatttaaaaatcctaaaaagcgagagtaaaatcacaattgggtttaaaagtaagggcataagagcaattctccctttcttgtaaagttaaactctattcaatgaaattggcgcttatcgattcgttcaaaaaacataacactactacataaatgattttttcatatggtcataatcgattttcgtaggcgggtggggtagcccgcctacatccaggtgtctgcgatttttgcatgcgggtagaacaaccgcttccgaaaattgtattttcacatgtgggtacataaatcgtcaggctgcaaaaagaaaaaacggcaaaaaaaaaatctagaaccctagcagctcctgagcccgagattcatccttgttgtcatcgccgccgccatccccgtctcccatcgccgccactagaaccatgcattggatccatgtgcgcgggatgggtaggc

SEQ ID NO: 13115 - DNA, 4904 bp, Oryza sativa
atcccaccgcaaagctcatcactgctagatccatcgccaccatccgctccaccgtatcaaacccgctgccgccgggctcccaccccccctcccgcgctctcgctcctgcccgccgccgagctccccaccactctcgctccctctctcgtccaccgccagagaaagtggtcgtcggccgctcccgagctcgccactcccgctcctgcctgccaccggcagaagtggttgccggtcgctcctgctctcgcctgttgtcggccgctcctgatcccgtccgccaccgaaggagagaggaggaggaggaggagcggaagtggaggaggtggaggaagtgatgggtggagagcggagaggatgagtataagagagagagaggacttgatattttaagggtaagcttgatctgatgagctggtggcaggcggggctttgaacatgccgtcttacgaaaatagatttattttcacacgtgatttttgaactgtgtttgagggaacgatttttccataggaaagcagctatggaccacctgcaacctaaagggattttataaaaaaaaaatcgattctgtggtagcgtgcacgtcgatcgtcactgctgatcccattgagacttgagagtcacccactagctaacgcaatctgctactcactagctagtagctgtttctgcagctgcaagaacctattctgctccgacccggcgaaaaaaaaagaacctattctgctcacatgtcgcagctgagatacaaatattgttcattaagctatctcatgcatgcatgcatggtcctaatagtttagttatacgaacagctaataataagtttattcgaatataattcctactgacattagcgttcctgcttccgatctgaattcagaaataatgcaaattaactgcctaataactttattcgatcgaatccattcaactgatggaggctgatgagctgctggtccagtggcgtcttttaattctagttgcatgcaacgtcgcttgcacatttggtagctagcaagaattgagctcagctcatgcacgtagctgtgtcaagatgggcgccatggccaagatccatggtcatccgaggcggtgtctcctcggtgctctcgtcggagccatcgccgccaccgccctcgtcatcgccgcctcgttcatcctccgcccgccgccgctcgccttctccgtcgccgacgcgaggagcggcgccactgacgagaacaaggcggcgttcctcaacctgaccctggtagccggcaaccctagcgggcgcgccgccgtggagtacgaggcgctggacgtcatgctctggtacggcaccaccgactacatcgagaccaacaccagcctcctcctcgtcggcctcgccgccgccgacgaggcggcgctgctcctgcagccgccgcgcaacgcgacggccgtggaggtgacggcgcggacgctggacgacaggtttgtgcaggagatcgtcgccggcgaagggaggagaaccgggctgtcgaaacatgaattcggcaataataaaagggggtagcgcacgagacctaaaagtggatggatgcggagacaaaggatttagacagattcaggccctctcaatgagagataataccctactcctgtttggggatttgaatccgccgagtgtgtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgacctattacatattccatagatataagttattccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaatcaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccacctagaaaatgaccacaatatataatcagcctaagccataatattggtcaataaaaatgcacacttacgtggcgaaaagcaatgatattgtatctaatcaattgcttaaaaacccaaacagcaccttgacttatatataaaaaagtcagcgggacagctatataaagctttactgtttgacaccttttaagatgcattgtaccaactcctaaaaaattaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcttaggccaaaaaatatgccttcgacaccctttaaaggatgacgcatgtgacatgctcccgagtaacaaatcttctgggtaatatagaccaagtgtagctcatatgaatagcttctgatctgaatgattatcccttatgggatactccaaaataaatataataattgaatcccgactggcgcaagtattcggttgatagcccttacggggaaaaataattggtccagtctttgagcatagaaaatagactcatgactatgaatccatgtggaatgtatccgaaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacaatgacaccaatcaaaggtaatgaagttgcataaccatggaggcgaagaaaccagtcggctacagccaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaatacttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggccgatgaagcagaggtgctggtgatgatgtcagtgacaataatccatcaaattaatgttatggctgttgtagatgcttcacttggaggagagttgatgtcaaattaattttgagccttgtatttgtgtagcccccgactctttggttagttgggaaacaactgaacatagagtcgagaattatagcttcttgtcgtcgagtagttattgcttgattgaagatatgtgttgaagatgtccaagtagaaatcatgaatgttggagagccacttgttgtagtaaaataacacggcatcgcatgccgagatgtcgagattcacaacaacgtcgtggttggtgaagtagtaaaacttgcgaagtagcaataatagagtttgccggtgccgaagataataaagatgaagtcgctccaccatgatgacaaagttgtattgccgtaatgaagtgaacataagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagggatgaagatggtaaggccaatcaacactggcagaatcatgcagccatggaagtgcagaaaccagtcggcagccatggcaaacgtaggcagcttgtgttgaagatactgatgcctattagtagtgacagcgatgtagccagccgtgaagaagatagcatcagttggcgttataacaggccagccgtacaggcggtgacaccagtcagcagcggatgcggcggccggtcggtgaagacatagacgcccaacaacggcagcataataggccagccgtgcaggcgaaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggccagccgtgcaggcggaaacaccagttggcagcggcgaaggcaagccggtcggtgaagacgtggacgcccaacaacggcggcataaaggccagccgtgc

SEQ ID NO: 13116 - DNA, 1605 bp, Oryza sativa
gccggtcggtgaagacgtagacgcccaacaacgtcggcataataggccagccgtgcaggtggaaacaccagtcggcggcggcgaaggcaagccggtcggtgaagacgtagacgcccaacaacggcggcataataggccagccgtgcaggtggaaacaccagtcggcggcggcgaaggcaagccggttggtgaagacgtagacgcccaacaacggcggcataataggccagccgtgcaggcggaaacaccagtcggcggcggtcgaggcgagccggtggtgatgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctaatataaatataatactcgagaaaaaatcaagtattttaaaatatgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattatttaaaaaatacgatataacatctatagcccccgactcactagtcaacggcgaaccagttgatgtagtgaggcgaaggaaaagacaaaatatcatataaagaataaaataaatgatgacttagctttgtaatattccccttggtgatggcagaagtggccaatgtgggaacaaagtcgtccatcaataacaatgaagacaccagtcggcggcgacttaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatggatccgattagatcggttttggcatgcttcgtgtttgtagatccatcttgcaacaccatggcatcctcgttgggtagattggaccagtaggcttggtggtggacg

SEQ ID NO: 13117 - DNA, 27672 bp, Oryza sativa
  unsure (1)..(27672): unsure at all n locations
ccgccgagtgtgtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacacgggccattcaacgtggcggtggcggcgcaggtgcggttcaaggtcgccggcgtggtgtacaccaggccgtacaacgtcagggtgtcctgcagcgacgtctacttcgtcgtcgccgacaacaagagcgccgccgccaccgcttcgtctacgcccattgattgccatggctgatttcatgtgtttgtgttgtatatgcgtgtgcatatggtttgattttgggttgtgtgattggtatattgcgaggtctggtctgaaccgtttgtgacgctacctcatattttgcaaatatgattgaaattttaatatgtataacatcaataacatgtttggtgtaatgcatgggttgatcgatgatgtgtaatgtctacatttgtacgaattgtagtgtgactagtaactccattccatgtgtacaaatgtaaatcaattccattaaaacacacgcatttatatgtacgtatcatcaacatataacatgggaaaactcatttcatcccttagagtatcctctcatttttctaggttattaaatagtcactatttgttttttttttaaaatagaatgatagatatatttcattacacaaacatgcaaattcaaattcaacctacaatacaagtacaaaaaactgtgaataatgtgtataagttaaatttaaatttataggtttgttgagcatatatcaaatattggcttatcttgtttttttttcaaacattttgatggcttttcggaacatacacaacatgatctttacatgaaaaaaaacacagtaacacacatcatgtatgtatgtatatatcacatgcatcaacacacagatatatgatgttacaccaatccattgggatgcaaattaatcataatgaagtgattaacaatcaatcaatccaaaaattagccaatccatgcatgcaaaccaatctttactgtaccactccaaccatcagtatcctcaatcaccatccgatcgatgccgcgatcacaccgacgcggcggcggggcgggcaatgccggtgtgcgtgacgagcgcccagagcacggtgacgaactcgccgccgcgcgccagcgcctcgccgtgcgccctcacctgctcggcgtccctcgccggcgccacgtacacgacgatctccgtccacacgtcggccaccagcttccacaccgccgcctcgtcgccgccggccgcctcgtccatcagcgccttccccagcctcgcccccttgcgcaccaccgtcgtctcctccgccgccgcctcgtcgtcttcttggccgccggcgatagccatcatcttcccgtaccgggtggcgtccgtcgagaagtagtagcccttgagacccagctcccgcttgagctccgtggtcatggcgccgtacacccgcgccgtgcagtcgacgtcgtcggggagcatctcccggcggaacgccaccaggtaggcgcagtagcgggacagccgcgtcgccaccgtgctcgacctcgccgccgccgccgcctcctcctccgcgtgcggcgggcacctcacctccaggaggctggtggcgatgtgccatgtgagtatcacctcggcgacgctgccgctctcgcatgccgacgagatcagccgggacgcgttgcacagggcgttcctcgccgccaccgccgacctgccggcgctgagcggggcgacggcgccgtcgtacgccgcgaggtactccacgatggattgcttcgcctcctccggcacggccgccgccggcagcttcagcgggagcctgcagaaccagagcacggagtactgcttgacacggaggtaattgcggcggctcatcctgttcgtcacccactggacgccgcggatggcggcgcggcggagccggctcggcggcttgacggcgtagtcgcagaccatggagacggtgagccagttggagaggaggaagacggcgagctcccacgcctcctcgtagaggatggtgaggaagaggaggaacgtgatggagaggtcaatggaggagaagagcgcgacggcgaccggagtactctgctcaggaggcacctcgtcatcctcagcaagccgaacgacacggcgtagttgtccctcttgatgctgccggcgatgaaggcgatgtagccgttgccgcagagcacgacggtcatgaggcagaggccgagcacgaggacggggaagacgatgtagttgacgaggaggaagaaggggctcgcgagcatcacagggaggacggagtggtagtactcggtgacgaacccgagctcgtcgtcgatcacctcgaacagcgtcgccgccgccgtcgcggcgccgccgtcgttgcacaggcctcggaagatgagctcacggcagtcgccggcctccgcggcggtcaacggcgtctcttcgaactcgcggcgaagcagcttgaagagagcgtaggagaggcagagccgcttcagcttcgggttggacaccagcagctggtcactctcggcgagcgaccacactctgcccacggtgacgacggcgtcgtcatcgccggcgactgtcttgcgcaggtcgacgaggtagccgttcggcccggcctccctctgcaggttctcctctcccatgacggcgtacttgcagctcgtcatgagctcgtcgtctcgccgcgggcgccgctcctgctgctccagcgtctgcgccatgtagccggcgagaagctgcggattcttgccgaaggcgaaggagcgcttaacgaactcaccaatcgcgacgcgctgcaccagcttggcagcggcgacgacccagagcgcgccgaacaccgccttccggccggcgccgtggacgttgaagaagacgaggtaaccgaggaaggcgacacggccggcacggctggtggggccgccgccactggcgcccttagtgccggtgaccgtggcctccaccttcttgcggagcagctcgacgagcagcatccatgcgagaatgagccgcgcacgcagaggcagctcggcgtcggtggcgtcgccggcgccggggacgtcgttcttggcctcggagaagaggtaggaggtgacggggaggaagagggcgagggagacggagaggacgaggcgcgcggcggggcgcagcgtggcggcgccggcgaggaggtcgaaggcgaggaggagggcggcgaggaggagcatggtgagggaggtggcgacgatggagacctcgttcttctggtcggcgtaggaggaggtgaggttgtagacgtaggagcccatggcgccgacggcgccgccgcagtgcgcgtccgtcccgttgaagtagtccatcgttgattgcgacgacgagctagcagatatgatgttcttgctcttgcagctaattaaattaatcaatggatgtaaacatggatcgatgcatcaacaacttgttaatggagatcgagctaattgatcgatcgatcaaataatggatgcttttgttcgaattggtaggtaggtgatctagcaagctggctgagcacacacagagagagattcagtctgctttattcgatttttgtatggtgattaggcatttaggcccaggtgaacaagtccctgggctgcggctggattgggctgaattttctaggattctgctacagctgtgctctggctggcagtgggccttgtatatatgcctttgagccagacaaatttgtatacgtgccatcgttagaaacaggcttcgctgaaatgctatcgtaaaaagggattcgctccaatgccactgttaagctgtgggcattcgctacaatgctatttttggtgtttgttgtatttgcaaaatattttttatcgaaataattttttgggacggttttacccctgggcgtggatgtggttaagaccatccacatatgcgtttctcagagcatctccaacagcctctctaaatcggactctccaaacacccatataactagctctccaattgatttgtcaagccaaactcattcctcgctccaacagcctctccatctacactctctattataagcttatgacactgggacccacacgtcagtctctcctacaccatcttcctcctttttctcttcctcttcttctcctctcagcgctcttcccgcacgacggtgagcacgcagaggctggcgacggcggcggcggctctctacgacgacctcgacgacaacccgtggagcggaggtggagggggcaatgctggatggccgatgagggcggccgcgtcggatgcggccagggtcggaggcggctggcgcggaggagacagcgccgacaacaccttgccgctgccactcccttcatgccctcgacgccggtggccgcgagcgggaggccttggcgatgctcgccgtcgtgccgccccaccggcgcttctcctccgcctctcgaccttgcttccgacctccgatcctcaatgttgcacggacgaacagcgggagatggcgaagatgaagggcgagaatactggaagggcggtagcgggtcctcaactctctgtcaccgccgtacgggagctgggatgtgtcgccgccgctgcacagaggggcgtcatcgtcgttctcattgttgcttccgcgctgagcataattaatcgtgtgcagtcaatgagtacatcgtgacaaattgatctttgttttcttcagtgaggtatctgtcagatgctaatggtggtgggttcttgtcctgagtcctgacgtgtatccgaggtaggctccatctcgttgctctgtccccgtccgtcgccaccgctccaaggccgccattcctctaccaggcagagcaacgaaaggaagggacaagctcgagctcaagatctggtggtcgccgactctgttgagctccggtcctcctgctccctctgctctggcgggccgcgcgggccggggaggtgccgcctcaccgacaggcgatggcggaagggggacggtaggggagtcagggagaggagacgccggcaatgcagtggaaggggatggggcggcatcgaagtgtgcagagaaagggatacggggaagagaaacggtgtgggccccacggttggccatccgattttggctggccaagtttggccagcgaggaacccagtctggccagccaaatagcttggagagtgagatagccaatttgttggagtctgttttttatccaaaattgctaaattttagcttggagagtgagatagccatgctgttggagatgctctcacactggcgtctgcgaccacatagagcgagagggagagaagggcgaagacagcgacaccacgccgaccacgtcgacgctgccgcccgacgcacgcgtgcattgccaccgacagccgacgcgcgcgcgccgccgccgccgcccgacgcacgtgcgcgccgctgccttctcccctatccgcgccgccgcaacagcaacaacagtacatgcatgctttggttttgcaacagctgatcttggaaagggggtacgttgaatcccaatctgtagttgtgaggccggtgcatggcttttgggttggaattctctgataccttttcctgcacaagcctcaagtaaagaccgtgaagcggtctttgttgatggagcttctgcgatgctgttaactctttctggagattcctcagagtcggatgatgatgattcttaacgttgagcgctcaaagaagtcactgcttggctgaggaatgatgatgattcttgatggggaaagaatgcggcggcgccagcggctgttgaggagacgacccagaggaatggatgctgggcggggggaggctgcggcgccggcgcggttggggaaagaatgcggcggcgcatatgggggaaaggcagcggtaggccgacagcgcgcgcgtgagtcgggcggcggcgccggcaggctggcagcgctcggtttgagggcagcggcggcggcggcctcgtgcgttgggcggcgccagcgccggcggtggccattctccctctcgctcgatctgttcgcgttggagccacagagagagaaaagcacgactcctaggggcaaaacggtctgagaaaaatatattttgagggaaaatgttttggaaatgcaacaaatagtgaaaatggcattctagcgaacgcccacgggttgacagtggtattcgagcgaatcccatttgaacgatggcattgtagcaaagcctgtttataacgatgacacatatgcaaatttgtatatgtgccatcgttagaaatagacttcgctgaaatgccatcgtaaaaatgggattcgctccgatgccattgttaagctgtggaaattcgctacaatgctatttttggtgtttgttgtatttgtgttgacgcgaaaaacacacactagtctgggagatctgcttagctccagtgcaggtccaaaggttggtgagatgcaggcgtgccagtcagtttgaccctgcaactgacaagatatgcagatagtagatcaatgagacgatcggctgacaagccgatggagtaattccagccgatgccgataccagccgatgtcgatagggttttaagcaatcggctatatgtccaatgtagataatgatataaaggcaatcggctgttgataatatgatataacaataatataatccagtataaaccaatcggctaacaacatgatataatataataagcgctgatccgaaggttgaaatatatatcggctggaggtccgatgtcataaaatccacaagattagataaacagtgaaacctttgttgtcatcggctaaatccaacttatatatatatgcaatccttataagccgatgcaacgtccagataacttatcggctagcaccccaataaaacagtagcatgaacctatcggcttaacaagatttatattatcaataacaatctagtaggtcgaacctaaccgatgcagcacgagatttgtatatgataatctaatactcgataagccgatagatctgtctaatgtgatggatataacaaatctatttagaacagcattgtgattgtagagatatatcggctaagacagaagatcggacctaaccgagatagtcccaactaaaccgatgtgtctctaaacacaatgcaattagagatagaattaagatatcaggtaggcaaatatatcaaccaaaccagagcgatccaagagatcgaagtgatgcagccttaaacaacaccaatgtagccgatagattcaccaggaccggtggaacgtaggacttaccccttcgccggagatcgaaagccgatgcagccccgcgtcaggtgccaagttccgccggatgataagtaaaaacctcggtaaagagggtggcgatgcgccgagagtattattgatcgagagattgattacaatgaccccgggtgtacatatttatacccatgggtagatactagtccttgtaggacaagaaatgaacttttctaaagataaaaagaaaacataaagtccttatcggacactaaacacactttcctaaagataaaaggaaactaacaaattattcctaattaatagataaactgccatgccgcatcctctttgaactcagttgcttatggataagcttcctttagtagattaatttccttaaccgaatatagcaggaatccgactattggcgacttgataactcccatcggctgatttcgagatgctgaagccgatagttactctaagccgatgatgaccttgggcttaccaaattttggcgttaacacatgccccccagttttggagtgtgatgactcatgctccaaaattctgttctgtctgatcttgataactccaaaactgatcttcttttgcttcttgcaatcgactttcatgagctgataccgtctgcattagatgagccaggccatcaaactcgtggcaaaataatctatctctgataggtgctgacaacccttggaatgcaagatctgcgagctgctcatcacttagactcaaacaataacatcggctgtgaacatcacgaaatctttggatatatactatagccgattcttcttcttgctgctgaactgatatcaaatctgaaagcttcatctcattgatgccagcaaaaaagtagtcatgaaattgcttctcaagatcggcccattctccgatagaattcgatagtagtgatgaaaaccatgtgaaggccgatccagtcaaagacaatggaaaaaatctaactttcggagcctcttcagccgatgcctccccacattgtgctaagaattggctgatgtgttcctttgtagatacatcatcttgccctgaaaacatggagaaatctggaatcttgtatcggtgcagaagtggaactctatcgaaccactcaggatatggctgccgatacatatggatctgttccttaggtctcattccaaactgctcctctactaattttgcaattctatcggccaaatcattgttatattgatgcccatattgatgaagttcttctggccgatattgatatggctcatcatgttgatactgatatgtttgccccccgagccgatattgttgttgttctgcaatctgccccccgagctggcttttctgaataattaactcatcaactgttaccttgatcaaactttgtattgtatctgccaaaactccagattgattaaacaatgcgcgcgatgaattgcttcatcaactgtatcttgaagtatttcaactatcggcttggggaatcgagtcttctgagttggcccttctagtgtcatgttgaaacattgaagacaacgcatttgaaaatcaactacaaactgctccatctgttgcctctgttcctccgttaaattctccactgtgaccatgatcttggcattgacttcttcttcagacatgtggatataaaattcgtggtcctaccaggtgtgccaatttgtgttgacgaaaaaatcgaacacgccgccctaggagatctgcttagctccagtgctggtccaaaaggttgatgagatgcggacgtgccagtcagtttgatcctgcaactgacaagatatgcaaacagcagataaaacagccgatcggctgacaagccgatggagtaattccagccgatagccgatattagccgattccaattccagccgatgccgatagggttttgagcaatcagctatatgtagataatgatataaaggcaatcggctgtgaaaaacatacactggcctggaagatctgcttaacttcagtgcaggtccaaaaatcttgcctttaggttcgtgagcgttccagttgatttgatcctgcaatcaacaagaaataaagacaggaaaatcgtggttaaatccataaatgatagccgatcggccagtcgctgatgacatatcatttatcttccagccgatgtcatatttgaatcgattggcaattataaataagcaagacagaactaaatctactcgatcggctgtagatattaacgatatataattcttctgtcgatgtatatttaaatcaagtgattgggatagatcggtcgccatgccgagacagtataaatcacttagatcgaagtatacattaacataaagattataaacgtctatagcatagccgatcagatagatctagtatgtaacggctaatactccaatactactctatattaagatattaaaacagctagaatatatcaaacagaagtctaatatactttattgcaataagatcttaacataaagggcatatttaatatatcaatcaagcatataaggatataaagtagttaaattaggtaagatcggctgaaaccccgatgctatctccctagataaacataaaacaaactagatatcatgattatagatattacttaatagatcaaactcaaccgatgcagcattaagcataaagacaagcgcaagatgtaagcaagatgatgagaatatgtaagagatggtggatacacgatataatctagatcgatagcaaaatataactctaccgattgtttcctaacaacaagaatcagccgataacaagttatatagtgcgattaatagagattataacgcatatatgataactcgacgatttacataaacagaattagagtgttataaagatggaagcactaatcccgagaacgcaagccgccatgacaagtatacctctggttgaagatcaaattgatgcatctcgacccgaaagcaagaactcgtcgaaatagaatgaaagtaaaaagggtggcgatgcgccgaagttgtattgaacgtgtgttgttttttacatggtcctcgggctatatttatacccgagatacatagtatgtccttgccggacacgactcctaactctattacaactctaagacaccacaagtctttacggcagactcttgcccaaacatatctctaaggaaataacataaaatatcctaattaatagatacaattgcctttctgggactcaatccgtgcgtggcaatccatatgaagcaccttgtcttaacccgatgacgtgtaccaagtcatattaccaaaatcggcttaatcggctaaccttgtccaactcaaactctgccgatcttgaccatagccgattcggacttcagccgatccttactctgtttccgaaacaacttatcccttggatttcgcttcgattttatctctagctccgatacttgaattaccaaatttggtcattaacaaacgcatgtgaggactgggtgagagatcttgagttccatcccacatctcacatatatttttgagaaaattccctatgtagcatcagaaaaagttgctcttccctctatagcatctaaacttaaaaaattcactacctagacaccctcaaaatttttcttccctatctggcatttctgttactccggttagcctccaccgtcaaaacaagagacatggacccaccatcaagagaccagcacgggcagccagccccaggcttactcggccctgtagctcttgctctcgtgacccattacagtgctcgaccaagcgcaagaggagagagctcaagtggtgacgcgcgacctcgccggcgccgccaccgctgtgccggctgatgcggtctctgtcaacgctgcctcccacacgtccttgttggagatggagcccaagaagtcacacttcgacagcgcgagccggcagcaggacctcgagctcgtcggccgcctcttgggcgtcctgacggcaacgcggagctggcggggagaggcggcgcggtttaagcggcaatgctaacagcggcgcatgtggtgggcggcgccagcgaggtcgcacgtcgctgctcgcagccatcgcctctgctaccagccgtgacccccgaaccccatcgctgacgatgtgctgtagcgtcgtactcgccaacgacggccactcgtctgcgagagacaagtcgccattgccaacggcgtccgctcgcagctgccgagcctgcaggtgcgccgcctgagccgctgctcgtagtcaccgcctccgctccaagccgccacccccgaaccacgccgccgacgatgtgtcgcggcgccgtcctcgccaacgatggccgctcatctgggagagactagtcaccattgccgccggcctccgctcgcagccaccgagcctgtaggtgcgccgccagcgccgctgctcccaactgccacccccaatccacgccatcgacgatgtgctgcagcgccatccatactaacgacgggcgctcatctgtgagagatgagtccattgtcgccggcctccacttgctgccgccgagcccgcaggtacgctgcctgagctgtcgcccccagccgccaccctcaaaaacttaaaaaagggcaaaaccgtcttttctcctgctagttaacaccgtcaccctcaaaactaacggaagtgccaaacagggaagaaaaattttgagggtgcctagatagggaacttttgaagtttggatgcaatagagggaagagttgctatagagggaagagcaactttttttgatgctagatacggaattttgtctatattttttgacttggtatgcatctttagtcctagttattttaaccgggactatagacatctttaggcctgaattgagtgtcccggtttttttacttgttatgcatctttagggtatagacatctttagtcctagttattttaactggcacacatctttagtcctgtattgagcgtcttggtttttttacttgttatgcatctttagttctggttattttaaccggaactaccggttgcataaccgagactaaaggggttacaaaccaggacaaaagatgggttccccgctagtgcctgaaccttagttagtgcatatcacctgttcattctgtatctgaaagaagatttttgcactgcttacttttatataaaacatgcacgggatatatacatgatttctagtacagaattgaaacttgaaagttaaaaatgagagcatatgttcttcagagacaggctagcagaagtgcgcaagcaagttcgaaggcgtattttacgatgaagcatagaagtagagattagtgaagatggagcgcagagacggaggatcagccttaatttggaaaggaaattaagactgagctagtgatcccttccattttgaaacatatcattattactaaaggaaaggaaagattgagcgtacttgattaccaaaacaaagaaaatcccataaatacgatacccatctcacgccgatcgatcaagcgcagccatgcccgccaactccggtggacggccaacccggcgagcctggccaacctggtgagcccggccaaccaggagggcgcggtcgcggaggccgtggtggccgcggcggcagtggaggcgctggcggccgctttggggctcgccgagatggcgcccgaggagggtggccccggcggtatcggcggcgagggtggccccggaggggatggcggcccccacggtatcggtggcagcggcggggacggtggttgcggcggggtcggcggcctcggcaggaaaggtggccgcgggggtcacggtggccgcggcgggaacggcggcttcggcggtggtgacggcggccgcagtggggacggcggggaaggtagagtaagaggccgcggtggggacggcggagtaaattaaattagcaactttacctgatgagtaatgcatttatattttaaaactatactaggccaaataaagggttgcaaaatcgcctctctattgcaatgatagttgcaatatttttctgcattattaagatttttgagaaacaggagaagaaaataagccaatgttgtatttctgtttctatggttgaaattaaacaagcagcacagcatcaggccaatctatttcttttgtatgttctttctatggcagtaatgagaggagataaaagttaattcagaaatcagaactaattagaagattgccacttgttcaaaaaaaaaagagaagcttttcctatcagtacaggtccaagcatggatagatggctcagtgcatgcacaatgcaatctcaagtggaagtatagattagactatctccaacaggctaggcatagcgacacccaaacccaaaatgcgtgctccaggctactgtagcggaaaaaaacagggtccaacagagtacccatactaaggacctattttaggtgctagccgaggcggaacccaaatatgagtgccctctctcctcgaccgaaacacctggcgcaactgtttcgcgggaggtggagagaagaggaaagcgcacctggccccggcgatagggaaagctccgccgccgacgagatctgctctgagctagacttcgcaggtatggatctctctccaacccaccctccttcatccccggtcccatctctcctctctctggacatggatttggccgcggccgctcgcaccctggccaagggcgcatcgcgccgcatgctgtgcctagccccagcgacgccgctcaaatttttgttgaccgcaccttccccagcatgtttgtgccatgtttgattgaatctctgttgtaataggatgatggataaaagtattggtggctcaagtgctcgcgctggtgaatctgaagaaatatttgggacaaatcagtgggcttttggtttttctgccgctttgcattcttttgatgttcctccgaacccccaggtttattgcagccatgcatatgatgattttctttatttacatatcaatacatcgatgattaacagtccttttcatcactagttcaacatgcatggctcgtcccaaatgtcatgcccacctataaatgagcaacctagccaggggttctccattgacaacaacattggctctgaggaccctccatcattgaaatcacagagggctgcaaagaagaagaaggtgtccaggagaggaactgcattcaccaaagaggaggacatggtggtgtgttcggcatttctgaatattagcaaagacgctattacaggtaatcatttgcaacatcttttatgaattctttgatgcccaaataacatggtggcataacatgcaggtgtgaatcaaacttcaggtggttattacaagaggatgcatgattatttcaatgagcacaaacctgaagggtccaaccgtagccagattgctattcagcacaggtgggcattgattcagaaagcgaaacaagttctgtgggcacaaagcagccgttgataggctaaatgagagcggaaaaaatgagcaggatcgggtatactttcactcatattatcctccatctatctaatttacatatggttactttctaaccggtttaatctatatttatttttgatagaaggtttaatctatattcatatttgcagatagatgatgttgtacaaatgtacgagaagacagaaccttttaccttcatgcattgttggaaactacttcacaacgaggccaaatggaacaataagtttcttgagctaaacaactctacatcacctgatcgaatggaacctccttcaactcaaggccatactgtagccggccatgcagaatctgggaatgagaatatagacacagcacggcctgagggtagggatagtgcgaagaggcgtagatcgaagagctatgcagagacatcatcatctagtacagcagttgaagtcctccagcggttgcaggagaaatcagagaagaccgaactgaagcaagaccagcagatggttgaaatccttagtaggaaggacggaaaaattaaaattcagagggatcttttcaaccttcagaagaagcatatgaagatgagtgtgaagcagcacaagaaggaaaatgagattagggagaagcagactgaggctcaactgatgtcagctgagtctagtattatgtccattgacattgagaaggtccccccttatctgaagaactattatctaggcatgcaacgacaaatcatggagcgcagaggattcagtagtcccttgaacaacggagactaaggagcgtgtgtgttgaatatatgtccaacttggttcgcttgagttgaacttttctattgtgtgcaactttgtactattatctattggagtgatgtgtgtctgttcatgtagtgactattatctattggagtgatgtgtgtctgttcatgtagtgactattatctattggagtgatgtgtgtctgttcatgtagtgacaattgttcatttcagcaacaaaatgtcatatatttcttatcaacaacaaaatgtcatatatttcttaccaacaggcaacaaaatatctttcagccactatagttcatgtgagcagccaacaaaatacaaaggtcttatgagtaggcagcaaaaaaactaagcctacaactaaagactagttcctgtgatttgcagcaaagggaccagagcattggccatatagcatccacatgtgttccatcaagtcattttgaagcaatgctgctgtctctctgtcctgaatgatgttttgagcatcaacaagtttttcaattgccgggatttccctatcctggttaataggtgggtcggacactccaggccattctgatggatggacagtaggtagctgaaccccacgctcatcttcaactaccatgttgtgaagtatgacacaagcacgcatgatggaattaagtacttttggactccataaacgagctggcctatgcaagattttccacttagcctgcaggacaccgaaagctctctccacatcctttctacacgactcctgttgctctgaaaataccttttgtttgttgctaactggcaaagcaatgcttttcactagtgtagcccaatcgggatagatgccatctgctaggtagtatccaagggaatagatgttgtcattgatatggaactcaacagagggtgccctccctttagccacatcatcaaacacattggaacgatgcaaaatgttaatgtcattgtgagaccctggtaaaccaaagtaagcatgccaaatcctaagatcctcggtcgccactacctcaagtattagagttggcttgcctttgtgccctctgtacatgccttgccaaccagtcgggcagctagaccattcccagggattgcaattaagcgttcctttattcccggaaaaccttgggccaaaagnaagctaaaatgggccctatctccccctcctgggagaacaagaaattcttttgcaacaccttgatcattgtcataccaaatccattcaggtcttcagacagtactttctcccattttcaaatgatcatccaactcatcagccggtccaacatatgctagcatctttagagccaccgtgcacttgtgaagagcagagaatcctaactgcccagcagcatttctcctctgtgtgaagaacctgttcttggctgtgacctcatccactattcgaaggaacaattcccgtctcatgcgaaacctacaacccaaaattacagttgtttatcaaattaattcaatatatctgcaagaatagtgagcaatatacaattgatcatgaaaatgttggcatttccttcaacacaaatatttcatgaaaatggaaactgggccaaagattctaccttctcctgaaatgttcttcattgtacagtggacgttcaacgaagtagtcctgattcaattgccagtctgctgcaattcgatcacgcttgtaagtcttgtgaccagggactgaacctccccaagggcgttttcgtggcgtctgggtgaggatgaccactgcggccatgatctcatcgtcctcggagtatgctgcggctgtcccgaacattgacattttgacgtaactccaagccatggccaccacaacggaagtgcaggtctaaagccaagccaatttagggacaaattagccacaaattaaaagggaatgtgacatcgaacaagcaaatgctagaaatcagattacctgtgttctgattgactctgctgcgccaacgttcggccttgtccgaacggtcgctcgccggcggctacctcgctgccactgagactcccttctcacatgcagccggggcggcaaaacaatcctgccatcgagccaaccccacagtcccgcgccccgcgcccggtatatctcgcacgacaccctccgtttcccgcgtaaaaatttcatcgcgggcccgcgaaggaaactgtctgcattgcagggtttccatttgcgttcgctgttggagaaggcaagaaataggtgcatgacccttttgccgcaggcgacgcataccgtccaatgggtctcctgttaagggtattattgttggagatagtattattcagcaatataatgcagaaaaggcgagcagaaacatcatatgtccaaaaactatttgcccaccttgagattaattatgtactgcagagcttcatggtgaaacagttggctgaaagtttgaattatttggcccttttaaatggcattgatttcctataaatgataattaagctaactaacaaaaaaaatatttcctccgttacataatgtaagactttctagcattttctaaattcataaagatgttaataaatctagacacatatacaaaacatatgcattgattaatagatgaatctatttaaaaccaaaatgtcttacaatatgacacgaagggagtatccttttaaagtacatctgcaagacagagatcaggtggtttatctctgtaccaaactacaaatatgtatgatccaaacatatatgtatgatctgcaacatgtactactgagtggttgctttaatttgttaataatatgcctagctaccaccatacaggccacatgtgttttaaatgtttataattcgcaagttctttaaatttgacatttaaatgtgtgaaaataacatatattatataaaattaaatctgttcagttcacaccttgcggccggctgatagtttcacccacaaaaggaaaaagttcactgcttgttttcgatgtaatctaaatactccagacagatagcatgataactcactgctacagaaattattttttcagatgagaccccattagattgcaggcgggccataaataccagcgccagcaaaaatcggtcccctggggggtcagttgatggacaggaaaccggttggtggattgcatgcgataatgcattatcgtatgcggctactacctaagaggatactaattaagaaggaacttaatatcatattcttgcataaagcttgatcaatcatagccgtaaaaatggtgagatagagatacagtgttaagtgcagctctccaatactagctataagcatatgaaagcgagttggtttatcgttgagccatggatgtgcacgttttttcgcttttcgcagaaagagacggagtgtgatcctcttttgtatgttggtccatatacatacattttatttggacgaattttaaagggtgtggagcaccaaagctggtcatataaaggcgtataaagacgagcactgtctgaattcaggatcctaggccggctaaaccgacactaagatactgatccctcggatttttaatgcatgacacatttacttttagagacatgtttgattatttatgttattaatactttctctgatttttaataatgcatgacaccttcaattttgaggacatgcatgtttggtcatttcttatctttttattaatttctctctctaattaggccaaaaatgtcctcagcaaattattagttgtacttgtgtcgtgatacggtttttacgatgtttgtcggcaaattacatgaattttaaatgtcatgtagcaaaattcatcattaataaattatgttatttcattcattttatttattttatcattaaaattactttaaacataacatatatattttacctaaacttttaaataataaaaatggtcagatgtacgttaaaaattaatgacatcacacattaaaacctaaaaaaaggagagtagttaaatgtgggcgcacaaacagtgaacaaatcatgtaaaaaggctatagatatgggaaaagtagtacatgacttgataagatggacataactcgatattacaatctcacacgagcacaaatgacatcaagataattaactaattattgcagacaacataaacaaaagagctttgctagctagcctaaactttagcagacaatgcatgctgcaagccagctactttaatccctttccatagagatcatagatgctctactagtactgtaggataaacatgtcatgagaagataaacagcgattaaattgactaattatttcatcaaccaagctaattaataaaccaagctagtttggcaagcaagcaaattaatttagcaggcggcgctccggaatcgaatggccttgccggggacgtcgtacaccacctcgagcgtgcgctgctgaacgttaccgatgaaccctggcatgcggtcgctggcggtgggcgcgaaggcgaggcagccttggagcaggatccccgccgcgtcgaggttgacggtggccccgccgtcgaacaccagggcgatgctgggcagggtgatgctgcggacgccagaaaagtcgtagcacgtgtcgaggatggacaccggcggcgccggccggtacatggtcatcgcgctcctaaacgccgcgcgcagcgcctggtacgccgtcggcggaatccgcgagatgacggtggcggagtcgatcacagagctggcggagaagacagtgggcggcacggggagcgggcgtcccgccacgatgatggagcggaggagcaccctgtagaacgtcggcgacatggtgctgctgctcagcaacggcgtggagacgaaggtcgggacgagcgcggcgcgctgcggcggcacgccgaacatgatgaacccgaaggagctcgtcgacggcgggacgcagtacgagaacaccctgctgtactgactcgccgtctgctgcacgaaagactgtgagccgccgccgagagccagggttccggcgacgtcgtagctgaaggtgcttccctggtcggcgtgcgcgcagccgaagaggaagcccctgacgacgtcgtaggggcccagtgtgaggtcgtcggagctatacgtcccggtcgccgtcgcgccgttggcgtaggtgatgccgaactggcactgcgagttggccaagcagccgcggcggtaggggccgagccgcgcgcaggcggcggagctgcaagggacggcggcgtacgtggtcgaggtggccgggtcgaacagggggtcccgctgcgggtggcacaccagcagcgggcatggctggcattgcacccatggcacgtcgctgcccgagtcgatgatcaccgtctggctcaccgccgacgtgccatccggtgccgaattagtcgtcgccgtcgttcctaacctcgtcgtctataataacaaatcaatcaacttatatatgtataatagtagagaattgaagtacataaaaatatacgtagtactataaattcattcacatatacaggatgatgagatatttgttatatatatataggagtatcgagcaaggagatggggcttacagttagatggggcttttggccaatgccagcaccagtagcgacctggaggctacttaccacatgagtgtctccaccctcaacaaacttatgtggatccgcgccgtcgccggtgtcgccagcgagcctcttctggatataggcgacgcggagttggtcggcgtcgagcgccttgcccatggaggccacatcgtcgtcggtggtgctgttgtccgtgtccgaatacgccggcgagcatggcccggtgcccaagtgctgttaaccgacggttcgttacttggagcaactgtgcatatgacactagtccgttcgtcagaggtttaaaaaaccttcttatgaaaaactactccagtatgatgtgtagacggttaagatatttaattatttcattagaaaagacatatatatatatatatatagtagctctaatctacacccctctcttagaataactattctacacccctctcgcatcacggcatcacccaacccactcctccctcccgtgggcctcctcccgcgcgccgcccctcccctcttcctcccgcacgcgtcgcgtccctccccctcctcatttttctgtcgagctcccctcccagcgccttccccctctcgatcccctcctcctcctggcgcctccctccctccctctctctttctgttccctcctccccctccgtgtctctctctctctctcactcccgttccttcttttcttttttttttctatttttccaccaggatcgatcccttctctcttccttcttttctttttttttcctcctatttttccaccgggacctcctcccggcgcttgatcgatctcttctttttttatctcatattttccctcctcccaaggtctattctctttcccttcctttgcttcaccttaaaaagaaaactaaaaattaaaatagcaaaatcaagacttgaacacatgaccccatagtttataataagctctcctaaccaatttacccaataacactatgtgattaggggttatcgcttgcttgctttctacctctatataaattttatgagaacaaaccagttatattactataggaatcgtaccttgttactatgatttggtagtaatattatcgcagaagtgcagtaacacggtacgttactgcgaaatttataggttattactgcgaaatttataggttgttactgcggtttttacagtaacatcatgatgaaactgtagtaacagagaacatatgttattaatggtactactacaataccactacttgtgcatagctaaattattaaatctcaatcttgtgcaaaatacaagtgctaaaaatacatgtgcatatgcatagtcacaagttaacacaaagtgctaaaagtacttttcttcgttcatataaagatacatagtagcaagcttagtacaagtaaactattataatctaatctttaaacaataatacaatagtcttgttactacacgataatcgagacaacatgcttaacgaaactagatccatcatgactattttataacgttgttactgcggaaagtagccgtgttactatatattgactgtcgcgttattacgccgttccagcgagacgagaactaaaaaaaaagtaaatatcaatctttagagagcaatatctctcactttatatattatttttctaatccgtctgcaccataatattcgtaaaaaagtgctcaacaaaactagatccatcatgactattttttgatgtcgttactgtgagaaagttgtcctgttactgcacgatgaccgttccgttactgcagaattcctgtgagacgaggacaacacagtggtgggcgggggagggagtcaatggacgggtttgaccggcgggagggggctttgaccagcctttgactgaggtgggaggggggatttgggccctatgaagggtgggggaggtgggattggcccatgggagaggggggggtgtagaatagttattctagaggaggggtgcagaatagattcactatatatatatatatatatatatatatatatatatatatatatatatatatagacacacacacactatatactatatgtttattatgagaactttgaaaaattaatatttaagatgctctcaggaacaggaatttgtacaaaaatttgcacatttcagcttcatcatatatacttcctcagtttttaatagatgacgccgttgactttttctcacatgtttgaccattcgtcttattcaaatttttttttgcaaatatataagatataaatcacacttaaaatactatgagtaataaaacaactcataacaaaataaattataattacgtaaattttttaaataagatgaatggtcaaacatgtgagaaaaagtcaacggcgtcatctattaaaaaatggaggtagtatatagaagaaattatacccttgtggccagagcaggaagcttttggtttcatggagctggttgctatgaccatataggcgccgggttcagcgtctccgccatgagcaacaagattaatggagctagagaggacgaaaagcacaaccagtgctgctacaaacggggtcatggtcactatgactagatgtgcttgccgatagctaagctgttgatggctactgcctgccttgcattgcggatgtggaggctgcacgtgttatatagggcatatacgtacggatgcgggtttgaacagtacttgacagcacaggttatatatacagaataatatatgtatataatgcccctcgcttcttaaaatgccaactaattaaatacttatgtgaaaaaaaatgctgaaacattgatgtcataaaaatatataccgcatgtctcgcaatattattattcctagtatataaccataaactcgatttaatttatcttatgtatcgactaaaaagcatttgcagttggacttgacgtttctttttttaaagcaaatattatcttacatgtttattattattttaaatgaaatgaatttgaaaaactctttgttctgattccgatccataggtataattgtactttacatgtacaacatactcactactttttcaaaaaaagatttttcctgacacatatgttttacattttcaggcaaattaaaaaaaatcccgcttgtgaaaataagaagaagcaccatagatctagccccgtctgtaaaaatcaatttttacatgcgaaaatacctttatttccataggaggacctctttaagtccctttttttacaggcgggacataaagaggtccgctcgcaaaaaaggtagtagcgctattaaagccacgtggcacaactgagctcgagctagctctttctcatgtctctggtcctccctctctccctccatcactctcagccaaggagcaaagggtgttggcagtgggggcgagggcagtagaaggggcggtaaggcggctcgggacaagcgcagcacggtggagggaggagaggggacaggagcacggctcggcggtggcaatcgcttctccctcttggctcgacggagacggcggcgaagggaatagtggagggtcttggcgtgggcgatggtgtagtggagggagaggtggctcggtccagatctgctaacttctccgctcccctcccttctctctcttctcctagatccggcgtggcttggacgacaatcgagctcaggcgaggcggagaggcggatcctcctacgacgagcccaggagtggcgaacctaccgctagcaagcttcggcttggcgacggcaaggacgaccacggctagggcttcatctcggcaacggcaatgcggtgaggtagcttctacctggcaacggcgacgacgactgtggcgagctcgtttgattggttttttttgctgtgaaattgagctgaaaaatcgattttggtttggattcagttttgtttgcaaaattttaggctggattgtacgattggccaaggattttagcggtcagccgagattgaaatattttttgtagtcggacaatataacttagccgcctgcgaaccaccaacgaaaatctatttccgtaggcggctaatctccgcttgtaaaaatactctattttcactgacctttagttgcaagtggcgcggtcagccaccagcgaaaatcgattttgaccgcctgtgattaccctttttctagtagtgacttatcaaatcaaattgaatttgtgatacaactcttagcatatgttttcgtagaaacagtcatattttgtatgtaataattttctagaattatttggactaatatattgtcgacgttgtagatcctgactacgatggtgctggggtatacacgagatcgaggtaaaaaagacagagacaaggattttatactggttcaggcaagaagccttacattcagtttatatgtaattatgagaataggtagcaattacaaaggagaacaactgagtcacggaataccgacgaactcccgtcaagatcagtctgacgagaccaatcggtgatatggctgtgggtcctccagattgctttggctatggcgagatcaaagatagcgctagatccatcttgtcggcctccaatagcactagacggggtctgtttaggtttatctctaatgtcgatatcttgcggcgagtgttgatctctctatgttcgctcccctctctcctcctaaggggctttatatttatacccacagatatccctttgtctaagtaggactacggagacaagtatggatacgatccgaatagttcatgtggaactctgcttctccctccttatccgaactccttctatatacgaggtaaggttccgtataaaaaatggtatatggtgggtcccatcgagcttaattgactagtattgggtatgtgttctctataaccctgacatatataacttgtaacttctgtagatacaatcattttttttagacaactaaaaaaccgacatacaccactataattttgatctactacaagggaatggtcggtgtatttcctttttctattaaaatgttaatttcaaagccttagaaaaaacacggtggtggctttttttcaagctattttgataatacaaattaaatactttccctgcatgcatttgtatggaattataacttgcaaaatacaggtcatgcatgcaactttttcagtaaattgtgcttgtaacatcattattgtaccacggttggatgggactccagaggagcaaagctcatgccgtgttggcatttgcaaaaaaaaaaaaaaagaataagaaaagaaaagaaaaagatctcctgggaagaacatattcatagttttgtttctgtttacgtacaaaacatgaagtcatccaaaaaaacacgccggaactaagaatatcattaagaatatccaaaaaaagactcagtgagagcgatgccaagatgtgtgattgtccgtcttcgccatgtttattgtctcacgtatgcaaagtataaactggttacaagtacccggtccttattagctaaagtataaaagaacatggtaattattgcaatttgcaagcaccacatgcacagccttgggagtcggcaatctattcagaacaagacatcgatacaaattaagctaccaagtacgaactgatcctatttaattacctatatatatccttttcgcaagcaaaattaagcaccaccccggtggcttcaccactgaccatataagttaaaatgaatcctcatgaggccccttcatcactactcccaacctccaatgacagctttggaagtagggatgaaaacggagcggatacggacggataatgctcataccgtattcgttttcatattttttactggatacagaaacgaatacggatagctcgaatacggaaacaaatacggattatctcgaatacgaataagaatcgaatatgaccggacacgaatacggaaacaattttttctcggaacacgaaaaccaagttaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccgaatagcactgttcactggatatccgaattattatccgtatctgacggaaatcccgataccatattcgtatacgtatccggcaaaaaatatccgtatcagaactatccgagaattatccgatctgaaaggtatccgtattcgtttttcgccggagcggacggaaactatccgctccgttttcatccctatttggaagttcccaaatgactgcatgggaccactttacctcgttctcttagagcaagtttaatggtatagctaactattgactattagtctatattatagctaacttgg

SEQ ID NO: 13118 - DNA, 3475 bp, Oryza sativa
tttaatagtatagctaattattggcttttagtctatactatagctaacttgtataatagattaactataaggttagctctatttttttattctctttctttctcttattcataatgtaaatattttggaacatgtgtatagctagctcttgcatgagaaccaacacccctcacttttctttatctctctcttccacgtaagattatagttgacatatagctcactattatccttgctctaaattgcatccacacatctctcactatgaatttaatgtaaatatcttgggacatgtgtatagctagcttttgcatgagagccaacatccctcacttttctttatctctctctttcacgtaaacttatagttggcatatagctcactattatcgatccttgctcttagttgtactaattggttcaattttcgagttgttatactaaattgcatcaacgtatcgatcaaacctgcagtgagctattgatgtagattatagtttttttatacaattattagtgtgcggtattttctctctctaaccttttagtccatgaaatactttttttcaatcgcagactcaacttttcataactaagatccagactagactagctagcatcatcaacagcgcggtgagtttactagccattatgcatctgaaaaaataaccactagcggcaggagggaggcaagcctagagtagttagggcttgagctctaggcttctccaaaattataagtaaattaccatgtaattttagagaaaataaataattcattagttgagtcctagctaggttagtcctagtgtttagtaattatttctggttttgccactaaccaccaggctttagtaaatattgtagacgttgtgagctgtatagctgtcgtgacgttaattctgtgggtcaaaattcactcgctgacatattgaaaggtagatccggctccttgtgtactccctccgtctcaaaaaaagaaaccctggttttcgtgtccaatgtttgaccgttcgtcttatttgaaaaaattacgaaaaaaattaaaaagacaagtcacgtataaaatattaatcatgttttatcatctagcaacaatgaaaatacgaattataaaaaaatttcatataagacggacagttaaagttggacacgaaaatctatggtttgccttttttttgggacggagggagtatgttaacatatattggcaaatgtggtgtagcagaaaggaacacctggccagctgcccagctcaaaaggagctagctaggatacagaacggatccgttgtcaagctttggggttaggaccattaattatattggttccttttctatcttttccgaagcatcttacaaactttaatttactttgtgtacaccttaattaaaagcttccatccgctttggatcttcaccatctgatcttgtgaaataagagattttgccactaagcaatgattgtaccatctcactttttctagttctggataaaccaataattcagagtttccgataattttgttcatctcaactcacaatatataatcaactaagacaacatgcaatgcacaatcacacgaaagtgcattatatattcatctcggtcaatttgttcacaggaatccacattgtttcttctatgccctagctacctatattaagcgcttcagtcctaaggacttctttgtttggtggcatatgtaccaatggtatatttcaacctaaatggtttttgcggttgcttttgttgatgagttccatggtttctccccctatgaaacgtagactcccagcccatcccatagcttccgaggtatctagctaattaagagaacttcaaagggaaatttaactattggccactattaggtttgccaattatctaaatacccttattagatttgtccttattttttttacccctctaaagtggtggcatcttaactatttgtcacttttgcccatgtggtatgccaacatagcaacacagtgtaaaaatcgacgtgggacccacttgtcagtctcacagctctccccttcctctctctccggtctggctagccccgtcggctgctcctctctttcccgcggcgaaccatgtcggtggtggcggcggcgtgccggctcgtggctgcggagaaggagggggagccgagcgccaccgggagtccgacctcggcagttgcgagtgaactagctagatggattttcgcttgtgaacccactgctctatgataatgtgttagtaaactatatatcttcagtctgtgcaatctttgatcgcacttgcactatattgtgtttctctgtaatgttcttgtctgcttatctttgatcaaatagtcgatagaaatgttcatgtataacccacctttttctgagtttttttcctccttcaaaaaagcggttgcaagtttactgccgaggaagagagggtggtgatcgagttgcaggcgcaattcgggaacaagtgggcgaggatcgcgacctacttgcagggcaggacggacaacgacatgaagaatttctggaccgctcggcagaagcggctcgccaggctcctgcgcgggcctctccctgctgcacgatcaacagaacagcggcaagggcaaagcgtcttcttcatcttctctcgcggctcacctgaagcatctaggcccccgattgttgattttggtaattaatgacaagcattatttgtggactaacaatttccttgagttatattttttaagttaggttcccatattgtgtgcacatggatgattacggtggattaaattggatggcgcaaagctaaaagatcgaagacggtaaactagaggccttaaattttaaattgatcaaggagattgggcgatcaaattttgctagtttatttatagctttgtcgtactatcaagaggggttatgacctaaacaaagagatgatcaaaatgccacattaggtcatattgcatttggcacactttattttatcaaaaaccctgagtttccgcctgggccggtctgaccgggcgtgtaccgccggtctgactgcaggcatggcgccgatttgaccggccaggtagcccggtctgactggccggctggatgccagttgggcgcctctggatggccgatccagagccgccagagacgcagccggtcagaccgagccgatggcggtctgaccgagccgtggccggtttgaccggcaactctgctgcggtctgaccagccatgtgtgtcaggtgtattaaatgcacggcaacggctagttttctagccgttgcagagtagtccggtctgaccagccactatatgggggtctgatcggcactgcagtgaggttggggatttcgaccccaacggctagtttttgtgggttgggctatataaatccccccaccagcagcaagggatctctcttggcacttgcttcacttgcatacatcccttgcacactctctcacacactctagagcttg

SEQ ID NO: 13119 - DNA, 3686 bp, Oryza sativa
ctcgtctcaacagggacgtaggaaaccggcaagtttccgaacctcggtgaaaaattctgtctcttgtctcatttatttattgcatttacatttgtacaatttactttattagagacatatttgaaccacttgcaccctaggattgcaaaacttaacttagttgcttagttagacttgtcccttaccaagactagcaacttaggttatttttgattagatgttaatttttataatcgcctatttacccccctctagtcaacatcgttgatcctacaagtggtatcagagcttggtctctcttgattgggctttaccgcctagagagaagatgtcgaacgaggtgaaccatgtaggaaaggctcccatgtttagtgacacaaattattctacttggaaaattaaaatgtctactcacctcaaggctacgagcttccatatttggagcattgtggatgtaggttttgttatcacgggaagccccttgatggaggttgatcatcgcaaccttctactcaatgctcaagcaatgaatgccttgttcaactcattgagccaagacgaatttgatagagtgagcaaccttgagacgacttatgagatatggaacaagttgagtgagatacatgagggcactagtgagtacaaggatgcaaagctccatttcctcaagatccaatatgagacctttgccatgttgccggatgagagcgtcaatgatatgtatgggaggctaaatgtgatagttaatgatctcaagggtcttggggccatctacaccgaccttgaggtggctcaaaagatgcttagagccttaccggacaagtataagaaccttgtcaccttcctcatcaactcggacatgtcaaggatgacacccgctagtcttttgggcaagatcaacaccaatgacatgtacaagttgaagaagaaggagatggaaaaagcatcaccatccaagaagactagcattgcccttcaaaccgaggtggaagacaagggaaagggcaaggtaaatgaaggcaaggatgacttggatgaagagattgctcttcttactagaaggttcaatgacctcttgggaagaaggaaagagagaggaagagggtcaaacaccaatagaagaaggaatagaagacccaacaagactctctccaacttgagatgctttgagtgtggcgagaaggggtactttgcttccaagtgtccttccaagggtgatgatgaggacaagtcatcaaagaagaacaagagtggtggatacaagctcatgaagaagctcaagaaggagggcaagaagatcgaggctttcattggtcaatgggactcaagtgttgagagcttcgattctcaatccgggtccgacaacgagagtgatgatgatggaagctccaagaagaagaacatggccggagtagctatcaaggaggctccatcactattctctccattttgcctcatgccaagaggctccaccaaggtaacatcaagtagtgatagtgaaagtgatgatgatgttgatgatatttcctatgatgagcttgtgagtatgtttgaggagctccatgcttatagtgagaaagagattgccaagtacaaggctctaaagaaagatcatgcttctttggaaaccttgtatgaggagctaaagacttctcgtgagagactcaccatttctcatgagaagcttaaggaagctcatgacactctccttaccactacccaacatggagctcacattgatgtttgcatatcttgtcatttgcttgatgatagtgcttcttgtcatgctatatattttgcatcatctagcatatctacttcatgtgatgatcttatggatatgcctagctctagctctgtgcttctatttgtgatgtttcacttgtggttgtgaacaatgagctcaaggagcaagtggccaagctcaacaagagtttggaaaggtgcttcaagggtaagaccactcttgacaaaatcttgagtgagcaacagtgcatccttaacaaggagggacatggattcattccaaagaagggtaaaaaaaccttctcaccatgctcctcgttttgttaagagcaatggtaagtattgccataagtgtcgtggggttggacatatggcaaatgcttgcaccggtggtaagccttctaagacttgcatgtttgattctcactacatgcttaggaaggttcatgatggtcgcattgttgctagatatgtgggttcccctatacttggtggtaaaaagaattccatttgggtctccaaagctttggtctctaacctccaaggacccaaacaagtttgggtatttaaaagagcttgatcttcttttataggtgaactactacaccggtggaagccattgggtgcttgatagtgggtgcacccaacacaagaccggtgatagaaagatgttcaccacatttgaagtaggaggcaaagatcaagagagagtcacttttggtgataatagcaaaggaaaggtaattgggttaggtaaagatgctatcaccaatgatctatcaattacaaatgtctatcttgttgaaccactaaatttcaatttgttttccgttgcacaaatttgtgatcttggtttgtcatgtactttcaaccctcaagatgtgattgtttctagtcttcatgacaaatcttgcatcttcaaagattttcgttataaatatctttatttggttgatttcaactcaagtgaagcaaatttgaaagcttgtttggttgcgaaaatttctttgggttggctttggcataggaggctagcccatgttggtatgcatcaattgagcaaacttttaaaacatgatctagttgtgggcttgaaaatgtgaagtttgaaaaagacaaactttgtagtgcttgccaagccagcaagcaagttgcatgctctcatccttccaaaagcattatgtccacatctagaccattggagctcttacatatggatttgtttggcccaacaacctataagagcatcggtggaaatagtcattgccttgtcattgttgatgattattctcgttatacttggatgttctttttgcatgacaagtctattattgccgagcttttcaaaaagtttgcaaaaagggcccaaaataaatttaattgcactcttgtgaaaataagaagtaacaattgttcggaatttaaaaataccaatatcgaggactattgtgatgatcttggtattaagcatgagcttttcgctacatactcacctcaccaaaatggtgtagtggagaggaaaaattgcacattgattgagatggcaaggactatgctagatgaatatggagcttccgattccttttgggtggaagccataatgtaacagccctggacccgaaaacggtattgtgtccatcatctcatttagttggaccacacctacactgcaacacaccgcatttttcgtactcgcttgtagcgcccgttccgtcgtggcgcctagcgggaaaattatctcttaaaaaccctaattgcgaaatttgtttctttgattgttgtctagtgtccgtgccatctcaagatctcaatccccgatctatcgtcgagttcaattccgaatcaaatccctccgcaaaagtttagtttgcctccccggggttcgatgggccgaattccgctcggcccatctctctcccgggctctctctctctctcccc

SEQ ID NO: 13120 - DNA, 2891 bp, Oryza sativa
ttgccgccccctataaaccccagcccccccctttttcctttcctctcccattcacctccgcgccattaccgcccctctgttcgccgtcgccgttcgtcgttgcgcgtgtcggaagagccggcacgagcaaggacgcggaaggggacttcggccgcgccctctccttcctcttccccggcccgaggccggagagattactcccgcgccgtcggcctctcgtcacagcgcccctcctcttctcggtgatgtctctctccgttctccctcctcgctccgtctcctcccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtagcttcatcgccgttttccccttctcccgccgccggttgccgccgccgcaatccgccgccgtcgagcaacccccggcaaatccgagccgttggctcgtctcccctcgtcccgtgcaaccgcccggtgtgctcgctcttgcccgtatcaccgtggttcgctccgacgctcgccgccgccgcccgccgtccattcgcggccgggtcgtcgtctacctcccgccagcccacgtggccgccacgtaggcgccacgtcggcgccagctcagcctagaccgggtcgagccgaccccggtcggtccctccccgtgcgcgcgttccacctcgagccgtgaggctgcgcgtgggcccgtcgcatccgcgtccaccgcaaaccgcgcgcgtgcaccgcgttcctccccgcccgcgcgcgtgcgccgcgtgctccctccgcacggtgagccgagccgctgacaagcgggtcccacccgggaccgcgcgtggtgagcccggtccaccggactctctctcctccctcccgcgcgcgcgcgcttgggccgtcttgggccggccggcccgttaagctcggccgagccaccccaaatctcttgggccgcaccctagccgcccgagaaaagtctatattccctccctcccttctttctttttctttttccaaaaaggatttaattaaatcctttttcctttagaccaaaaatccgataatcttagaaattcaatatcttcccaaccgtaactccgtttgactccgttcaacttccaaaattcttcaaatctcgagatctatctagtggcacgcttagaggtcattaatagggctttattttcgctgtatgttgagttgtcccgtttcgcgtgtagtttcggagcccgaagacccgcagtgcgaggatttcgaggatcaagctcccgatctcgagcaaggcaagccacctttgaacatcttgagcctatatttgaaatttaattatgttgcttgcaaaatattatgcattgataggatcacacttaatctgttgtcccgtctgcaaggcagattggcggactcacctaatttgtcgcatttgatccttccattgttaattgctataccatgtccccttgtaaccacccagttgcgcctcgatactcgtgcactctgtgcgagtatcgacggtcgccttcaaacttaaaatctgagtaacaacttgggtaaaactggagttttaaaaagagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtaggggaggacccctgggcttcctggcacagtatggtctgggacctaacctgttgttggtctgggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgactactgcttgtgaaattgctgtagtgaaactgggttcgatgtttggaaaacctgcagctgatgggatcagctaggcccgggtggccgtttaaaaagttgctggcccgggtggccgtttgaaaagtgttggcccgggtggccgtttaaaaagcttttggccgggtgccaatcttgttcaaatctaaagactgatacattgcacatactctgaccggacgagacgcactgtctcatctgtgtcgtttgagaagcactcacttagttgcttttagaaaagagttcaaacaaaatcaattgcaaaaacatcagccattccttgaagcctgcattaaacacttatttcccctggcttgctgagtactcccgtactcacccttgctctatataaatatccccccagttgctgaagaagatgaagcgaatcctgctaatgaggagttcttccaggagcaaaccggctacgatgagttttagggtttcggcctagttcccaagtcgcgcctacttctactgtgatattctgtctccctgtgataccagcactgtttcctgggactggtatcgattaacaggttaatttggagcggttcttccaggagcaaggagcaaaccggctacgatgagttttagggtttcggccta

SEQ ID NO: 13121 - DNA, 2111 bp, Oryza sativa
cttgatgagcgccatgaagaacatgtctattggagacatcaagcccgttgaagtggaagacaagccttccacctctactcaagttgagcaaactacttccgctacgccaagccaagctcaagttgacgtggaggatgaaaaggcacaagatccacctatgccaccaagaattcacaacgctctctctaaggaacacccaattgatcaagtcttgggtgatattagtaagggtgttcaaactcgatctcgtgtctcttcgatttgtgagcattactcttttgtttcttgtcttgagccaaaacatataaatgaagcccttggtgatccggattggataaatactatgcatgaagagctcaacaactttgcaagaaacaaggtgtgtactttggttgaaagacgtagaaaccacaatgtcataaggataaagtgggtttttaggaacaagcaagatgagaacgggttggtggtaaggaaaaaggcaagattggtggctcaaagtttcacacaagttgaaggtttggattttggtgaaacctttgcccccgtggcaaggcttgaagccattcgcatcctacttgcatttgcatcatgctttgatataaagctttttcatatggatgtgaaaagtgcttttctaaatggtgaaattgccgaacttgtctttgttgaacaaccacccggttttgaagatcctaaaaatcctaaccatgtttacaaactctcaaaagctctctatggcttgaaacaagctcctagagcttgagagattttcttttatcatagggtttcaaaattggcaaagttgacacaactcttttcactaaaatcattggtgatgatttctttatgtgtcaaatttatgttgatgatatcatattcggttctactaatgaggtgttttgcaaggaatttggtgatatgatgtctagggaatttaagatgtccatgattggagagttgagcttcttccttggacttcaaatcaatcaactcaaggatgggacctttgtgagccaaaccaatcaaggacctactcaagaggtttgtcttggaggatgcaaagcccatcaagactccatggcaaccaatagccacctcgaccatgacgagggagataaaccggtagatttaaagctttatcgttctgtgattgatagcttgctttatcttaccgcatctaggccggatatcatgtttagtatttgcatgtgtgcacggtttcaagccacccccaaggagtgtcacttaatggccgtgaaaaggattctaagatatttaaagaattcctcaactattggcttgtggtacccaaaaggttctaagttcaagctagtcggctattccgattcggattatgtcggttgtaaagtggataacaagagcactttcggtagttgccaattgcttagtagatctcttctcgatcctaatcatcttctgctgcttctccattctttcttctctgtggcgtcaagcactgtcccttctgacgatgtcaaccccttcgcggcaggctctgtggccatctcggcggcgacggcgcaactcatcaacatcaagtcccacgttcccgtgatccttgatctcggcgactccaacgtcggcacctggcgcaccttcttcaccattgctttccgcaagttcggcctcctcgatcacatcgacgacacgaccgacgcccgcctgtaagccagcgccgacacctgtggacacgaaggccaaggtctccagtacgacagggcagccctacagtgatccgacgttctatcgtagcatcgtcggggcactccaggacctcacgctcagacggccggatttgtcttacgctgtgcaacaggtctgccttcacatgcactcgctgcgggacgtgcactggtgttgatgcgaaaacacgaggcctgggagatctgcttaactccagtgcaggtccaaaaatcttgcctttgaggttcgtgagcgtgccaattgatttgatcctgcaatcaacaagaaataaagacaaggaaaccgcagttaaatccataaacgatagccgatcggccagctaccgatgacatatcatttatctgagagccgatgtcatatgtgaatcgatcggcagttggctg

SEQ ID NO: 13122 - DNA, 2791 bp, Oryza sativa
tagccgatcagatagatctagcgtgtatcggctaatactccgataccactctatatcaagatattaaagcaagtaaaatatatcaaacataaagcttaatacacctaaatgcaataggatcttaacataaagggcggatctagcatatcaattaagcatataaaacataaagctaaatcaggtaagattggctgaaactccgatgctaccctaatcggaaaccaagaagcaggctagagattatagttctaagcacgacttatgaggtcaaacctaactgatgcagccataagtatgaaaagaaagacaatatctagacaatcaagccattgggagcttcatagagtggtagatattctatataatctaagtcaacgttggtatttaacctaatcggctgccttctagtgatagatgttagccgactgaaggttagataacaatattgccgaagattatatagaatatatgataactcgacaacttacagagacaagattagagtatcataatgatggaagcactaatcccgagaacgcaagccgccataacaagtcgtacctctagttgaagatcgaaaccgatgcagctcaacccgaaagcaagaactagtcgaaagcaaaacaaaagtaaagggtggcaatgcgccgagattgttgttgaacatgtgttaattgaatacatggggttcggggtctatttatacccgagattacaaaatatgtccatatcggacacgactgttatctctaaccaactctaagataccataagtctttgcagcagacttttgcccaaacttatctctaaggaaattatataaaatatcctaattaatagatacaattgcctattcaggactcaatccgagtgtggcaatccgtgtgaagcacattaactcaacccgatgacacacaccgagtcgtattgtcggaatcggcttaatcggctaccttgtccgactcgaactcagctgtctttgatcgtagccgatttggatttcagccgaatcttgctctgtttccgaaacgatctttgtcttcgattccgcatcgatctaatcttcttcttcgatactcagattaccaaatttggttgttaacaattggacacttgtcaagcggatcctccgttatgttcgtggcacgacgcacaaaggtctgcaactccggcgttcttctacaccgtcgctcaccgcgtactccgacgcggactgggccggctgccccgacacaggccgctcgacgtccggcttttgcgtcttcttcggcgactctttggtgtcgtggtcctccaaacgacagtccgtcgtgtctcgctccagtgccgaggttgagtaccggggtgtggcgaacgcgactactgaatgttgttggctccgtcaccttctcgacgaacttcacatcaagctcgacaaagccacgcttgtgtactgcgacaatatctccgccgtttacctgtccaagaatccagttcatcatggtcatgctaaacatgtggagctggatgtacacttcgtccgggaaaaggtggctgttggggacatccgcgtcgtgcacattccgactcgacaacagctcgccaatatcatgacgaagggattgcccacagcgctgtttgaagatttccgatacagtttgtgcatcgtcgacgacgcaccaaccgccggggggggggggggtgtcaagatggctgatcatgtagataaggataggctagattacagtttctttttgacctattcttccgccgtgctcagtctacgatccattttatcaggattccgttggcactcttgagctgcaccggcatgtatatatgtatactggatgtgatcaatacacctgtgcgttgcaactcaaactctttcaagattgatgtacctcatgggcgtcatcggtgcactcggcgtcaaaatcgtccttggcagggcacctagtgctagtggtgactggtgaggctggcaggcgaagatcagccgtggagagagagacgcaagtggccgaaggcggagaccgcacagaccggggtgggaaggcctccatgctgccggatccggcgatctcaagcatcctcgacagcggatcgcctccgccaccctgtagcgagcactccctccatggccaccgcgctcctagatcggccgcctggacccgctctcgatcacgttgctgccaccaacagctctgcaccaccaccgcctgggcctccaccagcggcccgccgatccgccgccggtgcatgctatttcgctcaagatgcggatgtggtgcggtggttgttcgctctttggtcaatccggcaaaatatataggatcatggtggatgggtttcctctttgatttgttacgttacatatctatataaatatttagtttataatagggacgcctaatttattggcaagagcggaaatttttgaattggcatattttggtagtgatcaatttatgtttagttaaacttgaagttgacactttatgcatagttgtagtacgtgtacacgtatttgtaagtatgtctagattttttttttatttgttagctggtgtgtgtggtaactgagagtgcactcaaaacttgtgggtacaatacatgtttttttttttttagaaaaagactagcggcccggcttatattgaaagcgcgcgcgcggggggggggggtgggggaggtgttgttttggggacatcccaaacacaaagtttacaacgcaggaggcatagcctcactaaaacaaaagatgtgtacaatacatgttatcgggttaaatgtggcaacaaatcaaaaa

SEQ ID NO: 13123 - DNA, 7226 bp, Oryza sativa
cagttatcatccacctctgctctgctcattctctatccattgctttgcatgttgcgttgctttgaatttattctgggatatgcatcaatgtttgattattcatcaccttcatcttgtgccaccactattctccatcatcttcagactgttgtcctgagtcttgctttgtccaatgcacatgtggcttgttggtgattgattggttgtgccaccaggcacatcaattgttgctactgctgtggtatatcaatatccatgtgtcttttgctactaaattagtatcatttacaaatcaatttcctatgttatccattgaatccagcaaattccattgcatatccttcattttgtcaaagttgtgccagtccatctcttcattgtcatttcatcatgactagctccacagagttggccttcatcatatcaccagctccccatcggagttgatatcaacatcaatcaatgaaggaccgaagaacaatttgtgaaggtccttcatcatcaccatcgtcatcgtcatcaaatatgtggagatccgaagaacagtttgtgaagggccctccatcatcatccacgtctctgaatcaatgaagagccgaagaacggtttgtaaaggctttaaggtactgagaactgaagaacagtttttgaaggctccgaggtccacttcattgaggaagagatacatcttttcttcttcatcatccaagaattgacacacttcgacgacatcatcaagactttggagatagaccaatatttagcttgtgttctcatatttattttacactccaaatgcaatgtgtatacacattgcatttgagtgggggtgttaagatattaggggtagtttagtattttcgcatcacttgtatacatttatatttgccctttagggttagatcaatgttactgttgaatccccaaattcttctcctaaagtcacaatggccagcaccaccgttgccgccaccgtcgtcgcgagcaccgcggtcaccgcgtacctcgccacgcccagccacggcaacttggtgcgcttgccgtcgccacccatggtctgcactgtacactgtcaagcacacgcatcgcctatacttgtcgctagctttatatatgtgcaacacgttgatgcaatcgccaaatcgccattgtcaccgctatgtcatctctccaatgttcgatctctgcaggaggaagaacttgttctgctcacatgtcgtttctgtgactgtgatcgaattgacagtccacccactaatgcaatctgctaatcacgagctgtttctgcatgcaagaacttattctgctcacatacattgatttctcagcttaggatcagagtattggtcattactccacctcatggtcctaatcgaaattatacgcactgctaatatacagtaatggctttattcgttgtcgctttcatcgggagaggtccaaattttaaaagaaactccactactctttgagtcccactccgatatgctctctactggtagtagaaaataatctgaaccattaatttcatttgatcgaatggttcatatttatttctactaccacctcacttaatggtagttgaatcatagaagggtattattgtccagggaaaattatttacagaggggtataatcatcttttagactcactaacccaagctgccctctctcctcgcactcgccaccttagccgccctcgatgactcgtccgccctcgccgccttcgtctcactcgcctcttccgacgcctgcactgccgcctccaccaccgtccccgtcgagcattttgtttgcatcgtttctgacatacgaagctgcttgcatgccattgaaattgaacaggctaagggagagcttgctgaagaaaattgacagcagcaaaacctgacaacccattcattgcttagccctaactttctatctaaaatatagtatggtttgtactgtatcactgtcagtgcatttagcaaccatcgagcaagtctacagtaaaacgatctattatattattaaagaaatagaaaaaggagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaagaacctccaagttcgctctcatggtctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatactattatatgagagaaaatataatgatgctagccgcgcaatctgcgcgggccactatgcttgttttgctatataagagtatacaagggtgggatttcacttaaatatataagagtggcagcttagcagattgggatttcacttaaatatataagagtggcagcttagcagattgggatttcacttaaatatataagagtggcagcttgagggcaaaatatttacttcatgcaagcgatccaccagttactagcactgcaagttactagcatagtggtttgtaaaacgctctcgcatcgccctcccctaggggcagcacgggaggcatcgaaccccggccgccccctccccccatcttcctcctccgcctcgccgccgcctgagcggccgccggcaaagccgcgcggccacaaggacggcggcggcggggctcctcgttcctcgtcgagctcgcctcgtttcgggcggcaaggggagcagcccaggacggcggcgacggtgaccgctaaatccgcgccgcctcggccggatctggcggtgtggcagctggcggctggcggcggagacggagacggagacggcggcggggatggcgacggcgacggtagaggagcggctgggtcgacggcggcggggatggcagaggctgggtcgacgccggcggggatggcgacggtggcgacgtcggcagaggcgccggatccaggcgcactggaggcgggtccggccccccagcggcggatctggccacccggctgccggatcgggcgagctcgtggcgggggcagcagagctcgcgacgacgtggtggcggtagcaaggcgagctcggggcaggagcgcccgtcgcggcggcggcggcggcgtcagccgccggcaggagctcctggaggtggtgctgtcggcggcggtggccgccgacggcggacgcagtatcggcaacgtccacggcagctctcggccggatttgggtgtggccgagtggtggtcggctggcgacgtctgttggcgacagcggcggcggtgtggtcgtggcagttggcggcggcggttgctcgctgcttggtggtggagggcgacggcgcagcggcggtttgcggtggcggtggctcgtgtcggtggcagcggcgacggcggccgtgactgtggaggcggtggtgacgtcggcagcggggaagtagtcgggtgcgaggtgaggatggcgacggcgaggtggctgagcgttcggcagcagcggctgcggtggtggtgaccgtgtctgcggtcatcagaggcatggtggcctcagacggcttgccgagggcgtgggagatggctgcatctggctagcgcgacatcatttggtggagaggtcaaagaccggcttggcgcagagaagcgcagtcgatggcagcggaggtcggctcggcgcgagaggcacgggcagcggagatggaggccggcttggcgcgagaggcgcgtccggtggaggaggccggcttggcgcagagaagcacggccggcggtggaggaggcgacctaggtgtgaggaggagctgctggtgtgtatggagtggtcttcggcgcacgaaggctggccggcggggggtgccggtgcaggggtcctatatgtcggcagagctagtatggtggtggagcatcggtgcgctagccgtgggtccctttgttagtctagtggcggtcgatcccgcttagcggcggccggtccggtgctagccttctgctgggcttgtgtgttggcgatgtcggtgtgtgggtggtggtataattttttctttttcctggctacaaccctccagtgtcataatcttgtaatttttttctgttttatcaatagaactcgttaaaaaaaaagttacaagcatgattcttcagataagcccattcatctctgaaacggaatgccacacatgcagaagaatgcaacacataaattgtgacatactagctagggtattaatccatatccatatctgtaacgaagtgcttcatatctagaagaattcagatacatgcattggaccaaaatatcatatcggtcgccctgcacccctgtgaatgacaacccatgcgtgtatggctggttgacagcagcaaattagaagaggttttttaaagatgagatgacgaattcgaaaagggttgtacagtacagttaataggcaaacaaattaagttttatttcttcgtgcatatatatatatatatatatatatatatatatatatatatatatatacccacatggatggaagagtacatatcaaagcaaccgctaatctggctcatacatgacgccagccagctgatcttgtagcacgtgtacgcatacgcaaaaataaataggaggaatcaaattaaagacgcgagcgctcgagctttatgaaaattaaaaggtatcaccggagcaagagcagctccggcctgtagtagtagagtcccgatcgagacgtcgggggcggcggccggactcagcaggcggcatggcggaatccgacgagggcggcggggatgttgtagagcacctcgagcgtctgaagctggatgttgccgatgatcccggggacctggtcgttggggccggcggtgaaggcgaggcagccctggaagaggacgcccgacggatcgagctcgacggcggcgttcttgtcgaacacaagcgtgatcctcggcagcgcgaagctgcggacgccggccatgtcgtagcaggtgtcgagcgggcccttgggcggcgccggctggtacatcgccatccggtccctgaacgcctgcctcagcgcctggtacgccgtcggcggcagcctggtgatggcggtgcgggagtcgagcgcggcgccggcggcgaacacggtgggcggcacggcgatccgctgcccggcgacggcgatggcctcgaggcgcaccatgtagaacgtgggcgggatggccgggttcttgagcatcggcgtcagcacgtacctccaggcggccaccctcggcacgccgagggtgaagaatccccggcgcgtcggcggcgggaagcagtgggagaagacgcggccgtaggtcgccgccgtctgcgacaccagtgactccggcccgccgccgagtgccatgatcccggcggcgctgctgccgaagctgaagctgccctgcacgccgtggctgcagccgaactggaagctcctgactgcggtggcgggggtgatggtcagcaggtcggagatgtaggtgcccgccgtcgacgtgccgtcggggtaccggacgcggtactggcactggttattgttggtgcagccattggcgtaggggccgagctgggtgcacgtcggcgagttgcaggagaagacgccggacgacgacgacttggtggggtcgtagagaacgtccttttgcggg

SEQ ID NO: 13124 - DNA, 4810 bp, Oryza sativa
  unsure (1)..(4810): unsure at all n locations
tcctcccttaagaagatacttccaggaagaaaaaggaaaattgtaaaaaaaaaaggttaaatttatttttttcgttactatacgtagaagttgaatttgaatttgataagcagcatgtacgtcaataatgtaataagttctagatctattattcttttcatcagatcaatcaataatgcataagaagttctagccaattttattaatattatatattgtgggtaattattaaccttttttaattatataaacttagctttctaattaattactagtaataggttaattattattattgttatataattattttacttctttttgcatatgtgtgggttaaataattttacctttgatgacattggtgcaggtgcagggtagtacgtgccatagttaagatctccttctatggactgctgttcgtagttagttgacaccggcacgtcgtcggccggctgcagcacgccggcgaccgagccggagagcctccactgtatgtagtcggcgcggtgctggtccgaccagagcatgccgtcgacggtggacggcgccgccctacccttcgccggcgaggagctgcacggcccgtacggtcggctcaacgggacccagttggtcacgttggggtgtgggctcactaacatccacgtacaacaattatatttattaatatgatatattaataataattattattaaatgccaaaataattcgtttcatttgttagagaggttatttaccaaggtaaacaaggaagaatatatagttaaaagttgcccaacgacggcaaagtctagtaaagagtcgagaagataaatgatttatatttataataggaggaaatagtataattgctctgacttaactacttattaaaaacgttcaagttttaatcttaggtactactacctctgtttcatatataaagtcgtttttattttttttctagtcaaagtttttttgtttgattaaatttgtaaaaggacgtagcaacatctacggtcccaaattagttttcaattaaatgtaacattgaatatattttgataatatatttgttttgtgttagaagtattgctaattttctataaatttggataaacttatatatgaaaaaattacggagagagtaggaagaagagagagaaaaattaagacggtactcaggctggagcagacggaatttggcttgagccagctgctggttagcaccacgatgtagttgacctcatctacacctgcactgtggtcagcgagagatgtagagccagagagcacaacaagaagcaacagtagcaacggcactagtgctgcacaagccattgccatagccgggccgctcctgtatttgtgctgtgctactgatgatgatgtgctgtgccaagtctagctagctccctgttcgactatatatagggggggggggggcattaaaggcattatatatatggcgtgcatgtggtacgtagggaataactttacaaaataatggagagttgttgttgatcatatctccaaggcagatgcttattattactctacttactaattactctctccatttcagaatataagtatctaactagatgggatactacaaatctagacaagctacctattcagattcataatattagaaaatattttatccgattttaaattcttatattttgggatgaagatagtaaagagttaacaatttttatctcttttttcatctcgtaagtcattttagctagtcttattctaagtcaaactcatttaacgatgaccgagatggttgatgaatacaacatctaaattaataaattaaataaatacactattaaaacatatatcatgcatggtgtgtttgtggaaatattttggcgttttatattggtgtattttttttataaactcgatcaaacctatattagttttattagaataaaactaatgacttaaattatgaaaatgagagagccatataatatgggtgctaatcttgaagcattaattgatatacgctcgaggaagcacccatatttatgtgtaatataaaaacttgcctttattaattgagccttttgatttaagaacatggagaagataattcttaaatagcactctagatgcttgattgcatggataattggacatattaagaagtaagatggagttataatcgtgatcgagttctcttatgaaggcgtcggcaaacggcaagcaaccaagattcctgaggtgctagctgccttccgaggtcataagagtaagaccctgtttggatctatagactaaattttagtcattgtcgtatcggttgttttgataataattagaagtattaaacgtagactaatgataaaacccattccataaccctaaactaattcgcaagatgaatctattgagtctaattaatctatgattagcctatgtgatgttacagtaaacatgtgctaattatggattaattaggcttaaaaaatttgtctcgcgaattagctctcatttatgcaattaattatattattagtctacatttaatacttctaattagtatccaaacatccgatgtgatagggactaaaatttagtccctggatccaaacaccacctaagttgtttttctaaacacgatacaacactacaagaaatatgaccttctgtgatgaatttctcgtgacatcggagctattagagacgcatgataggtgacggatgaattttcgtcacgcgagcgtcacatattacaaaacgtgacgaaattttatgttttttgatgtaaatgaagcgtcatctatcataagatttcttgtagtgaacacaagcggtcacaaatgtacgcacacccacgcttttgaatagtggcagcagtagaaatttttcaatgggggtacaaagattaaaaatataccgagccataactaaatatgatatactagtgggctacatacccaaatccggggcaggaaggagagcgccatgcacgcagagatgtcaacgccttcacaaacctacttcaaagattcggagatgctactggtctacgcacaaactttcaaaaatccttggtggcaccgattaggtgtgatgatcttgacatcgataacatcctggaggagtcgtaggttacacgtgcaactttcccactaaaatacctgggcctgccgttgatgctagggcggctgcacaaggttcacccacagcccctcttcgataagtcagcagggcgcatggcgggctggagagggaaaaacctgggtctggcaggaagaacaaccttggtcaaatcagtgctcacctcgcaaccggtttacctgctaacggctctcaaggtgaacaaggatccctcaaagtcctggataaacaacgcaagcgtttcctgtgggctggttctggtgatattattggaggcaaatgcaaagtcaactgggagaagatctgctcaccgacggtgaatggaggtttgggaatcctgaatcttgacaagttcacaagggctctaagactccgttggttttggcatgagtgaaagtcaccagaaaaagcgtgggcggggatggagacaccgtgtgaccagaacgataaactcctattcgcgtctgctttgaaaattaagattggtaatggagacacaataaaattctgggacaacgcatggcttgatgggcgctggccgaaggatgtggcaccactcgtgttctcgatatctaggcggaagaaccgctcactcgcgcaggcaatcgaaagcggccagtggctagatgaccaagccttacccatcaatgatggaatgacaattgagctcctgaaccagcttgtcactctctggacgacaatccaacaggtcacactttccccggatgaagacaacaaaatcacttggaagctcacgtgtcatggagaatacacaacgtcctcaacctacaaggcacaattcttcggatcgctcaaaacaaactttgaaaccttaatctggaaagtatgggcaccgtgcaaatgcaaaatctttgcatggctaatcattcaaaatagaatctagacgtccgacagattggcgacccggggatggcagaacaacgatgtttgcccgctatgccgacacactaatgagaccgctattcacctgctggcagactgcagatacaccaagaaaatatgggatgccattgtcaaccggttagcctgtgcgcccatggcgccgacaaattgggcacaggcgagcgtggttcacgaatggtgggaatctctcgccacatgccaagggttaccaaagctggggaccagatccctaattctcctaatctcttgggaaatttggaacgagcaaaatcgccgaatcttccgaaacaaggagctaagcacggcgcccctcaccgcaaagattaaagaagagtaaaaaacctgggctacggcgggaaccaaacgcctagcagagatgttaccttagtgcctattcggtctttgtaaatattacttttactccttacatgtaaatattgctccctgctttattcaataaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13125 - DNA, 3357 bp, Oryza sativa
  unsure (1)..(3357): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtaaacagcagtcttttcaagttaagtatagtggtagtaggctagtagcaaaagacgacgaccgtgtgagtgttaagaaaatgtgcgtaggtgacctccaaatcaacacatgcatgttagcacgtaggtggcgtttgtcttttatcaactacagctcgtgataattatactgctactgatagtctgataactgtgtaacaaagcatccgtgactgactgatgataaatttgataatacgcgtcgttagtttcgcaacacatctggcgccacacaattttcaattgctcaccatgattccttaatccccttcacctcgtcgatgcttacatgtgttaacaaatggtgattcgatttagttaaggatgcacatcaatcgtactgtacagattggggttgctcagtttgttaggtttggttaatttttctttttaacctgtcgccatggatggatgaattcatggatttcattgagagcagctggagaagaaagaagaagagtgacgtgatccattcattcgttcgttcaccttgactgaccactgcaacttcgtctcctctccccttaaattccccttcactctcctcactccatccagctcaccaccagcagcagcatcagcagcaatgcagcctcccatcctcctcccgcttctcctcctcctcctcctcctcgccgccgcctcgccacggccggttctctcccgccgccacgcctcgccgccgctcgccaccgagacgctcgacgtcgccgcgtcgctgtcccgggcgcgggccgcggtatccgcggaggccgtgccgctccaccagtccgccgccgccgccgtgtccacggaggtcgtcggggaggagcacgaggaggggcgcctggccctgcggctccactcccgggacttcttgccggaggagcaggggcggcagcggcacgccagctacaggtcactcgtgctggctcgcctccgccgcgactccgcccgcgccgccgcggtgtcggcccgcgcggcgatggcggcggacggggtgagtcggttcgacctggtgccggccaacgtcacggcgttcgaggcgtcggcggcggagatacagggccccgtggtgtccggggttgggctcggcagcggcgagtacttctcccgcgtcggcgtcggcagccccgcgcggcagctgtacatggtgctcgacaccggcagcgacgtcacctgggtgcaatgccagccgtgcgccgactgctaccagcagtccgacccggtgttcgacccttccctctccacctcctacgcctccgtcgcctgcgacaacccgcgctgccacgacctcgacgccgccgcctgccgcaactccaccggcgcctgcctctacgaggtcgcgtacggcgacggctcctacaccgtcggcgacttcgccaccgagacgctcacgctcggcgactccgccccggtctccagcgtcgccataggctgcggccacgacaacgaggggctgttcgtcggcgcggcggggctgcttgccctcggcggcgggccactctccttcccgtcccagatctccgccaccaccttctcctactgcctcgtcgaccgtgactccccctcctcgtcaaccctccagttcggcgacgccgccgacgcggaggtgacggcgccgctgatccgcagcccgcggacgagcacgttctactacgtgggcctctcgggcctctccgtcggtggccagatcctctccatcccaccctcggcgttcgccatggacagcacgggcgccggcggcgtcatcgtggactccggcacggcggtgacgcggctgcagtcgtcggcgtacgcggcgctgcgcgacgcgttcgtccggggcacccagtcgctgccgcgcacctccggcgtgtcgctgttcgacacgtgctacgacctgtcggaccggacgagcgtggaggtccccgcggtgtcgctgcggttcgccggcggcggcgagctccggctgccggcgaagaactacctgatcccggtggacggcgcggggacgtactgcctggcgttcgcgccgacgaacgcggcggtgtccatcatcgggaacgtgcagcagcaggggacccgcgtcagcttcgacacggccaagtccaccgtcggcttcaccaccaacaagtgctaagtcattagcagcgatggcttaacttaattagccagatcaaggagtgattagtggtggtaaatggtaattaagcgcgagagtgtgtgatgtgggggtggggcccagtgccaggctctgtgggctttgggagagacgaaaggcgaggacaaatgccagcctgtcctgctctctgcttgtcgatggatgggggggcccactctcttcttctccggtgctttgctgtttcgtctttgatgtctcggcaaagacgaattaaaatgaatccattccaatctgttcatgtgttctatggccgcttttgtttgatgaaaacgtaagcttccaaaatttccatatctccattgctcctggggatgaatgatttcgtaggtgttcggaccaaatttggaccggtagcgtaatacatttgcatttttttttgttctcgagcatttggtaggtaggtggcgataaccgatcacatgcgtgacgtagcttccaaattttgtcatgcacggcattgcatcattgttgatgagagagtatggacgatggatggatggctgcagcagaatggtttttaaccttgcgatgcaatgcttttatacggcgaatttgtgatgggatccatccgttttttgttgcttttgtccggaaaacaccaccattttgtgtggggactggaggtgatgatggcggtggatggggtgggtgagggattactgcagtgcagtgcttggttttatatttatggagggttggtgaccgttactgtagcattcttcaatgcacctgcagcatgtgacccagatgcttccccagcctgacccaaagcttcctcatatccattgccaaattttgctactgccttgagccatcaccggcttgattacctcccagctccagttctgttcaagatcttttggtagatggagcatctttcaaaatctcttaactcatttagattttctttcagatttgagaacggtaagagtatgaaaatatagaattcagaacataatttagaactcgaaagctaaaaacacagctattttagattttcactagttaattcctatcaactgtttcttagaattctaaactctattccatatt

SEQ ID NO: 13126 - DNA, 19336 bp, Oryza sativa
atttattgagtctaattaatccatgattagcctatgtgatgttacagtaaacatgtgttaattatagattaattaggcttaaaaaatttatcacgcgaattagttttatttatgtaattagtagtatatatttaattctctaaattcatccgatatgataggacggcgccacctcacacgggctaaatttagacagcagcagatgctcttgcgtgctttaatttgtcgtcatgcatctcgacttcccttaaaaaaggggctataaaatgcttatgtgtaggagaaaagtaggtccccggaacaatagagctgatcgatcggtgatgaggatcacaataacttgcagtgccattagttggtgatacgtcggtttcatcgaagaacatggcaaatgccaaatggagggatcggaggagcatacgtgctgctgcgccctgtgtattcatgcatgcatccatgcatcttgacgacctcatgtcacaaaagagagagagagagagagagagagagagagagacaacgatacaagattctcgaatctagtggttaattagtccacctctaatctgcatgttggtaaatttctgactcatttgctacttggattgtttggttttgctactgaatctagtgggttggaatactgatttttgcacatggaattaccaggacgaagttacacaggtcacagaatacaattactcacggtgttgacaaaaacacctctaattcctactctaatcttgtcgcgtactacttccactgtttcacaatataagttattctagcattttccatattcatattaatgttaatgaatctagacatatatcaatatgaatatgagaaatgctaaaataacttatattataaaacggaggaagtgcgtacagttacagcaaagtgcagaacaacgtttaacatctctgcgtgcacggttgaagaattattacgagtgtgttgcacacaattaagacacaatcagttgaggaggtgttcgttttcttcaatccgtcaaagaaattacaacgaacaacttcgaaatggagacatcaattttacgcagcgaagtacgccgtgccaaagcttttacggttaggcgtcacgattactcaacagggggatctctgatccgccataaagcctctcatgagccgatgagcccgacaactaataaagtcgatttgatgttcataaaacggtgcactgttcccgtaaaaaaaaaacaaccttagaagtcccctcccaggttaagcaaaggatgtgtttagttcacaccaaaaattaaaagtttgattgaaattgaaatgatatgatggaaaagttgaaagtttatttatgtagaaaaattttgatgtaatgaaaaagttaaaagtttgaataaaaaggttagaactaaatttggctttttttttttggactgtccggtgcatggtaatactgtcattcgagagtcctctctgataagcgatggattgtccaatgaactggatagtcacgctactccctcgtctaacttctaactttctatcacatcacatcacatctaaaacttttctacatacataaactcttaattttttttaaactaccaacttttcttaaatttttaacttttttcaggaactaaacacagcctaaaaaataacctagtactcgctccatcccataatataagagattttaccattttgcttgcaccatttgtcctattcaattttttttacaaatataaaaaacaaaaagttatacttaaaatactttggataataaagtaagtaaaaaaataaataataattctaatttttttaaaaaaataagacaaatggctaaacaatacaagtaaaatgtcaaaatcttttatattagagaaaggagggagtactacatatcctagtaaaaacaaatttagatatagagttatcaagatccgttataatagaatatgtcacctcataataataagaagttattttttttaaggactgagggtgtatatcgctagcagtagcaagaaaataaaaaagcagagacgagagaaggagacactagttgactgacgtggccggatgccacgtgtacagagatccggatcaacgtcggccccaccacgtggacggctgctcttcttcttcctttttaccccgcttccttcgtctgggctgtttcttcttcctttgcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccagatatatcggctcctccaactatcaaaaccagtacaaacaatgtccctcgatggttttcgaggtggttttggctgacgtgacgcctacgtggtgatcttaactcttaaccgagtctttgtcatacgtgacgcttacgtagcattagaataaaaacaaaaataaaaaaatgtgggatccacatgtcattcacataaaaaagtattgtgggaccactgacatgtgggacacacatgtcatcctccctctccttcccttcttcctccccgtctctctcccttatctctttctccggagcggtggcggtggggacaaggcggaggggagcagtggcggtggggagcggcggcgggcaggaggaggaggagaaggcggaacggatgtcggccaaatcaccgatgctgctccatcggaaggacaagaagaggcggccgatggtgttctgcttcaccgcgtgttaacgaccaaatttggtaatatcagcatcggaaaagaggattagatcgaagtggagtagaaggcaaagatcggttcgagaatagagcaagaatcggctgaagtccggatcggctatgaacaggatcggctgggtccgaatcagattgtgtgagccgatacggccgattctgacaatatgactcgatgtacaacatcgggttgagttgatatgcttcaagatgattgccgcacatggatagagtcctgagaaggcaattgtatctattaattaggatattttatgtaaattccttagagatacgtttgggcaaaagtctgccgcaaagacttgtggtatcttatagtttgttagagataagagacgtgtccgatatggacatagtttgtaattttcggatataaatagaccccgaaccccatgtaatcaattaacatacacgttcaacacaatctcggcgcatcgccgccctttttgctttagttttatttcgacgagttcttgatttcgggttgagctgcatcagtttcgatcttcaataagaggtaaaacttgttatgacggcttgcgttctcgggattagtgcttccatctttatgacactctaatcttatttatgtaattcgtcgagttatcatatatcttacataatctttggcaatatcgctatctaacctacaatcggctaacatctatcggtagagggcagccgattagattaaacaccgacgttgacttggattatatgagatatctactgttctataaaacttccagcggcttgattatcaagatattgttctttttttcatacttaatgctgcatcagttgagtttgatctattaagtcgtgcttagaatatcaatctctagcctgccttctggttgccgattagggtagcatcggaatttcagccgattttatctgatttaactatatttactctacatgctttgttgacacgttaaatctgccctttatgttaagatattattgcatctaagtatattcagcttttgtttggtatattctgtttgttttaacatcttaacatagagttgtatcggagtattagccgatacatgctagatctatctgatcggctatgctatgaacatatataatcctgttattaatatatatttcgatctaagtgatttatactgtctcggcatggcgaccgatctatcctaatcacttgatttaagtatatatcgatataagaattatatattgctaatatctacatccgatcgagtagatttagttctttattatctatttacaaccgccgatcgatttacatatgacatcggctcaaagataaatgatatgtcatcggcacctagccgatcgactatcgtttataggtttaaccgcggttttctttgtttctatttcttgttgattgcaggatcaaatcaactggcacgctaacacacccaaaggcgagctttggacctgcactggagttaagcagatctcccaggcctcgtgtttttcaccaacactgtgtgctgcatcctcttctggctgctcgtcatcgccatcagcgtggccgtgctcatcatctttctcatctaccacccgcagtcgcccaagatgcgggtgaccactgccaccctgaacaccgggtatgtcgatgagcttgacctcgtcggtggcgcccgggcactcaacgccgacctcaacgcgccgacctcaccgtcctcgctgccatctacaacccgaacaccaagctccacgtccccaccgccaccgctcccctctgcctcgtccccaccgctacagccgccgctcctttttgtgtgtgaatgacatatggccccgcgtatttttttatttttttttattctaatgccacgtaagtgccacgtaggataaagactcggtcaagactgccatgtcagccaaaaccaccgaagaacattgtttgcaccggttttgatagttggaagagtcgatatacccggttttgtggttggaggacatgaattatactcgggcgatagttgagggagtcaaagtatactttttccttttgataaggccgataaagagaggtcatgggccacggcccatttatgcaggctatctcgtgtgggccttattgtggtccggcttcgtttcattctgcgccaaggagcatcctcgggtatgtttgtctgcaagtagaccggcacgctgctgctactaactgtcatcaaagatggctgttttattctggtgatagttttttttttgttgtagataatagaatttcatttttctaagtcgagtgtcctgcagatcatggcacgggaaagccctttggcgtcttccgcgggcaccacggctttgcctagctcatgtgctctcgtgaccctactaaaataaatgaaactatatatggggatcccaaaccgttcgactagtattattttttttgggtatcacacaatatattactcctactctactagcaattgtttgttttgaaaaatatgaattgcgtctactcctctatccggaacatcgtcgacgtagatgtaacctatttcgatataacgggattgaaactcctatcgatgttgatagtaaatgggaatgggaagaatatatggacggttacgatgtcattgtcctggctgttcatgtctgcgtttacattctctttatgattgatctttgcagtaagggcagtcccaaccctccatctaggattgtgtttatggcattaactacattatcatataggacttttagtttacgtggcactatattaattaagagagagagagagagtgaagagaggaagcaactgggtctcatgtaagacacagcttcaacacaagaacctatgcagtagacactatcaagttttgcattggaagagaataatggctttataatagatgaagaataaatatgattggtagagaagagagatgatatatttattaatggcccactttaagaaaccatgggatgtagagtgtattttctattgtgatgtcttatcgacataggccctgtttagatcctccaaaatggcaaaagttttgccattttgtagcactttttgccattttggatctaaacactagtagcaaaagttggcaatttggcatttggcatttgctagtccatagtagcaaattgtgctaaaaagtgctttgggaccactccctctctctttctctctctcactttagtgctagaatggcaaaactttaacatgcatctaaacaccaactattacttttgcaatgccaaaacttttgccacaaaaacttttgccatttaccatttgctattctaaatggatctaaacaggccgatagtaccatagacactgcttatgtaccctacgggttagactatcctaaatgggggttacgggctccgcaccgcgtgatcaacagcttccgccaatttactgcccctccgggcctacttgtgtgatttattgggagcagcactttgcgttttgtgtgatttgttgggacggatcaagcaagtactacctctgtattttaaaatgtacgacattgttgacttttcgtttaacgtttgaccattcatcttatttaaaaaatttacgtaattattatttattttattgtgacttgattcatcatcaaaatgttatttaagcatgacataaatatttttatattttcaaaaaaaattttaaataaaataaatgatcaaacgttggacaaaaagtcaatagcgtcgtaaattaaaatacggagggagcaggtactcctcgttcagtttgcgagtagatagatcagtgacagcgtgcacaggtgcgtacgtgatgcgtggatgcctcgtcgccgtggccatgtccatgtgctcgcggtcgcggaggaaaatatgccacgtccgtttctgcgttgctgggctgcaggttggcaggcggcggcacgaacgaacgaacgtgcggcgcaccactcgcgcacaccaccccccgcacgtcgcagaagcagatgctgatatgcggatgcccaccggagcagggggggctttttgtggtggttgcgttgcagccgtgcagcccgtgcgatttgggtttggggcgtgcaatcatcatgatgcggcatttagaacggatcagtggatgagggtacggtgatgggagtgcggcggtggttgccgtggcactgccaatgcccaaaagctcgttcattcattttctctaaaccccgatcattatccgcttgtactatcattactgattcaagagcaacagtatggtcctgtttgcaggttctctccgaattagaaactctcccaactaatacagtgtttattccagattctaagaaactatagttgtagaatctaaaaaaataaactaagccataagctataagccataagctagaaaacccagctttttctagatttttataaactggctactaacaaactgtttctcaactgtttgtcagaatattaaactctcctaacagactctatctatatatgttaccatatgctctagcaccaggcagccactatcactgatatgctaatggttagtagtagtaggttttctctcgataatgatgccaatggagttggtagcggcatcagattagtaaattttaccgcggtcacgtgagatgccatgcacgatgaatcgaatccattcccagccagctgacgaggtgtctccgtgtgtgaatcggatggtagaaaaagctttgcaccaccctccaccaccgctagattcgctcacatcgccgccattactgttgccctctccttcccggcgcggccactccgtccgccgccgccgggggcgaacccgaacgcctctccaccgtccgatccgccagccggatcagatccaacacctaccaacctaccttggcaccttctccctctcgtctccttcctcctcacctcgcccactacacctccacctccggagctcacaacacaaatcgatttctcccaaaccccccctaaactccccaccgaatctccaatgcaggtcctgctgctgccgctgctcgtcgcggcggccgtcggcctcgcgcgcgccgccgccaccgacgaccccttcctctccggcggtaagctcactcggatcagtgggaatggtttgctgaaattgagcttgagatggtagtaatggtgatgggtttggttttggttttgtgttcctcctccagcgccggggaaccacagctacaacatcgactgcggcggcgcggcggacttcgtctcggtgttcggccgacggtggctcgccgaccagttcttctccgccggggggcaggcgggcatggtcgcggagccgcaccggttcccgcagccgcaggagcgcacgctccgcttcttcccgccatcgtcggcgggcaagtccagctgctactccctcccgctcccgcccggccgctactacctccgcctcttctccgtctacgacaactacgactccaagctccgcaccccgtccttcgacgtctccgccgccgccacgctcgtcctctccttccgctccccgtggcccgagccggcatcgcgctacggggcatactccgacctcatcttcccctccgccacctcgcccacctccgacatctgcttctactcgctctccaccgatgcccccgtcgtcgcctccatcgaggtcgcgcccgtgcacccgctcgcctacgacggtgccaccaccggcgcggacctcatcctcgtcaactacggccgtctcacctgcgggaacaacctcttcggcccgggcttcaccaacgactctgacgccttctcccgggtctggcagtccgacatcgatttccggaacaatgacctcaactacgacgccattacggccggggggaggaagattttcggcagcaaccagccgcccaactacttccccaccaagctctacacgtcggcgatcaccaccggcggcgatgcctccaacgagatcgagtacctcatgccggtcgacaccaggatgtcctacatggtctggttgcatttcgcggagatcgatgctggcatcggctcagctgggcagagggtgttcgacgttatgcttgccgggaagaacgtgacgaggattgacattttcaagcaagtgggagggttcaccgcgttcaagtggacatacattgtggagaatttgacgagctccaccatgagtgtgaagcttgtgccagtagtaggacggccgatcctgtgcgggcttgagaattatgcaatggtgccacttgagacgaggacagtgccaaatcaaggtgacatggtttgaagattgcgctctcagccgagaaaattggagaccagcaaaaatttcctcttgtacattctctaagcttgttttttattcatcttggcagtggctgcaatgaaggcattgaaggattccctgaaaattccagcaaggatggggtggaatggggatccatgtgcaccaaggacatgggatgcatgggagggagtcacttgcctccgcaaggacaaagggcttgtgatcacccaactgtaagtaccatttcgttgctccagtgcaattggtatccaccaactgtttttgtggggatgtttctacttagatgtgcagtactgatttgataagtttgccatgaagtagctttggcaagtacagccacctttttattttcttcagataattgatagcgttttcctagaaaacaacgatgatagttttttatgatgaccagaaaagaaatgatacatatgtacctcaatttcacagctgaatattactctactagttaccactacctccgtcccaaatacaagggattttgtccttgtattttgggatgttggcagtactacacaactaatctgaccgaaagcttaattgtcatattcaaatcgcagttaaaagtttcttcttaattctgctttggttgttttgagttaccattttttaaaatggtcaaactttagggcctgtaggtttgttgttgcacatttcttgatatcctttatcgcagtaatttatgactgtcagtattattgtgtgaaattggaagcaggggcggagctagcacaaaatgaaggggggttccacttgcttactttactctagtttgaaccaaatttagcttgatacgggtgcctaaatttgaactgacagagtatatatatggtgaaaatggacaaactatagctaaaattttttttcaaccgggttcctgggcacccccctagctctatgtagctccgcccctgattggaagggagtcagtggacttcctttctcgtaaaagctctattgagcaaacacatattatatatttgtgaaaattatctaaaaaaaatcttgtgacattgatatttttgctgctacaaacttataacctgtatgtatgtggtttctatgtcctttacagggatcttgcaagtcaaggactaaaaggttacatcactgatgaaataagtcatctgacagacttggtaagcttgtaagtatcattaaacctactgaaagtcgatttttcagtttgttcattatcttctttgatatttaaagtatctggatatcaacagttggttttgttatcggtatcttttgcactacgggaatatataaaaccttgaattatcaaagttaagtctcaaatagctctatagactggtttgcattgctcaggttaatagcaaataaagttggagtggccactttcctctagaagataaaaagagcaatgtatcaactagtgaagtacttcccggcttgcctatccacattttctgaacattgtggagccaaagacaaagaaattcccttttgcttttctccaacgtagatattttttcatcctgttaatgatacatttgcttcaccaggaacttgagctataattctttgactggaagcttacctccgggcttagggcaaccttcacttgctacattgtgagtatagctttctgttccataacatgcaatctcgtgattcaaattagaaaatatcttcttctttttttttaaaaaaaagaaaaataggcctgggtggccctgctttttatagaaagcaaaattagaaaatttcttgtgttcagatcacagttcaaatgcttgtcatatatacatgatgctgacagaagcaatgatggccactttaagaaataattttgtgaaatcaaccttctttatacatgtatcatttcaaagagaacttatgaaactaggatgatagagcatgagttttattttattatcatggattgatgactcctgagacagcgtctttcatttgaggaataaattttggaaaaggacatgatatgatatgccaaattggaaaattttaactcaagttcaacccaaacatttggaaacagaaagaaaaagtgaaatcgtgtacttttattcatgattttttttattttccaatgcgtggatcgaatttggtttgagatttttgcaaactggtacatgatgtaatcttacatttctaaacagtatctgaaatttttttcatgaccgaaagagtatgtctatggagaatgataacatgttaatatggtaacatcagatattccttcttccttatagacaatgtgttagcagatcctctacgaatttgagtgatggaatgatgcttttcagtttgcagctatcctaatgataccttatgatcttgtagttctggttctcttgtgagtaacctttatgtcttgtttttagggatctgtcatcaaaccagtttactggaggaattcctggcaccataggttcatcaaaattacaaacagcgtaagtacactgtttgacattagcaattgttgtatattctcaaagcaacacaaacatactgattaccatctcttgtacagtttactgaacaacaatcaactcgatgggcaagttccagaaagactttactcgattggcgtacatggtggtgtgatagagtaagatacctttagtattttcacataaacaagatcttcactttctcctgtaaagtttactagtagttagtagtatatccagttgtcagatatctcatacaaagagctattgttctcaggcttagaattgatcggcaggctcctctatttcatcccatgctccctgctgaagtccaccgcttaagattttaggttccactatgtgacttatgttatgttgagtattgtttagatcagtggtagagcctgctactgggctggtcaggcagccgccctggctcttttttttgtgttcttcactgtagatcactgataagcatggaaaaaagttgtcagagcaagaagcagctcttcgctggctgggttcattgttgctggctccgccactggtttaaatttaacaatgccatgtttacaatatgatacactgatgctgagcgatatatctctgaggttaaactgagtaaaagcagggtgttgttagaaacgtgagaagtatgtactaggccttgactaactaaattggagattttgcatctaatggtgcttaatttagcaaattttactttcttattccttgcaagcaaatgactggagttcaaacatgcacactgtgatcagataatagatcaatggtagatatattgtgaaccatgatacttgcattcattttatctctctatttacaaacacccactgttttaacagtttgtcaggtaataaaggcctttgcggggtgcctactttacctgcttgtgcattattttgggagaaaggagggctgaacagaactggtaaaattgcactaggggcctcgcttgggtttgttctacttgtcacactcatagtggtctacatattgtgcatcagaagaggaccgtacgattatgattttgagttcccccaagatttgacttgtgagtataccacatctcaccttcatactgtgggtcaacctcatatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagggcgaagtctgtaatgcttgccgagatggaggcgcacggcccggacggttattataccaacgggggcgctcactgaattgatgggcaccggaaatggatatcttcacaggttgttgtatttctacttacagagcaaacactcattgacaattgctggcctgaagcaaggacagttgtgacttgtgactcgtgaacacaattcaccagcatcatcaacatgacgtccctgtaacttcagtcaagcatccatggcattattttgcagttacactcacagcttaattacaaatgtaaaatatgtgcatgttttatgtgtactataatacgatgaagtggtggtggggtggtagtagtagtttggtaatagtagtaggggtgccttattttttgcagaggctttgctgtctcgtattagctttagctttaggcgtgtgcactccatcagcaatgtaaatggaaccaggttgggtcaggacagattcaggcgttgaaatgcttggggggtaaaagctggtgtactcataggtgtattctttctgtataaaacctgacttcgttggcactgtctgacttcaggagattgaaaacattagctttggatcagagtgttgttagccacttttgattatctgttgcttacttgcgtgtcatccagagtcatagacgactcaaattctcacctgctagtatttcaattgtcttcagaatgtgctctttaaacttaatttttccttctaatcgaaccatttggtctggatttagatacttgcattatatcgaagttgtactgcatgaaaccttaagcaatgatgtaataatatcgagtcatctgtaatgtctgaaaccttatttagactatgcagtttgcagttcatattaaagcccacgtaaaataattctcagcccaacaaaatacaaagaataattctaagcccaacgagcccaactgcgcttcccaactatcaaatctgcaccatccattcctcatcggatgccttcacgccgccacgtagcggagagcaaagcaaaaccctagctagagccacacccagaggtatagattccccaccccgccgcctccacgcattccttcgcccaccaaaccctagccgcgccgccgccgccgacgaccaggtaaggaaggagatccgccgccggcgccgccatgaagcgcaacccacgcgtgacgagctcccggaggaagtgccgcaaggcgcacttcacggcgccgtcgtccgtccgccgcgtgctcatgtcggcggcgctgtcgtcggagctccgccacaagtacaacgtgcggtccatcccgatccgcaaggacgacgaggtgcaggtggtgagggggagctacaaggggcgcgaggggaggtggtgcaggtgtaccgccgtcgctgggtcatccacgtcgagcggatcaccagggagaaggtgaacggctccaccgtcaacgtcggcatccacccctccaaggtcgtcgtcaccaagctcaagctcgacaaggaccgcaaggccatcctcgaccgcaaggcgcgcggccgcgccgccgacaaggccaagggcaagttcaccgccgacgacgtcgccgccgccgccgggggtgccgccgccaccggcgcctcgctccaggagatcgattaggctcgtgggtcggatctgctggtgctcctactgttccccccctccttatctagcttttgtttcgctatcaactgcttctgctaggagttcatgctacctgaacactgcttgctgctttatcgttgaaaatgtctccatgagagttttggatccttgatgttgatctatatctacgatgtggctctgtctgggattttgagttatgaagaaatcattataagtctaaatgctcccgttttgtttgtgttgcctagatatactgaatggcatttcatggactgtgttacctagatataccgaatgattctaggttgataagactctggttttctggatgatgtctagtcccttaatttgactctgagtcacgcatctcaggttgtaacacatcatatatgcttagttttactcaagttgagcatttcaggctgtaacaaatcatataggcttagttttactcaagttgagcatttcaggttgtaacaaatcagctaggctcatagtcctacttctaaattgagcatttcaggttataacacatcactgtagtttaattcgacatggtgttgcactatcatactgctttccttagggcaactggcatttcgtttggatcctacgtgaactaggaagtatctggttgagtggatgactgttgattataccttgctatgagtgtatgacttcctctatattatattcctatattgaatcgatttgaaatgatcttattgttggtatgatatgatgcatacggagcatggcgttagtaggctggactggctggtagcatcttgctttcacatgatgttttgttggcaaagttttttctgttgattcatcaaattttctactctactattgagctttgtttgaaactttgaatggttatatagtactagaatgtagttcaccttagctttctagtggtgacccttccaatacggctacgcatatgctctgtttgaattgctcagctaagacatcagggttaccgatgcatgagttgtctttcgatcaatgtggttttcctgtgctttcacggctgtgggagtgaatttcccttatggtccttctattgtcatgttgtagcaacattttcaacatttctgtgttgatgattgtgcgttccacctttatttaccgcgggattcaggcatttggacacactacatagctagagtaccagatagtctatttgttcttatttagcggctgacatgttaaattatgtgaaaggtttcttacacaagcgcatctgtgagggatggcgttttgattcctcaataagctggccctgtttatgaagtaggtgcattgtggatttgtgatacgggtcgcccctcagtctaatttagttgctgttgtgcattatgatggtttctagtatgcgggggttattaatggcaatgtatttccatggaattttagtcgatccctatgtttatgcgtaagcatgaatattgaaccgtatctgtcaatcgaatatttggtttgcatcagttttgaaaacggatgttggtgataaaaacggtcgaggggatggaaaacgagatcatatggctgtgctctttcctgggcatgtctccgaagtccatgaatagaccaaatgggtcagctcgacgccttatctgtggtgcgagcagatcaagtccactttgactccctcaaatataggtgatatcttgaaccactaacaagctgatgtggcgtgttgactattctaatcactattctaatcgactgaatcagaaaacagcgcccagatatcagcatcacttcctctttcttccccatctctattctctcgtctgttgacgtgcatactcgcctactctctcggtcccataaaaaacctagtatcggatgtgacacatctagacatacatatgtccagattcatagtactagaatatgttatatcttattctagattccttttttagggacggagggagtagtcgcttgctccatcgcccatatgttcaggagagcttctggcagctggatattcttttagaagccacagttgccagaagctttttcaaacagtctagatttttatctggattctgagaagttgtaattgtatagaagccaaattttcactcggattttctagattctcaccagctacttctcaaaatcttaagtttcctcaaatagaggtgacgacgttggctcaccacctttgtcggagacctctggagatcagttgcgaacaggatatacgtcgagcaacgccatgccacgcaacaccgccaccttcactagagacctatggagatcgagctcctcgaccttacacaccgttagcctcccctcctccttcctttccgcctcgctctagtgccaatagcgtgggtgcttgaggaggccagtgatagcttggcgaatcacaagcatgtgatgcagatcgcttctgcggttctgcccttggtctagaaattcttgataccccaaatgtccaaacgatttcatggataatcccaaaacagatacagagtgcatccagagcaagcacctcgatcccctatcgcttgcatcggttcttcaccgacgtcgtcgagtcttccttgtcgatgcagcttgacatcgggggagctgggaggttgtcaatgccgctcctgatgagcttccactttggaagggtcggtcttgatgtgttctcgtcgacgtcgacctttgtcgccgccaactccgacctatcccagaagcggtggtgggagcaagaattgcagcaacatcaaatggccgagtacatgtagaagccaaattctaggcatgatgtggatcgtgctagttgcatgagtgccatcgccccgttctttacccacaagtggctcgggcatccatgtcctctccatgggtgctgctgcagaaaagagacgggagaaagaaagagaaaagataggatgaggaagaagaagggacattgacatctcacctcacatgctaacttagtcgcttggactagttaacgagccacgtcagcggaaatgactctcaaaaccgctaaggaagtcaaactacatcggtttaaatagtttgggggttaagatatccggcatttcggttgagagatattaggatgaaatcggttggaaaaaccctctaccattttcatttgcatatttttttctcgaaaacggaatcgaaatagtagacctgaaaacaacaacaatatcattaatatcgttatatcggaaacaggaccatcgaaacagaatctaccaatattggttggaagtcacgacgaacaatataaacaaagttcaacaatacttcaacatcattgaggaaaccgaaattcaacaaagtccacttgccacaccttagggttaactgagttttcccctagccagttcccattactaataggttgcaagcctaccagatctcctttattcatgggcttccgatgggttgggctggctaagccgctgcggagttttttattttttttggaattttgacggaaattattggacaaatacgattaccgataaaatggtcggaaaaacctccatcccattttcggaagatattaccgtttccatttgtgacactgacaattaccgatatcgactgaaacggtcgatgcataccggaaacgataactagatatctcggaaatttccgtatatttttcacccctagattgatacaaatcgcacatgttcgagggaattaaagttgacttattccccgggcagttgctgttgcaattggagacgagggacccaagaagccaggccatgtccgtgtagcgcccatggtttgtgaagacatgacctcaccgatcgattgatactttgggccctcggcgtcgcgttaacagtgagagcatcatatatagcaagaccataattgccaagttgagccgcctacgtacgtctgtgagagttgcagttgtgttgtacaacaactacaagcctctcactgcttcacgtcatgcatcacgggctcattgtaacatcgcctgcctgcctgattttcgcctggctcggtacgtcggcactgcactcctgatcctgaatatgaatgaaacgtccttcaatttccaagctgaagtaaaaacgaccacacgatttttggtttggctgtcagctactgtgctcccctctcgccgccgtgtcattcagacatccacacacccatctcaactggaccccttgtgtcccactcgatcgatatgattcaggtagcctcagccagccagccaatcagccagccgccgtagcgcccaacactgcagatttccactgtgctaccacatgtacgcacgcatctcatcgatccgtccagtccattcattataccgaccgtcacctggactggtgttaagtagccacacagctgctcgagattccgagaagcagccccgacccgatgagagcccatcccggaaaatccttagcatatgtactccagtttcatgttttgaattctaac

SEQ ID NO: 13127 - DNA, 19546 bp, Oryza sativa
  unsure (1)..(19546): unsure at all n locations
tttcgggacggagggagtatataagaaactatagcttcagaagttcagcaagctaagcctcagctagctgctatagacatgtactccctctgtcccagaatataagcatttttagagttggacacggttattaagaaagtaggtagaagtgaatggtggagagttgtgattggtagggaagataatattggtggagaagttgttatattttaggacaaattttgagagctaaaagttattatattttgggatggagagaataatacatattgatcgatctatcacgtatttattgatccagccattgatatatatatataatcgatcgagcacgagcactagtctgttctctgttgacaagttgcaaggcaacaaccataataacaataacaatgataataatgttttaagaaaaagccatcactccaggattctaggtcgagggtcagtacatcatgtagcaagacatcagatgcgcaaatactagctagtagtaacatcaatctggatgcaaacacgcagcagcaccaacattatttgtccttgcagcaagtaggtcgagctatagctagtcccatgcaaatggatcattgatatcgttaatacactcacactgacaagtgagaaacactacgctgaaaaccctgcacattgccatgttgcccctgcctatactgctagtgcgcgcgccacctgtttttcgatccccagctactagcgctgatcgagacgacggccaatgatcatatgcaagtaaaaatttgcaagcaaaagcgcatgtagtgcaaaaccatgggcgggctagccgctacacggtgggctgcactgtgccctaactacttggaactctgtccattttcaaaagatcgttggcaacttggtactaggaatgctgctaggatcactgtgctcattgcgtccgattattgctttcgttgccatcaacagaggccaaacactgtcgactacagtctgaatgtcgacacccccctgatcatggattcaaagctagctagctacatgatgcacgcatactccttgtcagcattaatcctagtcgtctctgcttgtctgcatatctctccttgtcagcattaatcctagtcgtcccctgcttgtctgcatatttcaatatccatgcttgcaaatgcaatggttcatcagatcgagatactactactccagctagttaaatttccaatttctttgcactggtagtagtaaaaatgaattcggagctttcagctaacgtactgtctgattaataactcgatcgtgataaaacattttgatggcgtgaccagtgaattaaagcagccgatctggacttctggggactgtttttatatgagactaagctattggaagctgtcgtcaccgtgttcagagatgcacaacatcatgtttctgcaaataatagtgctcctcttccttacagtggcccaggcctgaatttgtccaaagctcaacctctgcagctagctaccgctgcattactgcgcaccataaagttgcacttgtacgaccatccaatcagcttctctcaagtttcctgtgctgtgctcatatggttttatatctagaaaccgttcctgaacatttctgtcacattgcttgtctgtttcgctgagaatcaataaagaagctcactggctgctcttgctcggcccagctccaacagggatctcgactcatggatgccaaaaatatccaagaacaacatcattgatgtctcttaggccctgttaacagatcccaccccaaaatttttcaccctgtcacatcgaacgtttaaacacctgcataaagtattaaatataggctaaaaaaataactaattgcacagattgcgactaatttgtgaaacgaatcttttaagcctaactgctacatgatttgtcaatgtgatgttacagtaaatatttgctaatgacggattaattaggcttaataaattcgtctcgcggtttactgacggattctgtaattagtttttttattactgtccgaacaccccatgcgacaccctatataatatccgatgtgacacaccaaaactttacacccctgatctaaacacccccttactccagattgagatggctgcatgccggttattttactgttgtaagtggacaattctactatccgtataaaaacctgtttactataaaaaaaacctgtttactagttcatttttctacatgatattttaaatttttaaaaacaaaataaactagaagtaaaataagcggacaaaataatcctacttttgcccgctccacttgcattcctatcggttattagggtacgtcttgattaacaattcagtttagcgtgtacttgtacaaaacaattcagtaaaataagtcttgattaacaacttacgcaagtgtgcatcgtatatatgatttagaagctgaaatatttattccattatcttaaaaaagttatcctaaggcctggtttagttctctatttttttttccaaaaacatcacatcgaatctttggacacatgtatgaagcattaaatatggattaaaaaaactaattgcacagttaggggggaaattgcgagatgaatcttttgagcctaattagtccataattagccataagtgctacagtaacctacatgtgctaatgacggattaattaggctcaaaagattcgtctcgcggtttccaggcgagttatgaaattagttttttcattcgtgtccaaaaatctcttccgacatctggtcaaacatccgatgtgacacctaaaaattttcttttcgcgaagtaaataggccctagaagccttgcaatattgcaagatgattgtgtactagtacatcgtatctgatagagtgaataaatgcgcatcagggtcgctgcttcaaaggagaacctacaatgttggtgtagcagtagcactcaatcctagcgcattaaccagcgacctactcacgggatgcagaatatgctcttatgcattttattgcatgcctatacatgttgctatcacgctaaaaataattacttaagaatctttagctctccagatacatatacatttggtatcacaacctttatcacaagtttaatggaaagctagctgaggattatggatatgcaggaatgatgcccttttttataatagaatgattgattctcctttgcaggttatctcattggttctgtttctaggctatccttcaaaagtcgggtttgcagaattttattgccgtggcatgccagcaattggaaagggtggctagggagtttttttttacccaagaacataagtgacgatctagtctatggattgatagctcttaatcattcctgtcatttgcttacttttttcaaatccagtgtgtgtttagctgtgtgcatcttagttatataaaggccaagagtgtttaatttcattacgattgtatcgtgatataattgattgagtttaataaatcttccattattaaaaaaagtactagtttcaaacggtgaaactaataagcacctggtgtagaattcagaaatgaactgatagacagaaatttgtttgggttcataggtttacgcaccaagtacactgttctttctgaaataaaaggactgaaatgatcgagtgcccggcccgtntgtggtatacggtggtgatgtactattttgccaaaacaagtatacagtaccacgaaattatggaagggcagcagcagcagcccgggagcctcggatgctgtaccatgtatagctggcattggaatcagccgtcatcgtggtcctttggattctttggacggtgcagattggatttgattggtcgagtatcctgttgacactggtcaatgcagagcacgccagttccaattgccaaaaggtgggcttcccacttgtcatgccccccccggtccatccaaaactgtgaaggttaattgcagatttttgcaaaaaaaaggaaaacattaattctaattctatgatgcatgtaaaattgcataagcaggagaaatttaagaaaaacatacgagttacttcgttagtacccaggggcggatccaggataagaaacgagctagcgtcaccacgcactactactttatggatcatatatagtatttacatatggatagtaaaaactgtaatttacatggcatgtttgaagatgcccttacacatttgtttccacactgcaaactatatatgctctgcaaatatatccaggtcccctacggttgtgcctcctccactgctgataccgagttgcaagcgggctggagtacgtaccaacttgtagtagttgccccagcctcccaaggctgccactatatatcaacaaatgcaaacagttatgctctataattggatcttgccatatcaactgtcccatatacgatccaacgtccttttcatcctatgtcatcactgcaccccacaaatggtccatatcccattttccacacataggaaatctggctgaaaaacttggaaacttccaaaataacaaatttatatatatgcgcacataaaaagaatattttgattaatgaagagatgcgaaactgatgagaatatattggttgtttaaataagattgttattgaatatatattaaaatagtagtatgcatgttaggatgaaagggtaaatatatggtgtaaaccaatatatacgtggaaaccatgcaagctacatgatggaagttctccatacgagaatgtttttttgatttttttcaggacttctatgcaaaagttcctaaaactttttgtcatagtttccactgcatattttttcatgcggaaaacatgctagtttcagaaatcaaatggaaatttcgatcaccgacagatgccaaattattacttcaaaagcatcatatcaatcaattactagtaccatataagaacctcagctgaaggggactcactatatattttttatctttatgcaatttagtattatctcagttgcacgtgtaccatgtagataccagatgagatgtgctacctaattaacttttttttttggaaaaacaacatatatgtgtataaattgtgcctgcaatgtgaccacttaatacatcagaaatgggcccaattaaaggctcttgtacgtagggggatgaacctaattagtaaggctcatgtccattcgtccaggtcactctccgtcctctgcttccacttggccaattgtttcagcaagatttcaagtgcacccgatgctgaatcgttattggttattgcaggccgtacccccttgattttaatggcaatacacaactgctatctactgtcacaaaacacatggtatcggaggcgataaggttttcaaatattaatgcagctttgacaactaaattttgtcataacatacttataaaactcgacaaaacatactataatgtacactatttttggggcgaacacagatactattttcatacatccaatcttacaatattaaaatattaagattgatgtttcacctctagaatttttagtgctctttgtgagtaatttttttttgctctttaattattgaacgggtatttgtaataagtggatgtaacttctttgaagcaaagtatagtccattatctcaaaagaaccacacactcacacaccaccaaatgcatcctctaacacacggcaaaggacagtggtaaatctctgccccttactaaacttctattgaaatcacaaccacatgtatgcttatattggttttgagagtcccttgggtcaataggactaaatggatcaaaacttctggtcaattatattattcggagtttctagatgtaaacaggaaaaaatataacttgtattagtaagaactatgctcaacatcaaaaaccatttgaaccaaacgatagaatgcgggctatagactaagaaaagtaaaacacccactagctcaaactaccacatgcatagattgagtcaagagaagtaataacggtacagagagaagccaaattttttcaccaaagttcggatccgacgatcctaaatattgagggactcataagagctaggtcgcattcgactggtctaaatgtgccaaacgaccacgaagataaagctcggttttgactcaatttaccactttcccttgtggagggggagtagatcattcacaatttttctcgggctctccacatgggttggaagtgcgcatgataagactaaacctaggggtgggcattcgttatgaccgaaaattttggtatcggtcttcggtctttcggtcatttcggtctttgaaaagtgaagatcgaatttcaacacaaaaatgtcaggaccgacaaattcggtctcggtctcggtctcggtcctgaccgaaatagaataacattttcatatacgcaaagaaataatggaaattttcaacacaaaaatcacaaaaaaaattcgtaagcatgtatgagtaaagactcttattaggttgcatgcctataagaagtagggatgtgaaaattagagtttaatcctattgaaattagtggattataggttgcatttaggcatattttgttaatttggtcttttcggtctattcgtttacccgaggaaactaaccgaattgatcgaacaaaattcggtctttcactatctaggaccaaatttcttggtctcggtctcggttttttcggttcggtctttttctgcccacccctacctaaaccacctagagccctagaaaggaaggcctccaagagtaactagtatgaacactagcttggcttcgaactcaagtgctcaagaatgaagctctcaaatgcattcaaatgcccaaattttatccaatctcacaaggatctctcttaatgcaaggtggagagtgagtactgggagtgtgtttcaaagaatgagccaaccaacctatcaaaggaggggaataaatatcccaactggccaactagctgttactcacaacaatttaatccatgaacttccaccctcctaggcctagaacttgtggccttttttgaaatatcagacaaaaactctttgccagaacttctggctacatcagctgctatacataacacttcaaatggatacccaacccctttgaacttccgaccaaccctgtcaaccccgaaagtgtaagtgttgtgaattttatatctcatcaaatatttcttgagcacttgagacaacgcatactacaccatatgcatgagagcctcttaatagtgggacattcctagactcaaaataaagagaaaaccgacgcttcggtgtcttgagtccattttccactagtcgtttcttttgtagggttcattgttgtttcaatcaacatctccgttgaagttgatccctatacatgtccttaataaacacgttagtgtactaaccgctttgtcatcaatattccaaaacccacttaggaggcctagatgcactttcagatttgaattgtggtgggtgaagtcatgcacctagaactccaccatcatacaaccaatgcttccaagaaattttgaaattttatttaggcaaaatttattacgggccactgaaaaagtgtggtctttgctagtggataccaaaataacgtgaaatttgcccaaagacactccaaaagtacgataatttgctgtaggacaccaaaaacattaaaatacaacatacatccaattgatgagagagaaaccatataaaatatcagttttgcccccatcttcttcttccttctcacagtcttcttcaagcaacatgcatcaacggtgaagctgctgtggcagctagagggcatccaaatccggttgaccgtgcatgctcaccccgtcatgaagtcactgccaccaggcgctgaaacccgatagacgatgcatgtgcgtgctgccgtgaactcgccactattgcaccctgccacctcgcagcctcaccacgaggtcaccatcgccccctgctgcgttgaggtcgcaggctgcgcacgccccgccacgaggtcagcgccgctgtgccgccccaccacgtagtcctcaccgttgtgctgccatcactcgcacacgtgccccatgtttctcgtgacgttgcagcccccccccactctgtagtcataagcgttgcaccgctcgccgatccgccgcaaggtcatcgccaccacgcggtatagttgcatcgctgcttctcatgccctccctccctctgcgggttgcgcatgagtggaatggatggaggaataagatatgggcaaaaaagtcattttatataaattctcaccaatctagtgaaaataatattttaatggcattagtgtcctataacaaattaccacacttttagagtgtgctcgagcaaattcatgttcttacggtgtctactagcaaagaccgcactttgtgaatgttctgtagtaaatttggccttttttttaaggcatgacctaaacaacatatatccaaatgtttgttacccgagggaatatatttactatagtgaaatgaattaacatcttgtaattaaaaacaattattaaaataggagagagatatatgtaaattatgatcaaaccttctctccatttgaacatgacagaaaagagaaaaacacttctatgttctcactttcttattagggctctatcaaatgcaagattttaacagggtttatgcaggaatttagattaaataatcctttaaaaatcctccgttacaaagaagaccttagggttctatgcatctcaaagtacatttaaggggaagttgtagaatcatgctttcaaagtgcaaacaattaccactaaaatatcttactaaaaagggtcatccctcgtctcctcccccttctcatgttgcggtcgcctccctgatgaaaagaaaaaaaaaccaactaagctcatagactatttttaattgtatggacttagtaatacatttggcccatccctaattgcacagccgattcaacgtccatgtttgttgtaattagttattatagaaaactatatgaagcacggtatattaggatgacatatgtggtttaaaataattgatcaagattattttttggactgtctaattttttttagaaaaaggccagtggcccggcttatattgaaagcccagtgcgggagtgtgctaggcaaagcccagcccggcttatgttgatgcaaaaaacacatcaaatttggtcgttaacagagtaccattacctacctgccactttgacccaagtttcatccactttcttgcacgaagcaccccaacccagaattgagaagctctatcaggggagcattggaacatcccaccattgtgtaggtatttcttcctcaatagctcaacacacaaactcttatcaggggattcaatcttaaacaactatttagctagtaaagcagtgttcagtattctagtttcagtaagccccagtcccccaaactctttagggaaagctagatcagaccacttcaccatgtggtatttcatgccttgtttatttcctagccaatagtatctaccactaattaagtcaaagttatgatgtaatcattcataaagttgatagaaacccatagcatatgagggatagaggataaccatgcattgatgtgtacaactctacctgcatgtgaaagagtattatcagatcaaacacctaatttcttctccattttttgagctaagaaggacggtatgcaaattaaaacaatcgaaaatcatgcacaccttttttgctttcgtcatcatgtatctaaaatctctattagagcaagtttaatagtatagccaactacttgcttcaaatcatatatagtcgatttaatagctaattcatacaatagttacatataacatatagtacacaattaatacctagattcacttatcataaacacatgtatcttggagcccatgctgtagctggctataaatctgtagtctactgctcttctctcttctcttttattttcttaaaatatgtttatagctggcttatagtctactattgctcctgctcttatattcttagagctgatcagcttgagcaggagagcaacatgaagggtacagtgcataaatatgaatccacgaaaagtataggaagaaaacttcagtgccatgagggaccccatatggggccatgctatacagctgaaatgtgcatgcctttaaacattcacagtaatcaacctcttagaatatattccaccaaaaactattatctcctcgacggttgccatgattgtacggacatgcatgtatatatagtgaaacagttcaccctgtcttttcttcagatataatattagtactcatcagtcgtcaattaaatttgaccaatcaaccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaatgacagtctcaacagtgtaaagtttgcaagaatgtgcaattagaagctaacataaacacaaaactagctatcatacatacgagtgaagggctggaagcagctaagctgaaagctcaacacaacatatactaccaatctagctacaaggccactccaagtcgcatatatactagtatctataagctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgtcggagacaagacgaggtaacacgcaagcgcagctagctgcatcgtatcgatcatatatatcaccccggcgccttcttcttcttcttcttcttcttcttcttcttcttcttcttcttcttcttcttcttcttcttcttcttcttcacttgttcttcgttttcttcctcttcgatcttctcattcatcttctgttgctgccctagctacaatgatcgatcgatggatgatccatatcatcgttgatccttcgcttcacatcaggttcatcattcctagctacatcgatatatgtacctataatttgatgatgagatgaacttcttcaaaattcaaattaatctctgaagaaaccaacggagaattaggatcagagtgtgctagctacatgtgagctagagattagagaaatttaagagtgtgtgttatatgtaaatatatcgatcattgccagatcgatcgaggcgaaactatagaattttgccttggggtttaattagccttaatttgtacccaaaaattgaaacaaatccgtcccacgcattgcattgggatgtgtaatccgggtttccatatgcatggttatgggaatgtgccatgtgtctgctattgctatatatagttattagtctagctacatttccaaatcacatgttaaatttgttgttctcataatggattcctctgttggagatgactgttcctacaatattatattcgaacttttatgatctcttactgtatgcttgcttcttctgcctacatttaacttactgtacttgtttagctagggttacagtaaaactccctcttcttaatttccttctaattacaaactcgattcttcaaacatatatattcagttcagactcatccaaaccgcctctctctataattcacacattgcatgccagttacttcctctgcttagttaattacaaaggagcacgtatgcacatatcccaagattcagtacgttagttttgactagcaaatagactcacatttagtgatatatgcatgcacaaagtagtggtaccaccactactgtaaatgtacttccaaatatatactcactatatcctataacaacggtatataaaaaatgagtaccactaaggaggaatttggttatcagataatagaaggaattttgagtgtgttgagattcagaccttgtagctgaaaccacataccctttaccacgacagcatctcaattaacggcagtatattgcaagtaggaatttatggttagagttcaatacaactaaaatatatatcgccttaagatcgagaagttatatatgatatggacagtagtgcagtgggtgtgcactttcagaatcgaaatgaagcctatgcgtgtttaaatatataaagagatattacttttcaggtattgagaactgatcagctctattgcttgcatgctagctagttctttatctcccaaatttaattaaccagtttgctcctacaggtaaaataaccatacattatatttctttccgagttagtttgtttttcggcttaattattttgcttagcccatcgaaccaaacacatcctatgggggtgtttagatccagtagtgtaaagttttggactgtcacattgaatattatatagaatgttgcatggggtgtttgggcactaataaaaaaactaattacagaatccgtaaccgtgagacgaatttattgagcataattaatccatcattaacaaatatatattgtagtaccatattgtcaaatcatgtaacaattaggcacaaaagattcgtctcgcaaattagtcgcaatttgtgcaattagttttttaagcctatatttaatactttatgcatgtgttcaaatgttcgatgtgacagggtgaaaaattttggggtgggatctaaacagggcctaagtatagtttgcacaatttaatttgttatatatagttgtatttggtatatagatggaatatattcctgagccggcaatggaggacgaggtactcacgtgtggtacggtcgccggatgcatcagaggcttgggagagaaaatgtttagaattttctggatttttcaaagaaaaaactataccaatgcagcatgcttcctgctattaatttccatgaatttaattggaagcatagatcaatcatacaaaggttgcaggagtatctacaaattatcacaagttttttgagtgaaaagtttttagatataactaatagtataactgtgaatgaaccgagctcgagcgagcccgtttgcccaggctcgagctcgacataagcttgagccgggcctattgcaccttcgagcttttagacaagttcggttcgagctcggccataagtaagataatatatattttaatgataatctcttgataagtataattattttctagttaatcacactaataaaagagtagaaaatgattaaaataaatatattgtgctaacacatgctaatttattgtgtaaattgatattaatatatatatttatctattggtttataaatcaataaggtgaacaaacaatataaactatatataattaagctcggctcggtaaagctcgcgagcttttgctcaggctcgagttcggctcgtttggagcttaggccgagcttgaacagagcctaggacaagctaagctcgagctgctcgcgagcctcgatcttttttgatagccctaactataactgtgttgtaaccacactgtaactattatataacttatataaaacttgtattcaactatagttaatttggttgcttagtacctgtattttacgcgtgatatgtgtgaaaatttctttctagcaatttttttcttgtatatataaatctcgagatgatccgatggccacaaatctaaaaattttgaggataaaaaacttgcagaaattttctagcaatttcgtattgttaattagacgtggatccaacatgcatgcaaggtccatgatatatgagtagctagtctcacttatcatcttcatctacagtatataaactccataacacaaagccagccagcaaggaactgtctatgtgcagtgatcataaagtgaagctaattaaggtagtgaactaccttaatatcataccatacgttttgtgtactcctcaacgtacacaatccaaggattacctcatccttggtacgtacaattttatgagatctattattgtctcagctgtgactatgcaactatgctgtgagggccacaaattctttcccacacattttgatctaatggaaggttgccattttaattatttgggagttaattaacttgactaaataaagttattgtacatcttattcaaaatgtggagccgcagtttggacgcgtccatatttgatcatattacaaattaatttgttatatatatgcatgtcacaagcaatactatgccacaaatacatatatgtatacgcgtgtgtttgtttcgattggaaccacaattaagtgagttattctgagcatgcactactttgtacgcatcaccttcagaatgctgcaacaatttaattacttttatagctacattatatatatatacttaatctactgtacgtcccagttaattgctctgcgctgatatatctttgtacatctgatagtctcgtaatatactcaatctgtcttctagcattcatcatccggaggaggcaggtgtttagactgctttctccttagctcaatggactttgaggcccatataataatctaagtatctaatgtatttaggcctggcccaacctaatccaattcagcgtaaaaaaaaaaactaatccaattacagtgcattgtaattttgctgactgcatatgcagccggtcttgcctgtatgcttgcaattgatgcacactagcagaaatgcagaatgcaggggaaggacaagaaagttcatgatgtaaatggtgtgtatcaaatgctaatcatgatcggtaattagcagacaggtgagctgcacatcacttcaattatgggcaccaattttgggacgaaggtgtagtactaatctgaactatatgaagccatgcatttaattttgttgtggacttgtacgtggtacagtcgatctagtgatgatacagtgtttaagggattttaactcttcatgagatgtcactgtgcagatgtcatgctttatttttttagtgaaatttgctataagacacttaaaatttgtgtaatttgcttgtaaatatcgtaaaaatatgtcacgactgaaagacacttaaaaaacaataattttgttacgggacactttcagttcaatttgatagagaaattcttcaaaaagacgagaatgcccctcgggtcaaaagcttttaagccgagtttgaagtgaagatggcatatgatatttgctagtgatttacttctggtgatgacaaatttagagttgcataatttctaaatgtttactctaacaccatgtttaaagcatgtgttcatagggacattcttgtctttcttaagaatttgtttctccgattgagctgaaagtatcctccagcaaattaccacctttttaggatgtctttcagctatgacacgtgtttttgatgtctattagcaaatttcacaagttttggatgtcctgtagcaaaattacctattttttaaacttggagaaattatatatgttcatgcctcatgttgaactcaaacgataacttcatccctagttttcttactttatgtttcctcttatttttaaatctaaatcttgtgtttgcccatattccatctgaaggagtacttaacaatgttaaaaacatcgatgtatggtcttgcaaatttaccacaatttttatgaggactttgtaatttaatttcccccttttgacatcaagccttttgacatgcattttcacaaatctagttaaaaaaagagcaagcacaaacttttcatgaattttaccaatgtatttaacatgagttttcacaccgtcaagtcctcctaattgaatgggaacaatcacaagcatcacttcaaaaaagataccaaaataaaaacaaatcaaaactagaaatgaacagaggggtaagaatggaattgccccttaattttccttgttgcatattcatggctacagtacatttagccagagatgcatgattatttcttttggattttaatcatggtcacttatgttgcatgagttgcgaggtaaatacatctattgaggcactactaggaaaacgattttcgcagacgaggtgcgtctatcttcctaggcagataacattgttgccatcatccgtccgcctgcaaaatagggaggcgggggatcaagatggccgtccgcttgcaaagatcaatcttcccatgcctttgcctacaggggggcgaccgtccgcctgggaagacaaattttggtctcctgcaaaaatggttttcctagctagtagtgaggtgagaagggcaaccactatatttaccatcttgctaactagtgccccacatgttgttacgatatataattaaattcaaaatagtataaaaataataatgaaatttgtatatactggttaaaaatggtgtaggcattggacatcagctctcctagctgatcgagttgtaaccagtgtatatgtaagtcgtgggtgttttcttttcttcttctttgtggggaagggggggggggtttatcaactacaggtagtgaagtttatctgatggttcatatatacacgtaagacatgttcaagtgtgcattggtttaacaaagagactaaataataggggtatctgtgaaagctcacacctgtatgaactgctcaattggagaaacgaggtaggatagtgtcactactactaaagagaatataatgtggaatgagagaattgctccttgagtgtgtgttttgagagtgaataattggtctccttttatagctgcttatgacggtggttaaggtcggtaactcccacaaccgtcattgggaagcaaccaggagctgccacttggtttggccgacccctgggccccacctctctccaccgcctttcaccagagattgacatgtgggtcgctaaggcagtgcacgacggtttggccccactctaagttggtttgagctgacttgtgggcccatcaattcatttgctctcatgtgattcgccagaggtgtgtttctttgaatgccggctcatttctccttcaccttagtgtataattcatgcacccatagtaattctccaagacaagtggaactaaatttacttgtaactaatatacgtgtaagaaatgatagttctctctttatttattgaggtaattgacgtgtcaaaattggtacttaacgaccgtcaacagtcatgcaactcagtcacccaaaaaaaccgaccacccctccaactctcgttactctcatgtaatcctgttggccacgtcctcctttcttggccataattgaagaggcgatacaaaacgacaaggcaaagatgtccccactgtcgttcctctctatgcctccctcaaagatgtccccacctccacccgtccccaccctcgtctgaggagatggtcacccttcccaccactattcccctccccatccctgtccttgtgtgctagcacctatcgccgagggaggccaccgcgtctgcctcgagcagtcgccattggccagagatggaggccgcatcaacctccattcatccccataggggtggacaaaaataccccgaaggctgcaaactgaacaaaactgagctaaattgaaccgaagtgtcgattctttggggcataggtttacccttcgattaatgtattgtgtttgatcaatctatggtcttttctacggtttttaattctcatgaaccggacaactcgaggaaactggaaagtccgaaccacaggtccaccaaacgttgtatagcgacaaacctggcaatgtgcaagctttaaggctcaacacccaaagcccacatatctaacaataatacatctcctagagtactccagtactgttcatcgttgtttcgtaatcgtgcgaagccgtggccggatttctaccctaccgccgcaaccgtttcacgggtccgtgccgctcgccgcccccagctcctttggacgactaccctgtgcaactgcgcatacaattaccacatagctcggtcatggtctactagttgcccaaacctctccaagttccaagactcctgctatgtgaggtcagaaaaactccttgtctcttgatctgccattgtatgtgtcatcaagtgatttctttgagtatcttgtgctttggaattcttgccaacgtgttcccacgatttgttcggtaaaaccggacaacagacccaaagttactcagtttactcggttcggctt

SEQ ID NO: 13128 - DNA, 3329 bp, Oryza sativa
agtcccgattgagcggccgaagtcactccttggattaggcttggccagccaacccactcatagggcggttggtccaccacctcacttgggcttgtcttggtgaaattgggttaatggccaaggcattggacgtggtcggccggcctagtttaacttggtggctgacccttccaaggggtccaaaggccctccggctaggcttgtcttggtgaaattaggttaatggccaaggcattggacgtggtcggctggcctagtttaacttggtggctgacccttccaaggggtccaaaggccctccggctaaggtggtgaccagcctgattgctggcccttgttctaggtcggtcgaccaccctcggctctataggatgacggctctataggatgacttgtttttctggtcgtcgtatctgcttcgtccacactccaagtcacacgtatgtactaagattacacacatatctattcacgttccttattcgatctttctagttttgacttgtttaatttttttttcatacacacacacctcccatgcacatcaatatagaaatctcaacttcatgtgcaccatgattaatttggcatattattcatgaactgtcttaaccctcataaacctcaacattttggcatattttacatcacaactttcccccaacttttaatcatttacttctattttttgaaacatatatgatttcaagtagtaataatctcaagttatatgtaagagcatatttccaaagtttaatctattttttgaaacatatatgatttcaagtagtgataatctcaagttgtatgtaagagcatatttccaaagtttaaccgttcaaggctcttatcctattcaccctaggagggctaggacataggggtgtatatccagtataggatcgggtctttcccacccaaaaagtagctaatgaaatgagagactcccctacttatatattacatcatttgtccttccataatctatgtgagactatttaacgtatcctaacagataagtataaggtctttggcagcgtcgtgagacaaatacatgtggtgccgacatagggaaattaagctggctagatagctagctagggatgcaggtgacacgtcgacggcgacggctagctgatgcatacattggtacggttgatcagctgattaagtgtcccttaataatttaatgtttcccgatatgatcaatctctctaaatatatcgctaattatacttgtttttttcttcttcttctggcaggaattcaggctcgttcttaatttgattggttcatgaacccctgcaccaacatagcatgtctcaattaacgtacgtgtgtaccaggctaccggtagcttaattagccagtgatggaatttgattattaatttggctttaaattagttccggacaattccctgatccatctatctatcttgtgtgactatctacttccaattaaggcccccggtcggcagatggcaagagtaattagcaaagttccacagtacagatgctccctaggcctatatatagtttaattttgcgctcgtactagctagatagatatcgaagatatatacctttcagctcactactgtttaacgttgttcggcaaagaggagtactcaccaaagtaggcccaaaccgaccaggacttaaccaacagctttatattcaattgagaatttattaatttcatcagcatgcagctgctactggtccaaatagagcagctagcatgaatattgtgtactacagcccggacctctctcgatcgatcgaatatgcaagctagatgccaagatctatcgatcctagctacaccttagctgtttccatggagatgcaacgcttgaatggcaaatggatttttgaaagagggtgactagctataacttgtctctgatcgatctctctctctcgctaatttgaagaaatggtaacagagagttactgttgatatgattcactgaaaggaggatgcttacaagaaaacatcgagtaactaacaaggtggtgtaacctccgcatgttagaaggtttcaacatggcgaaaaattatggtgtgtttcacttctttcatatatatttttctaggtggtttaacgacggacaatttttacgatgtggttttactaaaactagaatacctacatgtataattgacgagaaggggtaccgtgttttcttcttaatctttaactagataggagctaaaggtttagatgatattatttgattgttacgatttatacttttaacttttttagggggggtgtatatataaacatgtaaggaaatgtaatggcaaccatacataaagacaatcgaaagaaagataaagtgattaactagagggaaatatttatttcaagtagatctacatatgaaaaatcagagagttaaaaaattatgtcagcattaggtttcatgagagaggtatcgtaaacccttctttgctttttttttttcgggtgactggtggggagatgagggtccttagaagaggtcattgttagataggttcccacggagttcgtctatttctacacttattttaatactcatgctatatatattgttagatacttgacaaatatggaaggtacacctgataactagggatgttaggatacgtaaaaatgctgtaatactagataaaatttgaattcaaactcaactagcttttaattaattttgaggttttttgacatatatagtatgtattccaatcttgtctcacctataaaacactaataatacaaataaaagtttacacacaagctatatatttttcttctttgtttaattttttatggcttatccggcgaatctacgtagtgtttatcgggatcacatgatcccaagtaaataacttaatgctaactaatttatatcatattaattagtactatattagtagttaataattagagacttcctccattccaaattgatctacatatagtttttttttaggttatttctaaatgatctacatatttgtgtttatttattaaatctatttgttatttgtgcattggagtaaatggacattgaggcatgcatccatgcgcacaagtatttataacccacatgcaatatcttgatttgctattggctaggaaatagtggggatggtgcatgcttcgagtttgttgctagagtaaatatagtatgagagaattattagtttttttttgtcttggtgtacctatgaaatatgcagatcaatttggaatggagagagtaattgatatctatagaatcctcgtaattttttctaggttcgtcactgggcttaggctgtgtttggaggagggg

SEQ ID NO: 13129 - DNA, 3017 bp, Oryza sativa
aattcctgcagcccatggccgtcatcttagtctcccctcctcaccccagtaaaaatattagaaaatgctttcatgcagttatttgtattaaatttataaagtatatatagagtagtgtcggagagtgaacttctctagcagggaaccatgaggccctcctttgtgagttcggccgggggcagcgggtgagattcgagagcttggtgagcgatgctgtgtgatcttgagggggttcaatcccccaaagacgatgggacaaaaggggtttatacaggtttgggccgctaggaagtgtaataccctactcctgtgcttggttgattgagtgtagaacaccagtgcttgaggttgcaagacccaagcgcgagttcactcggaagttcccccctccaccactaggcatggacctccttttatacctcaaggggttaccacatgggtccaacaacctaacctaactccggtggagaagtattataatctttgcattaaatgcatgtctggtctcttgacttgggaagccaagcgcacgtcgtcttaatgatggggcctgtcaaatcttgccgcctgacacggggggtgcccttgtcagtcaccatttaatgggtaaagacttctgggctcctattacaccgggaaacgggagcattgctttgaccagagcgggaggaccgactccgactggaataagaggatgagaacctctcaccatcattatttgatgggacatgtcgggctgcacgtcgcctgacacacgcgatggtgcgcctgacatcctgggtcccatcagtcattcaaccggtcacagaccggttgagtgcactgcacaccgcattaaatgcggcgtggcgcgaccgctcgggtcgccacaaatgcgggtaggtgggcaccttgaggcagacacctaacccaccatacgtggtgacctagagagggggtcggggctgcccgacccctagtgacgggagggggcggccgccgcccgacctcgggcccgatcccccctcgggggagggccacatggcgcctggggcagcctcctccatccattctatgggaaggagtggccgccgccctaccttgggctcgactcccctcgggggagggccacgtggcatcggggggcagcctcctccgtttaaccttttgggaaggagtggccgccaccccacctcaggcctgactcccctcgggggagggccacgtggcatcgggggacagcctcctccgactagtctttgggaagaattggccgccaccctacctcgggtctgactcccctcgggggagggccacgtggcatcggggggcagcctactccctctaaacctgataccccggacccatatcaccgacagtagtaattagaaaaggcgatgatataatatgcgtaataagaactggatcaatgtcgtgctaaacgacaagaaagtaaattaaaggaatcagtaattctttcagatcgacaagctgctagcagggatcgatcatcgagcaagctgtcagtcagggtggcaatcaatcttcaaccatcaacccggccatcatcaactgactttcagtacattcccgggctgcaactttttgtgggtcgatccctttgatgaatatccagcaggagtaattaattagctcctcaacaaagaataatattaacctcacttaattagtgtgtctccgtttcatctgtccatcacatcatatcggcacagctcgatcacacattttattagaaatgaacatatcaactcgaatgggtccagcctgcctgccttttctgaatgatctctcatccctattcacaatgaacaggctagcatgcatatatgcagcttgcagcaatgcaagtagcaagagtgcgccagcagaaaacttagatgcgatgcaatgcatccatccatccatccatatgtatgcactgcatctggcaacaatggcgatactgcccgggaatgaatcagtgtgtgtgggggggggggggggggcaaagagagttgctgctgcatgcagcaagttggccaatggcgtgcgatgcaaatgcatggctcagaatgatcgatagccatacagtatatatcttctctactgttgcctactgttgcagctggcctggctacccctgcctgcctcttgctaattactgatggacagattgatcatagtacattatatatgctaccgcctccatcccaaaataaatacagccatagatatatattcagcatttttgagcgtccgtcttatttaaaaattttatgaaaaaaattaaaaatattagtcacacataaagtactattcatgcattatcatctaataataataataatactaatcataattatttttcaaataagacgaacgatgaaacattgagcatgaaccgtgttaaaactgtatttattttgggacgaaaggagtactcctaaatgataccatcaatattggcagctgaattgcacctggtattgggggtcagtacaccagtactctccagctgctccaattttgactgttttcagggacctaagcagaaaagaacctggtataatatcccacttgcagacgtaggtaggtccaagcccatatggccatattgatctttgtccagacattttccaaactttgcagtgatttctctctctctctctctctctctctctctctcttttctttccaaacagttgcatcagatcagtgcctttgtttcactgtaccttttactgcgttgtgtacgaggcaccttgctgctgtcctctggtactgtgcatgttccttgtctgcttgctgtggacctgatcttcatttgggaggagaccgacttcttcctcttcctttgtttgcatgagagacgctctgaatcctcagacctgcatgctgcacctgctttatgtaggagtgttattactggagtatttctctatgcccacaagtaggcacacaaaatgttaattctccatgaaaacctggtaaaatggaccagtacctcttgaccaattgggtaattaactaaccccacg

SEQ ID NO: 13130 - DNA, 6764 bp, Oryza sativa
atcctagaaatacgaatatggataaatacatatccaaatctatagatatcaaacccgatcataggtttttatatatcggaacgaggaagtaaagtagagcagaagacgacaaggtcatccagcagcagtggcagcaataccagtggcagcatcaattcataggccacagtagcgatccttttctggatccctccctgcagccactggacggctggaccagctagcttagctagcggcagctgatgctctcgtacgctgatggatgcagcagcatgcactgcacacacacaaaccacccgggccgcggtttctagcttcccccccggtgtgtggagatgagatgatctctctctctctctctcggccacagccacacgggccgtacgttgcgcgccgtggtttttggatgcccaagttgctcatccgggatggagaaggacgcatgaaccgtaaggttgtctcgctatgatgttacaggacggacgaaaatttttcggtccagtactcgaggagggttttattgaggggaaacagctcgatttccggggttcaccggagggaccgggtaaaaggatgctacccatattttaattggggtccttgtcgtatgcttatatatatatatatatatgtatatatatatatatatatatatatgtatatatatatatatatattaatgatttgtgcagcgttctggggtaggctttttcttattgcttggctacttgtgtacgggtgttaaggaaaatcacatactaatagtagctatcggctttaatttagacctgactactctcttattatctggaagaactattattaccttctcccttattatgtatttgggctctatttactcgctactgaagcctatggacctccatgtcggtcgtcttttttatttcagccccactcgtcccactagcgcgctcctactagccgctcgttgcattcttatctcctttaacccctgaaattctcgtacgtttctgatggttttcgcttaattagatattatcaccatgatgtcgattatatctacatgttgcaccctggtaagtctaaaatccaccctctcgatcaccatatatactttgttcgacgcatccacatgttgaatttctcacacttcaatgtcttaaaatgaacccctaggcatcgtgtcttcctggtcttcggtggtttcagacgccagttaattaactgctcggcaccatcagtcctgttgccaaccgcaggttcacaaccatccatacgtaatcccattctaatccctatttgttcatcttaaatatatgctacttttttcactcccatcctaatccctattcctgaactatttctataccattatgattaattgctgagtttaagagcctactaatttcctttcattccatatcataccatattttagtttgtcctaaggtaaaactggattttgaagaaactaatttgatgattttttaaaaaaataattgaatttatttcggccatgacttctgataagctacatctaattattatagaatttgcaggagtaatcattgcgaattacaaaattacaacttcactagaagcaagaaaactactaagaaaaaccacccaaaagacagatatatccatatatgattggtcaaagtatgcataaccattgtttgcaacaaacggcttacaagttgtatgtggtccttatcttccttgaactagaaatacaacatctccgaaaccagcagtcgatcgaattccgcctccatcaccgttagcgaatgatgtttaaccaaaggggaagaaaatgttggggactagctgagcggtaaatcagtcattagttcatatcttagcaccaccaaaggaacatgatcagacggggataccgcagcaaggatattgcgctctaatttagggcctgtttggatgcattacatcggttgttgggacactaattgtaagtattaaccgtagactaatgataaaacccattttataaccctggactaattcacgagatgaatctattaagcctaattaattcatgattagcctatgtgatgctacagtaagcatgtgctaattatggattaactaggcttaaaaaaattatctcacgaattagctctcatttatacaattagttttgtgggtagtctatgtttagtactccaaattagtgtccaaatatccgatgtgacatggacgtactacattttattctctagatccaaacaccaccttagacatgaatttgtcctttcacttggaagacccgctaccttcttccttattatgtatctgggatctatttattataaaagttagtcgatatagtagaatgacgtctaaccttctcgatcacttcagtcattgattacccaagacacgctagatgacaatatagcagcacacgatatttgttaacgagattcaggccaaacctacatcctcgaggttctgatgatgagcgctcctcctcaatggatatagcacctaggctctacaagtacatggcctcgtcgttatcatctccctacgtgtctacgctaaattgtagtcgttacgtttacattgtggtgtctccctccctatttaaagaattgtcgggttacagagtccgattctaattccaccccttaccacctattacaactctaaatccaattgtaatcaaataggactaatatattcgacacctattcactattcgctctctagtgaagcctacaaacgtccatagatgtagtcttcctcatttcagccccgctccggcccctctgttcaccccactagttcatcccatcggcctctcattgaatccttatctcccttaggtccccgagaaatctccgtgccttttcatttttttaccttatggtttccgtaattttttaattgatcataaatcttactagggaaactaatttattaatttgatcattttcagataaaattcagtccatggttaactaattaattagtaaatccggaaaacaaattaatccagccggtgcgtgtacgtctgtccaaaggtatactatatggaaccaaccgggcatgcatggtggatcggcacgcacatacagtatgtctcaagtactgtacatgacctgtgacgactctgtgagtatttttgtttgtaattaaataaagttgctggatgagccggaacaaggggatggaggccggattggggcatgcatgtacatggtcggcagcagaaaataccaggtgcagcatcatacgtacatatcgatggacagcatcatcatgcggcgggcaaagcatcgcatagccagctgcactagcactacgttccagcatcatccatctgctccccagccccaacacgacaaataaaagccggagagagagagagcaggtataatagataaacagttataaatatattttaaagagataaaagaaaagagagaaaagtaacgggctataaatttgtagccagctacagcatggccttcaagatataatgtatgtatgatagataggaccatatattaatagtatagtaagcaactattatataaattgactattacatcgactataaatgattttagagttagtaggggcctgcactgttaaacttgctcagagagagagagagagagagagagagagagagagagagagcgcgcggcgcctttggttttggttttggtttgctgcagaggggggctgcatttggcctcttctcgctttgcatttttgtggcccagccaagccgcctgtcacctctcccgcccacttgcccatgttgcataccggccgcttccacatttcttacatgcccacgcacctattcatgcatacagccggcccccaccacctgcccaattggacattaatttgcttttcattttgtagatcgatatcctcaaaaagaaaaagaaaaaaagggatggagagggccggagatatatttcttgtaatgattattgtttgccaggtttaatcctctgccatatctagcttgaattttttttccaaatgggctctgaattagcggtcgtgcgagttggaacttggaaccaacgaccacgcgacacggtactggttaggagacaatcgcttgactatagtggttcgatttttcttaagttaatgttttgtgtttttagtcatcgagttaattgtttgaaattaaaagagattgttaatttttcttagagaaaaacacccataaacacaaaaagattgttgttttcccccctatatgttgttattttattaccattaattaattttatatttcttttatgtgctgccactatcagactacagagcttgagggtgagaaaacattagaaacatattatggagtattcagttttccaacaaaaacataattactgccgatcgataacccatagttgtagccttgtaggcgtacacacctagcaaccaccgcctctggctgcaggctgcaactcaatgcatgggaaattaatttttagttccccaaaaaagagatttcttaattttgaattttatgaagttttatttctgagaaatttcgatgttccaaatgagttctaaattagcggtcctgtgagtagaaatcaacctaagtagaaacactggagcggtactaagttagcgacagtttgcatgttcactgtaataatagtgttcccatgttttacgtctttttagtagcaagttgatcatttgaaaaagaaacggctgtttttctccatctctaattttatcctggtcttaataatttttctagtgcactataaaaactactggtagtaattattaagatcgtttaccacttagtttaagataatgcttctgattctctgcgatggctcctatggagatagaccatggaaacagtcttacagctgcatctatcttatcaagacatgagtatacacgtgttgtggacgtttgtgtttgtattgtgtttgttctctgattagaaaaaaaattatactatactatactatagaccttgataaaaggaattagtacaatcaataaattgtggttaagtattttattagtggttatgtaaattaaaaacaacaattaatctcttgatatgttggagaacacatgcatatcaatttatagtagtcttctcctgagaagtttcctattggacgctagcttatccatcagaatataattatgcctacttgcagcctaaatgcttgacacacccatgattcatttctctttctaggaagaaagtttctctttctaagaaccttcttccccctcacacctaattatagacgaatgcccttcgctttcttcacttgtcacaattctgggcacgctttttttagcttttcttattgctagaaactaattttatctgttcctttcttcctccattttgaacatacatatatcacaaaaattccgcccaaaaaataaatacatgttgaacataaatatatacgtctcctaaatttcacgttgtttagagctatgtttaattaattagatgcatccagttagtattatttttcttctagctttttaaattttttttttgtttgctgtcgcggccgccataggattttgcaccttggtccaacagtttttgatttttaataataaattaatgggtgaccagatactctgatcaaaaagattaaatagggatgacgcacacgccaatccgctcaagtgacgacacagtccttgacttccttgaagcacgtgcacgtcaaaccggttagtattatagactaattctttctgtttatgtcactgctaattttattttatctttaattagcacagcttaagaaatcaaattaattataccataacttagggcgtcgatgttttttataattggactgtgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaaacatatagtcaaggaataaataatccaaccaaccgagtggttttgataatcgtaatcaaccaagtgacttgatatcaatatatagcatatgcggtgtgaatcctccaaataacatgatccgagtgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggt

SEQ ID NO: 13131 - DNA, 21736 bp, Oryza sativa
cctcttttttgtacaatttaacttaatctgcaatgagaaatgatgaaaaaatttttgtattagttttattttgctatatatgagatgaggatgatctgtgccgtggtctttttgtgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgatacccgacccccccccctttcaggggtagagtagaagcgacgaaggtgttcgatgttccacgggtttggcagctccgtgccgtcgcccatggccagccgtaccgagcccggccgggggacaccgatcactcgatacggaccctcccacattggtgagagcttgctcaatccagcacgcgtttggacgcggcgtaggatgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggctcgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaaggcacttcaggaggattccgtttgccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgaggcggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgatccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggaccgtacccccggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggcttgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcgggccgctgccatgcgtaataccctactcgtgtgtcttgcgggcagacgatctttccagatacagagggagagcgagagcttgagatctcaccctaagcccccggccgaactggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccctgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcatccagggagagaaattggagtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcctggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgtggcttggccccccggaggatgcactgggctcggggatgtcccccgggcccgtttggtcctgggcgtcgcccggtgaggtaggcccaggcgatgcgcccgcggcctcgtcgcaagccgcctcggaggatgtcgcctgagggccgcccgagggagtaggcccaagtgacgcgccagcagcagctgtcgcctcagcctggcgagaccgggcggcctcctcccgagcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgttggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacctccatcataatggttagaatggaggcgcggtcgggatcgctgcagagggggaggatctcctgaggaatgcgagatgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtaacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaatccatattgcatgtatccagagcaagtccaaattgaaggtatgatacttgtgtttgaactagtaagcccctgagcacgtagtcacaattgttcattgatggtagctgacgcaattggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagatcagccaacaatgaatatgaaggcgctcagcaataaagttgtgtaactatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttcccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcgacagcataaccagtcggcgacggaaaacgatgatgtttatcagtagtggtagctgtctaaaccagacgtagaggtgagggcactagtcagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccggccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcgcttcccaaacatgcatatgagtgacatgagtttgtcattaatggaacaaagtttcacggatcagagtttactactcgggtacttttgcaattgttaagagcagaaaataaatttatctcatctctatacttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaatttgtttaaaaaatatgatataacatcaatagcccccgactcactaatcaacggcgaaccagttgatgtagtgaggcagaggaagagcaaaatatcatataaagaatcaatgatgacttagctttgtcgtattccctcggtgacagcagaagtagccgatgtgggaacgaagcagtccatcaatggtgacaaaaacaccagtcggcgccagtggaaccaagccagtggtgtagataatgaagcccattaacggaggcgaagtccaccaaccgtataggcaaaaacaccagtcggcgccagtggaaccaagccagtggtgtagataatgaagcccattaacggcggcgaagtccaccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcgggccggcggtgaggtcgtagacgcccaacagcggcggcataataggccagccgtgtaggcggaggcaccactcggcggcgacggaggcgggccggcggtgacgtcgtagacgcccaacagcggcggcataataggccagccatgtaggcggaggcaccactcggcggcgacggaggcgggccggcggtgaagtcgtagacgcccaacagcggcggcataataggccagccatgtaggcggaggcaccactcggcggcgacggaggcaggccggcggtgaagtcgtagacgcccaacaacggcggcataataggccagccgtgtaggcggaggcaccactcggcggcgacggaggcaggccggcggtgaagatgtaaacgcccagcaacggtggtgtgaccaaccaaccatataggcgaagacaccagtcggcggcgacggaggcaggccggcggtgaagatgtagacgcccaacaacggtggtgtgaccaaccaaccgtataggcgaagacaccagtcggcggcgacggaggcaggccggcggtgaagatatagacgcccaacaacggcggcataataggccagccgtgtagacggaggcaccaatcggcggcgacggaggcaggccggcggtgaagatgtagacgcccaacaacggtggtgtgaccaaccaaccatataggcgaagacaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagttagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagactggtaatcaacgttgatgggaccgctttaccggccgatagccattgttgtcatgttgcaccacaagaaaacaaatgacaaattaaaccctttgttttagagtcgttgtgcttgtgcagttcaatctcactgtgcttatcctgacaatatagttttgttttttacgataaattctcttctactttattaaagtattccatttaattaacatcttaaactatttttcggtttatttttttgtcatttttagtttagttacttaaaaaggttcacttttttctataatagaatagtatttaatttggttttgtttccttgtatataagtactttttaactaagtgagaattttgatgcattgcaacttgtgcctcaacttttttttctctggatttcgtattcagtttctgcatactaaactttcatgaaagatatatcttggaactattgtatagcacaggttatattctcattaatggctctacaaaatgaccaaaaatattttagaatgctaagtgaagcaaggaatagttgaagggagtaaaaatatgtttccctattttttaatttagggtgtgtttgagaaaagagaaatgagaagattaaacaactttcttatagaaatgtaaaaaaaaaacacacatgtttagtactcggatgtttagttcgtgaagcatccgagtgaaagatggatttcttctccctttatcctcctaacgaacgcatccacactactgtataatcatctgaattagtctttttttaattttctcctttcatctgaacagcatgataacaataattaatggagataccgtagttatatatatggaaatttaggaaataatttagcagtgatcgactgcatgaataaatactctgaaacgacatacttatatctgcaagttgcggaaaataattaaattaagctagctactctggataagtcctgcacgaaattcattcagcagaacagtcaataccgtttgtttcctcaattcttatactagtgtgaaaccatgccgctgaaagaccaggatggttgcataaggaagtcctggccatattgaaagaagagcaatgcattatgcatatatgtctgaaataatgaaaaagataggttgaaaacagtaagttgattgttagtgcatatttatatatatattcaggatttttaaactaattaatgaaaaaaaaatgaggagtaccaaagaagatattctcctatgcatatccatccccttgggttcctacctagtacggccggacaggcaacattgtaacatgcatcaagtacattgcatcacacccccaataaagcatccacatcaccatccagcaacttgcatgaaacaaaaaaaattaattaataaaaaaatctactagcacctcccaaccacctgtaatatggtgctttgatagggaccaaaataacaaacaaaaaaaagaattccaaaaagacatggtcgatcacttttcataaaaaaaagcacagatatactaccattaaattattgtaattaactaggctcaagatagatagacgtcgtctctactactcctactagaaaacatatctttgtccaagcaaattaacaaaatcaaatatagcaagaacacgtttaattttgtacacatgctgcgtttgggttggtccaaataaaatacaaagaccagtgtctatatatacagagcacacgcccacagcaactatcactcttcatcatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccaaagttgtcttcttctgttcatctgatgtgaattgaattaattagattccacagaattttattcttcgcaagataattggttatgctgcacttattattaatcgtactatttgctgatgctatgcgctgagtgcgtgtaacaatattaataacatgtgtaatctatcatcagaagatatcatacatatatatggaacactaatttggggattcaggacgacttgcacatttctttttatataatattcagaacactcgcgcgcgcgcgcgcgcgcacacacacacagatatatatatatatatatatatctatatctagctagaaattatttgagttattaacctgatgatctttttctggtacttcctctcttatatatctcgaaactgtgctaaatttaattttagcacacttgctatttgctatttcttggttgagcattcagattgttcgaattgatctccatttgctatatatcgatttaataactagtagttaccacactctggtagtttcaaacttttgttttgttaattagacgagtaattcccatatatctgtactcaaatggagcaaagtgatctatctcttgatggagttttctacttcgttttgttgtattctatgtcactgatctttaatttgcatgtggcccatattttcttaattagctttttgtcgtaaacaaattccattgtggaatagggaaatcatatgttacttatcatgcacctacagtgtttcccccccaaaatctataactacagtgctagctacctggggttactatctataaaaaaggttacttttgctttaaattgtttctgtttatattgttcaaagttttcttttataatctttggttatttggcaatgtgatcataactgatactttcttcaccagtataaatcaagtgtgccttcacgacaactgtaaaatgcgttgtgtttcaagggaaaaagcttctcgccgaagaaatttatttttatgttcttaggaagtatattacgatcgaggttgagtcatctcctagtatgcgttagtccagatctttattaatgcaagttatattttggaaaataatcttacgaaactaggcctatgtttagatcctcctcctcaatgcaaagcactggctcgtcgtaaaactaactgttttggatggtagttaacctattcgtcatgcttttaggacagtctaaatagaggcctggtctcataggaattatttttcgtatattatagtgtataattatgtttcttacccttctatacggtagaaatggaagagaataaattaatccttcaaaaattttatgcaatgaaaatatctttgtagatgtacgtcatcatattttcccccaaatacatgttatataatattttgataatataataagttaatatgttgtaaaaggtataatactaactaaagtatgagaaaaaaaatgatggttttatattaggtctgaagaaattattttatttttcattgtagaaaatcttttcgcagtcaaaagcgatcatagaacaagcatacttaaaaaaaagatggatattgtaatatatatcataagtgctaacataacaacaaaatgttgttatttattttagataatggaatagaatcttggcatttgctcaacgagctacatacaattattacaccaattcaaccaaacacaaacacacctcaacaagtcatatgttattattatttagttacatatgtatggtactatcatgttaggggccttctttctacatatttcgtaataatgcctagctttatgaaaattcatgtttaagctttactttccttcttatcgattaagtttgatgagctcaaagaccaaagaaattttacaattgaaaagtactaatgtttcatgtgcgcacatatttctcccgatcatcactatatatatatgtacctcaaatccaggtaa

SEQ ID NO: 13132 - DNA, 874 bp, Oryza sativa
aattcctgcagcccccgaccggcttgccttcgccgccgccgactggtgtttccgcctgcacggctggcctctatgccgccgttgttgggcgtctacgtctcaccgaccggcttgccttcgccgccgccgactggtgtttccgcctgcacggctggcctttatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccacctgcacggctggcctttatgccgccgttgttgggcgtctacgtcttcaccgaccggccgccgcatccgccgctgactggtgtcaccgcctgcacggctggcctgttataacgccaactgatgctatcttcttcacggccggctacatcgctgtcactactaataggcatcagtatcttcaacacaagctgcctacgtttgccatgactgccgactggtttcttcacttccatggctgcatgattctgccagtgttgattggccttaccatcttcatcgccggtcgtctcgtctgctgctgactagtgccctcacctctacgtctggtttagacagctaccactactgataaacatcatcgttttccgtcgccga

SEQ ID NO: 13133 - DNA, 2139 bp, Oryza sativa
  unsure (1)..(2139): unsure at all n locations
nnnnnnnnnnnnnnnnnnnnnnnnnnnnnnnnnnnnnnnnnnnnnnnnttaggagaatcaaaactgaacttcttgtgcaaatgcaggtgaattttagcttatattattaacttttattaatcaggtgcctgctacctgaatactttaaatgtgtacttggacgtgttattcttagaatgataatgatcctgaaagttcagagcttcaattggagacgcacaaaatgctgttatatttgaaacttatatagttcgttaaggatcaagttattgaaacagtgcttctaacttgtatatttgaggggcaaaaaggaacatggtatattttcatttcacattttagttctaagatttgttgccacaccgttttagctaatactggcgtactggaccggctacttcctctaataccagtaggtttctagtaccaagtccaaacagagttgtactagtatcaggtgtcttagttagggatattagccaggccagatctgaagctattccatccagatttggaatcataaaagtgaaaacgtgctaaatttccaagtagatcagatgcgaattggctgattagttgctttctagatacatggatattgatgcatggcttgaccgcttgaccataataatcgaataccacatttgatgggcttcaaatactgtccatcttttcttagagcatgtatcatgttattccttgttatctgaagcattccatggtttgttaaactatttagatgccctttttgttacaccaacttacttaccttttgctttgtttcgctggtgaatgtccagggtgttggccataatgatgacaaagtactggttcttgctgctacaaacacgccatatgctctagaccaggtttaagaagatctataaaactgtgttgcaccattcagaactgtcaaaattctcttgttccattgaacaatttagtacttacttaaatccattatctcaggctgtgcgccggcgctttgataaacgtatttacattccactacccgacctgaaagcaaggcaacatatgtttaaggtgcagaattgtccaattcagtttcaagaaaatgtcatgttctgttgttacaatctttggctgagggcaaacctttaatttatccaggtccatctcggggatacaccacacaacttaaatgaaagtgattttgagaacttggctcgtcgaacagacgggttttctggttcggatattgctgtttgtgtaagttgttttctgcaacattctcatgtatccatgctctgttagcatatactgaaatctcgttgctcttttttctttcaacaggtaaaggatgtgttatttgaacctgtccgcaaaacacaggatgccatgttcttctttaaggctgatggtgatatgtggatgccttgtggaccaaagcaatctggtgccgtacaaacaaccatgcaggagctcgcatccaagggccttgcagcaaaggtaagattgattgacatttcctccactgcgcatgttagaagaggcttctgatgattagcaagatttatttcctgttatgtagatccttccaccaccaatctcaaggacagatttcgagaaagtcctcgccaggcagagaccgacagtgagcaagaaagacttggaggtgcacgaaaggtttacaaaagaatttggcgaggagggttgacaagattatgcgcactcacttatgcatagctgctccacagaaatgtatattttatgacttcgattgttctggttggaagttggattcacagatttgtacaattgatagcctaactatgattaattacaacctgtttattgcgttaggctatcattgctcctctgtcgtcaacttatttcatttttactgtcacttatacttgaaattttccacaagtgtattaattaaggaataatacttaacgtggagcccttgtggtgcagcttgtatagtttgttctcctctggtttccgattcctgtcatttttcggttctattcagtgcttgttctttgcccaagttttatttggcccccaatcgatcaggtctggtattcaaccctcaaacgatctccttttgttcatgtgagtttggtagtacttgtagaggcttgtagcaatgattccttcaattttaccaga

SEQ ID NO: 13134 - DNA, 2368 bp, Oryza sativa
aaatctattggccggtgcagctgaatttggggtggtggcgtagtacgctcagtactacaaacgtacgcactcttctgaaggctcttgctcgtcgttgtaccgcagaagtacagtgaacacttgcatgcatataataggtcaggaggaaatggccaatctctctggagtattcatcaagatcaatgcttgctttgctttgcttgcccggtctcctagctattagtctccatttgattgatgcttttgtactaattaactaccactagtaatgctattatactaattaagtatatgtgcatcaacatagttaattaattcctagcagcctctatcatatcctgacgatttaagcttgtagcattatattagctaagcttttgcagtcaggagtacgtggacaatgactgacctaggagactcttgcttatgggtgatttatatgcatgtgtctcatgagatattatcaaaactgtcatggcagattaaagtatgtttatttatgcttctggttaatatgttatggctgcttgagaggcacagttgtagaagaacctaccacaatcttcccatcttgtgatttttgtcgcttctcgtaggccaattagggatgcaaggaatcggggacttaatctcattaattaatgaaatgacaggacagtagtagacccttgctaatcccggccttctggcaattatatacattgataattttgataatgacacaatccctaaaatttagctttgacctgatcgaatgccatgatcatagtattatggaaatgttttagacaaatctaccagcaccattatattttcacatatatcatcgtctttgcatgttcgtatatatatcacaaattaaaatgaatactatttgcttgtggttaattagcacctcaactcatggttcattttatcgcttgagataaaaattcgggataaattaaccgatcgagattttctaccaagattaagcaaaatatcgtcaacaatttttaaatggaaaaatcgtcaaatattgcgaaaataccaatggatcaacttgtatgtcctaattatgagcactcttaaaactccaagaaaaaaaagacaaaaatgctgaagtgtgatgcatgcatttgtacatattgctcctcccaaatggccgggagtattaatgaagaatcgaaagaaatcatttctttttctgtcttgcattattcatttaaatccaacgatttcagttggtgaattgaacttggtcacctggagcacctttccaaaaagtttcatctctgtacagactctcaagaaaactagttggcaagtggaattctttagtcttctctctaccccggaaaatatcaagaccagcagctagctagcaacttatgaatattttttaattaattatccccattgatcaagtgctgattttaattataacgtgccaaaaagtttcagccgccaatgacacatgcatagacaaattgatttactacaaaaatgcatctgctaattgattaacaagtcggcaacatgcatgaacaaaccacgcacacacatatataatatatatacttgatcctagcttccttccaggaagaagtaaggatcatctcatataaaatgtgtgcacttttcatcatcaatcaaaacacttctagcataacaagtgtacaactaaacaaataatttggagtccatgaatgcatgaacagctaaacacatgtgcacacaagatcacagcatcagctaaccccaggaaaaggtagtttgattccaagacggaaatcaattaacaaccgactaatccttgtcaaagcaacgtttaattacttactagtatactccaaatggatccattgcccttgaccaatactgaatccacaaagcatgcatattacgcatggactcttgaaactaacaaggcatattgcatcggtttctctctgacaaaggcttgcatgctagtagcttggaataaaaaacccaaggatatagcacttacatagtaggagtactatagtacaaagagatagtagcaaagtaataataaattaacacacaaatgcttaattaggtgggtggcaacatgttaattaaaatcagctccttgcatgcagcctttgacgccatccacagaattgacatgcatggcgacgtggccggacagcatccaagaagcagatcctttgaactaagccaagtagctagtccatgttgcatatgatcacccagctgaaacccaagtggatcaccaatccattctttgaaccatcatctactattagctctctctctttaaagttgaagcagaggatgacaagccagcagcacagctagtagcagcaacttgcaaaaaaaaaatttcaggctagctagctct

SEQ ID NO: 13135 - DNA, 831 bp, Oryza sativa
cccgtcaaggtgtgagtttctaagcactcgtccccagctggagctagcgtgttacatccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggggagttggctcacactttgtagctcattcatacacaaatccacaaaaacacaatcgggtcacccataaccctcggtcaccacgttcccggcctggccagtctcgacatgcggatctccccaggcactagccccgacccgcgcttttcgaggactgggacttgggcacgggcccttatttcaagctaagacacaaaaagaccacggcacagatcatcctcatctcatatatagcaaaataaaactaatacaaaatttttttcatcatttctcattgcagattaagttaaattgtacaaaaaagaggcatgaaggccttagaagaaagaacaagaaaaaagttaagattggcgggggcctgggggctcattcaaatg

SEQ ID NO: 13136 - DNA, 668 bp, Oryza sativa
  unsure (1)..(668): unsure at all n locations
ttggaaaattaggggggaagaacacaaccttatattagcagtaattcgatcaaataatatgatctatttcctgctagcccggaaactcaggaaatgggcacgtatagtaaagcaagtcgtcgtttggatcggccagtccgatgaggctataaatcatactgaggcggtcaattattaatcagggttctggaatgtaactgatgagatactatgtgccaacggcagactggcagagacagtttatgaccgtaattaagcagccgtgaccacatgtacatatatgcatgttagtatgtgggttatagtagtacttgcagttggtgaacttcatctataatatatggagtgtagtatactagtatatatattatcctatattaggatgcacaacgcgtgtagagaatcttaaactaagtcaatttataggcatttcgatttggatcattagtacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13137 - DNA, 910 bp, Oryza sativa
acgtagacgcccaacaacggcggcataataggccagccgtgcaggcggaaacaccagtcggcggcggtcgaggcggccggtcggtgaagacgtagacgcccaacaacggcggcataaaggccagccgttcaggcggaaacaccagtcggcggcggtcgaggcggccggtcggtgaagacgtagacgcccaacaacggcggcataataggccagccgtgcaggcggaaacaccagtcggcggcggtcgaggcggccggtcggtgaagacgtagacgcccaacaacggcggcataaaggccagccgttcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcgcttcccaaacatgcatatgagtgacatgagtttgtcattaatggaacaaagtttcacggatcagagtttactactcgggtacttttgcaattgttaagagcag

SEQ ID NO: 13138 - DNA, 704 bp, Oryza sativa
tacaatattctttgtttattgattttttttttcttttcagcgtgaaaaaagttatcttcgcttttggatatatgttgaatcttttatctttttttgtgtactaatgatccaaatcgaaatgcctataaattgacttagtttaagattctctacacgcgttgtgcatcctaatataggataatatatatactagtatactacactccatatattatagatgaagttcaccaactgcaagtactactataacccacatactaacatgcatatatgtacatgtggtcacggctgcttaattacggtcataaactgtctctgccagtctgccgttggcacatagtatctcatcagttacattccagaaccctgattaataattgaccgcctcagtatgatttatagcctcatcggactggccgatccaaacgacgacttgctttactatacgtgcccatttcctgagtttccgggctagcaggaaatagatcatattatttgatcgaattactgctaatataaggttgtgttcttcccccctaattttccaacccacatctctcgtttttcgcgcgcacgctttttaaactgctaaacggtatgatttataaaaaaaaacttttaatatgaaagttgtttaaaaaaccatattaatctatttttttaaaaaaaaaattagttaatccttaattaataatgtaataaaa

SEQ ID NO: 13139 - DNA, 723 bp, Oryza sativa
aattcctgcagccctacaacgagcacgttggccatgtggttagcttacgtactcatcttaatcttataaacttttgcagtgatatcactaaatcgttgtggcattcgaccggcccggtcccgacgactccaaagactttgaaaagtcgtccgagatatagtttctagaagattcttggagaccatcgcagaacgttcgccatagctccacttttagcgatcgatcgagcacagcttaatgcctgattaatccatgtgctaatcgtattgcgtgattatacagtgttatgcattaattaattaacatcttttacagcctcatcacatcgttttgtcttttactactactagcttataattaagccgttatcatgatttaaattttgaaaagttcacttcgagtttttaatttatcgttgtttattttttggtttctaaatttctaatgacacgtatataaaagtttttttcgcgaaaatatattaaacgaaagcagagtttagcttacacaaattaaagcgctattgccgggtgggtgcgcggggggggggagccttggaaaaataaaagaatctaaaaggaaaactacttaaaagagaaaaagaactcctaagacaagggagacacatatatatcttagcttttatcatgattaagccgttaatcatgatttaaattttaaaagtttacttcgaactttttatcgttgtttatttttgggcat

SEQ ID NO: 13140 - DNA, 28802 bp, Oryza sativa
  unsure (1)..(28802): unsure at all n locations
tgacttttcccctttgcagccttttatttccaatcacaatgtcatcctcatgtttcaatggtaggggatcatagtgatcaaaatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccgaggtcatcagccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcgaatccccctgctacactcttcggacctatcatgcccatcttcaacaaattctctagcaaatctttcatatcacccttagtaaccaccgaggaggcatctacaacctcctttccaacccctgaagacatttcccctccccctttctaagcttccttagtcctcacctgctactgctctctgctcctgtaatttttcagcacacaagacactaccaacagcaagcaacagcggccagccggctcacctggtcgcagctccgccaccactcctgcgccgtcgcccccacgccacggtcgcgcgaccggccgaccaccccggcacgccgctcagcagctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgttcaatttggggaatttttctagggttagcctactcagctcaccccttcctcatgtattctattagcataacactttacagataggtccttggtacaatacatatttacaccaacaaacaccaatttagctaacgggcccacactgttagttagtctctgtttgtcactgagatgcaattgatagtacagtggcaaggtctgtgtgattttaactctgaaatccaatgttcagtcctcaacacgttcataatttttacttaaaaacaatatttggccgacgtttccccttcaaatctcttttttttttctttagtctgtctgtcactggcacaggcactcacacgcacacggcgtgaacagctttcacctcatcatgcaaactcatgcaatgcaggaggagcaggacgaagacgaccagagctttgcttgatctgcacttatcctccaatgccctttttctctcatcagtactaggctgaagattatgctccagctgcatgcctgcctgcatctgcatggcatcataaagcagagctactagctgtagcaacactgagtatccagcccaggggacaaaatgctggcactgtcatgctctgtcagaatcccaatgtgagacacttgcttgtgctggacttaacctcgtagtgatgcttgttttggcctggctttagcttgtggaatattatatgcagagcaaaagttgaatgacacctaatcaacagcttgtttcaggttctttcaggagatcaaaaccagttagtttgcagttcaagggggttctcacttctgaacttgcaatgtcttcttttcacttcttatttttcttcatttcatttcatatctagtgttaagtgttaacgatggttggttctattctacaactcaattacatcaaaaaaaaaaaagttcacactactgtaaggacaatttcattatctctgtggccaaaagttacaagatacgcgcccgaatcaaaatttccatcgcaacacacggacacaatgcttgcaatcaagaaaatacgtcgatttgacgtgagaaaaaggtgtcttcagaaatgatgcggccttgcaacactatcatagagcatgagaagatgaaattttcacttttcaagcatctagtaaaggagctctttcggctcagttgcttggtctctcctttacctggcttctctactcactcctatcatcctatcagcatatatagcgcataccttactgcacaggtcttttctgctatggatggctcacttgcattcaatctcaagtgccaatacctactccaatccgggtgcatatcacatagccctttttttttatcacccttgggctcgtgcaattgtgcggtctttcaggaagtaccacatactagagattatttcaggaagccaaacttagtcacttcccttgtttaaaaaaactgtatatatccggttggatgtaaaggctgagtaaaaatacccttctctaaaaaaaaaaggagatactatcgggaggtatcaaaatttataatactccctttgtttcaaattacttgttattatagatttgtcctaagtcaaacacatttatctctaaccatcaattttttgaaatattgtcttataacgtcaagtgaattattgtaaaagtatttcttatggtgaatctaaaagcataaattttattatgacaaactatataaatttctagaagttgatcattatgttaacatttcatacaagtcaagtccatggatcaccaacctacccacctctctgcatttcatgtcattgcgttgtgcatgtgcattcaaaggatccagatacgattaggtgataacatcttggacagcttctgtgtaccaaattcaattccactccccatgaatgaacccatgatgatcaagacaagagcaatgcagctagtgctttctaggtaagctgtactgcaggtgacaaccctgctgatggttacttaaccaaaaacatgcagcacatcaattatctgatgtcctaaattaacaaatttcgttagatggagctttctccttcgatcggatcgaccaaaccgaaaggaataatcaatcacccgtgcgtggacaggcacacgtggatggtggcttcaatcagatgatttctttttgcacgctttggattttgatttgtctctctcatatggaagcaaacgatgcatggtggattccttgttcgtacgtagtggtcttcttgtgcatcatgaaaggggaggactagctaactgatgcataaatttggtgaaaataattcaattttttttctccatttgtcctttcttttggaaaaacaaatcgtttcagcactggtgaagtataagtgaattgtccgtcttttctcattagtttaagcttctgggttaaattgattagtagtttaagctttttggcaactcaatagacgcaacatttgaaatacaattttgataattaattctcttgatatgagaatatgtataccatgatatgatatcatgttcagtacggtgcattgaaaaccagtgctaagtcctgtctctgtcagcaaaattatttttctgctctaactgaatttcagagaattcaggtcgacattcattgctggagcgaagatgtgagtaactcctgatctccgattcgatcgggcgaacgccattgcagtcttgcattgaaggagaagtcctttcagtctgttgagccgccatgacaacttgacgagcgatcttaagtatgcactggacgcgagctgttcctccccctttgttcaggtttgccaaaaaaaatgtaacagacttgccaacgttacttagttacttttttttaacttagctacagatttgctattttgaagaacagaacaccccccccccctcctctctctctctctcaagcaacctgttgattgcttttttttaaacaagtacaaaagaaattgaaagaaggattgctgatttttagccaggacagatgagcttggtttgcactttgtagttttcattgtaattctcccatttgcatgttctgttttttctgaacaacaattgtatcttgtgttagttttgtgttgaactgaaatcttcagtttgcgacctgaatcaattagaaaaattatggaagtgaagtcgaaaatgcctatatggaccatcccatacaagcccaaggccatctagcagaacatcagagtgccacattgtgaaaatctgctaaaatatttggcccatttggaagaaaggaaatttcacctgaaactattcatgtaaaaaaaaacgagaaaaaaaatctctgaactttcaaaatccttttagccttctcctccttccactccagtgtgtcagcgtcagtaaaaagcatagtgaaagtcatcttcctggattgatccccggccattgctgtcatagaacactggttacagatggtctcttctgacaatctgatatggttgtactgtaagatttgttctctttttttcttcttcactcggctattaatttgtcattttatttggaatttggatcaaggaaaggaggaggaagaaatcactgtcggtttcaaggtgctgtgtcgtgtactaatcgacaaatgaacagtcgcaaatgctggccagattcagtcaggcacagccaagcgatggaatcctaaaacaaaattctgcatctagtagtatctattcatttctgcaatttgatcaaccaaaatatgcacatctagtagatctgaaaatatacaggaggttggttgaatgatattgtacatgaagaacacttggaccaaaccaatataaagaatatgagaatatagatggctatcatagagaacacctggatctaatacttgactatgaaaagaaatattctatcaaggtttctaacacattaaaatccatcgtagtagccaccaaatgatatgcttgcccttgtggatgcacctcccattactgttgacacagcttgattcagtctcgaggcttgctgcacaacctgctgaattctctgcagttcagacaggcaaaatcgtcaggagcagttggaattttcccctaccgactggtgatttagcctacacattatcatcattccacttgatctaatccaatcaaaatattgtgaaattttataatttttaattggcagagtgatgcaatttcgccgaactatttcaactactaacttgcagacacaaggacagcggccagctcaagtcttactctaaaacatgctcttgagacagtgcatggattaagaaatttgagcaaaaggaaatagccaccaacctcattatcagcatacatctggaacggggtcttctgattctgcgtcttgtgcagctgctgctgcctgccaccaagcagaaagatgcacaaggtggcagccgcaaccccaaatgagcagagtgccccaacaccattcactctcagcttccccacactgaaaccattgtgttccttgtctttctgggcaccttcttcctcttcaacacattgatcaggtgcaaccatagccatcacctcatcatcatcgtcgacatcaacttcctctgcactgacgggactcttgatcatctctgcctcctcttctgcatcaaatatctcagtcaccttaggcacgaactcttctcggtacgattcaatcttcacgacatcgatgtccttgaacttgatgacaggatcacccacatagacctcttctgatagatggataggcagaaatatattcttggtctcatcatctaggatacaatcatagggagaagggtgagatgcaggggtgaaatggtccatgttgatcatgatcaaactggcaccaaacaagaactgatcatccttaccaacaacagtgccatggtcactggtgaactcctccatgaagtaggaactcttgttgtcaggcaggagctcccactcatctaggctgattgcatccatggaagcagtacctctgctcatgtcaaactagttcagaagcgagcttggatcacagagagatatatagctgcccaaatgcttttaattttgatactcccttgatactgtggaagtggtcaagaatggatgctcaccaagaatcaataccagcagtgctgaggaaggatactttctttttttctggaggagaataaatggaacaagagggtacacttcttgcaccaggggagatgggtggcaatccaacttgaggggtttgtgtgtgtgtattggcttagtctttctgctaagtgacaaaggtgaaaatgttacctggggcctaccagtgatgactcctcctttcctagtttccttcctttctactcaattctttctaggtttgtgcaagaatcaagattagcagacggcaaacaattaattattcagcaaacatgattagagattgatttctataaagataggatatagtgtcggtgcagaactgtgaactagtctgaagtcagctggagcctcacattcagacatctcgtgtgtaaagagcattcagattaattaattcctctaatgaacatctgatgataataactcaaaatattcctacgaaccagcagtatgttactcagtaatcttacctggacggcagacaaaccttcattaaatatcttgacagtagctgtcgaaggattagggtgccacctaatctgaaaaggcttggaatgtcaatccttttcagtcgacttacgaaaaatgtttccaaaatacaggtccaatatacaagtcaatttgacacagcactggttagtagactggtaacactgtgtagatgataagaaaaggacttgataaacgaaataaacaggaactgatgaaggatagtgacacacaccacttaaacacggcaggcataggataatcagacacatgttcagaaacttctacagaaattttactctggaaagctcagatgagaccatagatagaacccacaattttatagaagcagatttatgaacagggcacgcactcacaaatctccagtaaacaatagattcacatacaaaaggagcatcttccagaaacattttgttagcttcttataaacggtgatgtacatataacaatcacagtaaataaggcatgagtcggcggccccagcttcaggctggtgcagacaacgaccaagttaagagttcttcaaaggttaacactgtaatgattcatacagcagcaggagcaacaaaaattcatctaaaggctactcaaactggcaccacacatctcaaatttacagtagttatcttgacaacaagattaggcattgcatccgcaacgcaaaaggtattcctagtatacaacaaggtgaggccctcagaatttacatgaccatgaggttcccacatgcctgaatggcgcaacaaagcaactatcatatatagctggatgcggaagcaagattaaataactttggatcacatgtgcagctacactaaacaaacagccccgaaaaggttaagcacttaagcttgccgtgaggatgatgattcacccagtgaaacagaagtaaacgaggaagcccaagctcgagcattgcttgcgcctttcctaaggtcccttgtcttattgctcagtctaagcttgctacaaagcctcttcacatcaagtacattcagcgctcgttccaacagttggcttgatcccctacggatccctaagttcaagttctgaacacgcacgaccaagaacgttttcagatgggagacgacgatggggacgaaatgcgctgcaaccttcaggatgataaaaagcaccgcaagcaacacaaatggctcatcttttgcaattttacgcagagatcggtcccctggtgtgactggtctgaaatctccagtactgtcttgatgatcgacatcaaaatatgcaattggatcgaagcctgcaatataaataatttacttcaagaaatgctctgaagcaacaaaggcaacccaaaaaaatctaatcatcaatagcatatccctgtttagttgattggacaatggaatcgattctatacaattaatggttgtctgcattcacaagcatcaatatttcatactaaaaaggttcgaaagattaaaacattatagtaagatggagatcctggtgtgtaatatcgagaaagcatcatggcaatcctaacaggtgcagctaattaccagcgagggaactgtatagtttccaaactaaatagcacccaaaggctatgttctcatttctgggtttaatatatttgaaagttgttacgattcttgtatgcaggaaaagaagagcaatgcttgtacctgtagtttctttatagaagtccaccagagagctgagatcttttgggccccagtatcgtaccattgtagtctcatttacaagaagaatggccgggaatccacggacaccatatcttgaaaacaaactacaataagcagaaacagcataataagcagacgagtcgacttaaaagggggcatgatgcctcacttaaagagacatatagacaacataggagtcaacatttacatacctaggcattgcagatgattcttcaacagtaaagtgatatatctgagggaacatagtgctgagagcttcaaatattggccggaacttgcttgaaaatggacaccaagcagcatagaagagaacggagtacgtaacacctctgtggcgaaggttcaactctttagcaatagcctctcctctcaccttcagtaagaaaaatgcataagttatttacagataaacaataactacaatccagaggtttgcaaactttgcaatacggactatcgagcattatttacagtgccagcctggaagggtatttaattaccattgctagataatcaaatggggacaaactcttcagttaagaaaaaaaaatatcaatagtgactgacattaaagttggtttagagatatcctgaggaacattaatatggtcaacacacattgcacaattcatcaattttaaagactacccataagaaatttggaaatgcaggataatgccaaatttgccctagactgcatattgaaaagcaacaaatctacaagatatccttcaaacacgttgaggaagcgccttcacaagaaatacagcacatagcaacactccaacaagatatttaacattttctaagctttggggcatccagtcagcctaatgttattcacccggaacatgaaatgacaccacataacttggcccgggatcgtcgtctccgtcccaggaacaattgttaaaacctttcaaagtagcatacaatattccttgatctcattcctcaacccatcgatctgggaactttagtgaatttatatttcgtaactatgttaacatcatcatctcaatagctacttcctcctatgtctgcctttccaatcttacataagacactgaaaatccctcctgagtcctgcccgcccgtttcacctatgatgtagtccctccctaccgctagcacctgggcgccttgaatgtcgtttgcgctgccaatcattgttttgttaccttccctcaatcaattcccccgttaatcagctaattgttggcaacaaacaaacgcacatatgcacaaattaatggtgcaatatatttctaaccacaaatcgcacatctatccggtggtttgataacggatacacacaatacgccactgtcgtttgcccgcattttgacaagtagatattccacacgaagaggaacacgcgcagatactcgctgcttctagaacaacatgggataattgaattgacaagctatctgccggagaggaggtggggattggggaacacctacctctacaggcggggatggctcgatccggatgcaggggcagcgcgacgcgagcgcgtcgacgaaacccgggcccctccgcgcgcaggtcgacggggcctcctcctcctccccaccccccgccgccgccgcgccggcgacgaggagcacggccgcgacggcggcgacgacggcgcagcgcgtcatagcctctctctctctcctcgggaagggtgggtggtggtggatttggatttggatttgctcgtttttcttttttccctttttttctccttttttttgcgagatgagctaattttgggaggccgtgcgggtctatagtggttagtggttgtggtgggccacgtgtggcgcgacggttcgcctggctggcatcgtcgcgtgccgaccggggggtggcggggcccgcatgtcagtggctgtaggtcggtttgttacggtggatatggacgaccgacgggcgttctaatcttggtttgtgatctgttgtaatcatcctacgtggctgtatttggaaaaaatctgataccgtgggctgatttttcgcttgtttcggttcttgtttctgcatgggcctgttgttatcattgtactgttttttttttcagttcttttcattgtgtttttttttattggatgggatttaggagagagcttaacaaatgggatagatattcaaaatttcaaaagaaaagggagagatattcaaagtgtaaaatgagataacacacaatagtgttaataacgatatattgagcgtagcacaatatgttaaatttatagtgatacagcctgttcacggattagttttaaacttgacacgcgtgtgctcgtatttactgctaattattctttcagtaataaacgatgtatctatcaatagcaaaaatccttctgataaattcgtgaattttgaaaagaaaaaaaaaggtaatcacatgtgcctcaacgtgggcctaaagtaagtccacacagaatacatgggcctaaattaagcccatattctaggagcggcccagtccacgcccacagcccaacctgcacatgcagctcaccattctcctccgcctcctcgccgccagcccgccacctgcgaactcccccactcccggctgcccgccgccgcgatgcagatcctccggcggaaacttctggaagcttcccgccgcctccccttctacttcccctccgcgcccaccgcccactaccgcggccacgcccatgccgtcgccaccctcgccgccgtcctgcgggaccagaccgccggctccctcgccgccgccccgtgggccgccatccagcgccgcggcgcgaagatgctcggctccgaagtaattccctatctccttggatctgtttacgtatacctgtctccagggtttatttagggttctaagctagttgcaaatatctgctctggttgccccgttacggttagctcgtttcaaatttgtgggaggaactggtttggtaacgtagtagttcattgttgatgtgtttttggataatcaactcagttgaggccactagaaactcttttttaacgattatgcaggatgtaatttggtctagcatctgttggtttcctctaaacttcttgttaggctttttaaatgtgttaatggtatgtgcttttaacaaattcgtcgacgcagtcatgcattcactatgtttacactaagtggtactgttgcagtgttgctgagtatgtgcttttaacaaattcgtcgacgcagtcatgcattcactatgtttacactaagtggtactgttgcagtgttgctgccgttggtgcaggacttggacataattatgcataattcatgaattatctctctctctctctccctctctcacgcataatgatgcttacattaattaattcagggctttcttcatttgtaggtgaagcttggaaacgtaatacagagaagaggtgtgtgtgtttacatgtagttatgttttatttttgccttcaagtattgtggattactacttatcccatccctttggtcaaccttcaaggtcgcatttatcaggtatgcccatttgctatttgggttctgcatgagttttgtggtttatactttatgctcatgtatcttataagaacaagcaatctattatttcttttcttaacttgcttgtgctttggcaggtgataaaagcacaacattcacatcaaggtagaggaggagccactatacaggttttcatctcgttttgttcttttagttttttgcagcacacaacaccgtatagttcagcatcaaaataataagtaacaagtaacaagtaacagccaaaatagttaattttagagcacccctttttttaataacagaatattgcaaagctaatcaaataacaaaatatggatatcttattatactcccgatcatattttttcttcaattctttgatgctgcaggtggaattgagggatgttgacactggcaacaaaataactgaaagatttcgtaccgatgaggctcttgagagtatgaacatctttaaaaccaagacatatatgccttctatttttcagactaattttccttttacgatcatatcatatattacctgttcttgagatattctagcgtgattttaaacgttaatctctttatatttctatctacagatctaactatcaaagcaatacattcttctgaagtgttattacattacattcatgtgtcaagctaattttaggcagtcacagctcatttagagtgttaaacatataaattgtaatcatgctttttttgataggcattacatattttttctccaaaacattcaggagtttttgttgaggagaagtcattcacatatctttatcaggaaggagacaatgtgactcttatggagtacgtttatttcctgttatcctatcattaaacagttgacatgctatacagtgattatctgagtatttactttacttcatttaaccatgatttcacctgaaacctttgttgtcaggcctgaaacgtttgagcaacttgaggtctcaaaggaactgtttggcaaaactgcagcatatctgaaaggtaaagattaacaatattaatctacgacaagcaggaacactggttgtcacaagtctaaatgctaaaatatgcttatggtttcgcttctgtatggcgaggttgtatttttcacttttatcgaaggcatcacctaggggatgccttggtgcagcaaggtcatgatgaccatattaccttgttttatgaggcagacctagtgtgagaaagcggcagtttcgtgacaagtagtccttgtttgttgtgactgtcgttgctcctcgccgcactgcttttggcatttactgttgtcataaactcataatcaaccagactgggcatgagggagcgatggaaagaggtagagatggaagggttgagacttgagaggagggagggggttagctgccttgtatcacaaggtttcgtaatttatctttgtcagtggtggttcacgatgcgttttgtcatgtcatgacatcatacccaatttcctcacttacaacagatgaaatgaaggtgactctgcagtactttgatggccgacctatgtctgcatcagtgcctccacgcgtgacttgcacggttgttgaagcacaacctcattcaaaagggataactgcacagcctcagtgagtctcacatgatcattttcgtttctatttttactgtaatgtttgtttctaatgttcttatgacttttgggttaactgttgctcttactaccttttacgactttgatactagattgttttgatatgctgatgctggtcactgttcacagtttgtggatcaaaatagccattttgcgaaattcagagataaggctagtattatatactaaaaggtttttctttgctattcacagtttatgcctgatggattaggtcattagggtgttaagacttaatttggcatggcttgaggcctattgtttatgagctgcgcaatgaatactgatatcatggggtaggcctttggcattttagtaggcctttttatataaccgacgagctatttgctgttacatgtatatgtatagctttgtagttaccttctagcattgatccattagattgcaaggtccatttgtccaatacttgtgagctgtctcattaagggacgggcttaggtccatttgtccaatacttgtgagctgtctcattaagggacgggctttgaaggaggcttggcttagctcagctcatttaacaactgagccaagctggttcacagcttgtaaggctcaggcttgtttccccagcactatctgtgacatgcgaggctgcggaactgtatctgtcattctatgcactacacacaaagactttttttttttgctattatgagcttcataatctttcgtcaccagatgtttgaggctatgttatgcgggtaactaagctcattttgcactgcagatataaaagggtattgctggataatggtcttacagtgcttgtaagttgatgcgccatttcctagattttattgacctatccttttatataaatgttgaagtacatctaagaatggttgctgtatgtgctatcactttgatatccttttatttgtggcaatgtgtggaaaatggcatttgcagcatacatatgtctctgattgagttactgaaaatcaactctgttttgttctacatctgacttactcaaaagttgggatacacgtgccactactgaaatcaaccttgcttttgccgtgaaataatttactggttacatatagattagtactgaaaattagaaaacattgatgagtctgctgctttgaaatagttcttacttcctgttgcccttctgcgattatcttaggtaccaccctttgtagaagccggtgagaaaattgttgttagtactgcagatgattcatatatgacgaggtaagttctgagagcatcatttgcatattttggcatttcagttacataaactatatacttcggtatttgtttttttttatgaatcttgcattgatgactttgatggccatgtgcatactggtagttaaattcttgacaactttattgaaacaattttgcatttcagggcctgagggcaatacctggtagatggtgttattactccaaatttggttctcagcttgcattttcttgggtaaattttcaaccgccttgttgtagaaagacatcacctagcttcattaataattcagtattcaacaagttctgttctcatagattcttcttttcaattagtcattttgagttttgtttcccaccataaacgcaatcccaccatggtaccccatgaaatttttgtgggaactctgatatatatgctattggtattgagtacttggttgtgtcgtgctgtctatacatttctaagctgctaaacttaagctaggaattctgtcacgaacccacttgattctcaatcatacagcaaccagcgtaagagagaaatccaactccaatgcaaaatacaagagtatttggggatacaaattgagataatagaagtatagacttgaagaagcactttttttagataatgagacttgaagaagcatgggtttgggggctagagaattagagttttcagtgggaggtagaatggatgatgggattaggctgatgcagtctcttcatggatgcctttggctgttgcttgacttcttttatttttagacaaggaaaatgattgtatccccggcctggcctctgcatgtataacgcacacacatggccataaagtttcgagttttggctgctgatttatagctgcatccctgaaccaactaggccaagagacagccaaacggtgcagtctaaagcccctcctgagcccaggttcatgacaaattcctagcaacagcaacacatcacagatttcctggatggacgcatcatttgtcagcatggacataatcctggaaatagaaggtcttctcgatgaagttggcgagccagcgggaggcggcgaagctctctggacacccgacatcaccgccgtctccttgccggcggcgaggaacccgacgacggcgaccgccgccacctgcaaggtgatctccagagccctcatccccttcagtgcagctctacaactggtgcactgcatgacatgcgaccaatacctgttgtttgtggtatccaaacaagtattcatgttagatgatcactgagagttctctccaagagctgaagattgattgcgtgaagatcagtagacagcttgtttacctctccaagagctgatctctggtaggagtttgtggcagctgctgtttaactgttggatttgggtttgcccagccaatctgatggttgcagtactttctaaaccagtttctgtaggcgatgaccaagttgtcagatgatgttggcacatagcaagctttgtgccagttatcaagcccaactgttgtgatattgcggtcctgggaaaatgattaattaattattcgtgttaagaatgacaaaaggagagaatgggctaattaattaattgcacctgttaaatcagcctacagatagcctgaaaaaaatcatttggtttgagcagaagagaccaaatatttcacctcaacatggaggtacgtatccgaatccaagatggtattcgacgtcatatggtagaaccaacgtggtaggatcttgtcgagccatcctccgactttatacctggatgcccagatgaacctgctccttcccggagccaccgggacggtgaacaacaccaccctcacctcgggcttcttcttcttcttcttcttcacctcgtcagcctgcatcatcagagtataaacctcttaacaagttcaggaatataacgcacatctaagttagctttcaatactccctctatcccaaaatataatagattttagagaaatgcgacgcatcataatactatgaatctatgaatctggacagtctactatgatgcctcacatttctgagcatgtccaaatttatggtactagaatgcgtcacatactcacatccctccaaaatcacttgtattataggacggaaagagtatagaacaatttagtgcgatcatagatgtgccgttgatttctatttatttgagctagcgtgtgctaaggaatgtattcgccggtgccttgagtgtattataagcctatgttctttgtcctgggttcccaacctctctccctcattttccgcgcgcacgctttttaaactgctaaacggtgcgtattttgtaaaaagtttctatacgaaagttgtttaaaacaatcaaattaatctattttttttaaaaattagctaatacttaattaatcacgtgctaatggatggttccgttttccgtgtggaggaaataggttcccaacccccattagcgaacacgcctaaccaaaaatctgcaatggcaaagtgaagagaggctgatcgatatatacctctaggtcggtccggaacggcgtgccgtagagcgtgcacggcgccacgaacttgaagtagccccaatcaccgtccaggttcgaatggaacccatcgatgctggcctcttctatcctcatcttcatcgggctgccgtgttccagatcaaactcaactgtggagatttttttttatagataagggaagtttttattaaactcagtcaattacatcaaggtgatacaattatcctgagaacacttccggtctatacataactaagatatacacagccgaacaaacaaaaccacactcgaaagaaaaaaagaatgacatggagtattgaggaccatcaatctaacgactaaattgccactcatgaacaactccttggccatttcctccaaaagcacagagttttaaggaccaccaattctaagactagatcgccacccatatccctgggtaaaaaactccttgaccaccttctccaaatgttgacatgccgcaactaccatatcccgcgaatcaggcttctgtaggatagcccatatacaaagccaatggataagagaatatataacctgcaaaggtgaagatatgacttttttttatcaaaaaccacattattcctgcatagccaaagcgaccaacaagtagcagctgctcctaacagaacatgtgatttcacattattatgaattccatcaagccagctcccaaacatatgcgctacacaatgtggtggaggaagtccagatgttgcttggatgatggaccaaacagaaagggcaaaacggcattcgaagaaaagatgtctaattgtctcgtcattgcaacaaaaacaacagttcttattgccttgccattttctttttatcaaattgtccttcgttaacaccactccacggcgcaagtaccaaagaaaaatcttaacttttaggggtatctttaatttccaaagacggttattaatgttgggaacattgctgtgaattagagctagataatgagacttcaccgagaactccccatttgaggttaagttccaatgaatctcatcttgctcctgagttaaatgaaaaccagtgatgcgcggtgataaattattccacgccgctagttttgatcctataaggtctcttcgccatgaaaaagatgaaggattgttttcgaagacttgtgcaactgtagcgtgcttatgtctaactatgttgtaaaggcaaggatactgttctcaactgtggagatagaagctaagatgaatgtctgaaccagtaaaacgcagttgatcattgcaagatgaaagtttggggagaaaactgaacatatatatcacgacagatgaggaacatatctggctggatcttctctctttgggagctcaccaaaaagccccttgtgtgcgtaggggacgtgagcagggtccatgaggttctccaccaacaactcatacctgcaaacccatggtagtactattgatcgtcaaatttagaacaacagtagttaggcatgaatatgggatgagtctacgttccgatgatgcgggggaaaaatgggacgctgatgtcagcatccgcgtctaatttacgtgcaaaattattttaaactgatttttctcttaaattacctatccaaatcatgatccgattgcaccattaaattcattacaattaaatcttcaaaacaagaccacacattgatatattccgacgaaaaaaattattattgaattatttttaaatgttgcacgatgttccactaggtatatcggaattgtttcactaagtagatcgaaaatgtttcactcgtttaaatcgggtgttgtttcaccttatataaaaacaatgtttcagcaaatagcgaaaaaaatgtttcagttcactgtaacatttgatctatacatagtgaaacattataagtacaataggtgaaatatttttcggtggaacaaaaaataaaacgaattcccttaatagggggtttccaaaatatgtgggttttttgtggcaatggaatatttcagttcactgcaacattagatctatacatagtgaaacattgtgagtatactaggtgaaacatttttttggaacaaaaaataaaccaaattcacttaatagagggtttccaaaatatgtggatgatttgttgcaatggtagatgagaacagagaacgcggtggggcctatggcctacatgtatgcacgtggggggaggggcgtgcgggggagcgcccgatccggctcccccgcgccggtcgcccggattgaatcattctcgatgaatatgtgcttgataaccagttagccgtcagattagttttttttaccattaattaatctggttattaggagctgattgggatagggtgagtggctaatgtggtgcttcagcttttaatttagtccctaacattttaaacaagctggcttaatatagattttagactagccaaaaatgcctaccatttccctatatttttattttcaaaaaacaaaccatttaacaatttggaaaacataaacgtgaaaaataagtggggtgaagttaggaataacacaacctaattcagtcgtgtacatccatcaacgaatttgaggattctttgttgttttgctcagaagaaaaaattctcgcgtgtcggaacgaaattgagatagttatcgattcaccggccaggttcttggcaactaggacgtacgcgttgatgtgcgcttgtgcgttgtactctcttcatccataaaagtatttttgacaccaagactaaaaagaaattaaatcatcttaaatattaaaaaatcaagaagtgaatacaagcatgcaatcaataagtatttagatgactccttagattttaataaaacatttaatttatctcttcatttaaatcttgagtgtataaaaactacaaatagtaacaacttatttgaaaaaaactcaaatgtgaaataggtgtaacttttgtggatggatggagtaatatattttcatggagcaacaagcagtcaagcacatctcaatggcgcgacaagaaatactccctccgtttctaaatgtttgacaccattgactttttagcacatatttaaccgttcgtcttatttaaaaaattttgtgaaatatgtaaaactatatgtatacatgaaagtatatttaacaatgaatcaaataataggaaaaaaaattaatagttacttattttttttaataagacgaatggtcaaacatatttaaaaaaatcaacggcgtcaaatatttgggaacggatggagtatttcagagaagagaataatggatttgtttttttctcttctttttacccgtataagaggtccctgacaccgtagaccataaaatgggacgggtcatcgtcgtcgatctccggaacgtagggtggccgcttcctcttcagcacgtcgcagtactccggctccgacctcgggtagaaccacaagatgttgttctgcaccacgctcgggtacgacgccacgcacgccttgctattcttgtgcacctgccataaattgatccaagaactcaattaatcctaagaaaatcttgatatattttttgtttcactttgctgattgatcgaggagaggaagaaaaaaagtacaggagggccgagggcgggagcctgggggatgaactggcaggagccgtggccgtcgaagcaccagccatggtaggcgcactggaggcggcccttgccgtcgacgcgtccctccgacagcggcgcgaggcgatgcgggcacgcgtcgtccaccacgcgccactcgccgccgccgtcgagccacgccacgacgctgaggcccatcaccatcttcccgtgcggcctgcgcgggtcgaggtcgcacaccggagccacgggatgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgtggctggcagcgtgcgtcacgtcgctatccttttgcagccactaacccacgttcccacgattccctccgcaacagcgcgtccacgttctttctcctgatagataaggaggccgcgagtccgatccgagttcctcgcttctttccaggtcttctttccaggtgttagtttctccttctccgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtacgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacgggataccactggtccagccactcgaaccgctcctccgcccctaccaccggcggcgccgccaccgtctcggtctcggccgacggcgccggcattgacgacagccatcccgtgctggtgcatctcggctgccggagccgccgccgtggcgctagactggctgcgcgtggcctagggacgccatggcggagaggaagcgaagtgcgcgcccggaagagcaggtggagggagaagggagccatggcttccgggtgcgaagctcaagcgtggcaaccaacttattatatctgcagtgggccgaagatggagcctatacagacactgtccgtattgctgacagcatcaaaacatgccgtagtgtgtaatccacaagaggaatcattttattgctagtactattttcatctactggaagcttaatagaaaccactctccgtccaaatataaaggagtaacaacttctagcctttaaaaattaacgtaaaatataataatttcttcaccaacattctctttccaaccaattacaatcatcttccattcaattcagtattcaacaagaagttctagaattattttcagagctgttgctaggtgtgaagtgatttcggacatcttgttctgggatacctttggaatgggtctattggaagccaaacacatccagaattatgtgctcactctttagacagaagcatctctgtaaccaagttatgctataacggccccatcgtttggcttatttatgaaataaaccaaacgatatatttgcaaataaaaagtattttgtgaataaaaaatttatatacgcattcttagcgatctataagcaaaggctaaaactaaactttgatgaaacaaaaaatctcaaaatcaacttcaaatttaaggttaaaattcgaattttagcagataagcatgagcttaagtgaaaacatgaggccataagcctgtagaggattgcttcaggctacctcttaatgagaaaacatatgtccagtttcaggctcttcagatagaggttaatgatttacaattactggatgtaaacgaggataaatggagctatatttggaactctccgaattatacttcacagaaattttacaaaatgaactttctaggaactacccctcccaggctatacatttggttgtggaaaacaaatgtcatgaaaaccaaaagtttttatacggcttatgtttactgataggtaaacaccaaagacatgtttgatagacgatattgtgcagtggggattgtctgcagtactgcagctgcagtagcagtggctgataggctgcagtactgcagaggatccatgtccgatattgtgtcctaaaagatgttggtctatcatgtttactctgtcctttggggatcagagagacattaatccatctcttttttcaatgcccttttagtgtaatgtgttgggagagaattgggatcaaatggaacacaaatatgaactttgtaaaaatccccctggcgcatgggtttcatgttctttccctgtgttaacgccaaaatttggtaagcccgaagttatcatcggcctagagtcagtatcggcttcagagtcttagaatcagctgatgggagtcgtcaaatcgccaacagttgtatttttggtagagttggatcaattaaaggaaatttatccagaagagtccgagttcaagaaggatatggcatggcggtttatctattaattaggaagtatttgctagtttccttttatctttaggaaagtgtgtttagtgtccgataaggactttatgttttccttttatctttaggaaagtttctttcttgtcctacaaggactagtatctctccatgggtataaatatgtacacccggggtcattgtaaaatatctctcgatcaatacaattactctcggcgcatcgccaccctctttcctgaggttttacttatcatccggcggaatttggcacctgacgcggggctgcatcggctttcgatctccggtgaaggggtaagtcctacgttccgctggccctggtgaatctgtcggctacgttggtgttgttcaagactgcatcgtttcgatctcttggatcgctctggtttggttgatatatttgcctacctgatatctcaattctatctctaattacattgtgtttagagacacatcggtttagttgggactgtctcggttaggtccgattatctgtcttagctgatatatctctaaaatcacaatgttgttctaaatagatttgttatatccatcacattagatagatctatcagctcatcaagtattagattatcatatacaatctcgtgctgcatcggttaggttcgacctactagattgttgttgataatataagtcttgctaagccgataggttcatgctagtgttttatcggggtgctagccgataagttatctagacgttgcatcggcttataaggattgcatatacatataagttggatttagccgatgacaacaaagacttcactgtttaatctaatcttgtggattttatgacatgggacctccagccgatgtatgctttaaccgtcggatcagtgcttgttctattatatcatattgctatccaattggtttatactggattatattgttattttattacatcatcatcagccgattgactttatatcattatctacattggacatacaaccgattgcttaaaccctatcgctatcggctggtatcgacatcggctattatcagatatcggctggaattactccatcgacttgtcagccgatcggctgtttgatctactgtttgtaggatcaaactgactggtacacccgcatctcatcaatctttggacctgcactggagctaagcagatctcccaggccagtgtgtgtttttcgcatccacaccccctgtaatcacccggtccaccacaaatcttcgtctctcccacaaagacggtaacgcaaagctgctcaacgatggcgatgatgtcaccacacccacaagaaagctgatacgaaacagcgatcgacttaggccatagaaacaatgaatcaagtgctaaataggtatccactttatcattcctaaaattcttctttctcctattcgttctttccaaaacctaaatctttaattccactttgttatatgggaatcatgtgctaggtaagtgctgagtgcacctgatacgttgcccatttgcatattttgacattctagttacataaactatatactttgttattttttggatgaatcttgcattgtgtgtacaggcaattagattctcgacaagtttactgaaacaattttgcatttcagggcctgagggcagtacctggtacatggcgttattacttcaaatttggctctcagcttgcatttgcttgggtaaattttcagccgtcctgttgcagaaagacatcccctagcttcactaatagttcggtcaacaagttctgttctaataggtgcttttcaatttgttgttttgagtttttttttcataaacgcaatcccaacatggtaccccatggtatttttgtgggaaaactctgatatagctattggcattgagtacttggttgtgttgtgttgtctatgtacatttctaagcggctaaatttaagctaggaattctatcacgaagccacttgattctcaatcatacaatgaccagcgtaagagataatcaacctccaatacaaaatacaagagttcgcccagctaatctgaatatctgatggtcacagtaccttctaaacctgtttctatagccatatagctatctagattcataatactatgttgcgtcttgtaatactaagttgctatattttggatgaaaattgatggaccgacaaaacgttctgtagcatgtaactatatactgttctgtaggattaataggaggaaacatatgcttctatcttcaccgaaaaagttgtcacatgaggaaccgtatgcttctaagtgatatggccctgggagtacgcacggtagagggaaataaacttcccatctagccacgtggccgtgcggcctgccttttctccaccccctcgggaggaggttaggtagttattaggtggtcaggggggcctcggggtgccacgtcacacccctcgggcccgtgaggcatgctgccccgaggcccttacccggccaccacgtggcggggtgagtgggcggagcaggaggcgctgttcagcgtcataaatgagcggcaccccaaccgtccctcactgcatttaatgcggtgtgggcggacgtgcggcgccgcctgattgacgcatgtcaatcgaccttgaccagtctgcgaccggtcgtaggcggataggacaggtggtcgtgcccccacgtcccgccctgtgtcaggcggagtgggggcaggtatgccccatcccatcggcacactgccaagtgcaccccctgtacatggtgaatccaccaaagtctccatacatttaagagggaatgacagggatgtcccccgtgtcaggtggaggacggcgctggccccacctaggggcggacaaccactttgcttccggttgaaggcacggatagtgatctgactcaggctatgtgggcccccctcccatggaggggtacgtatgaacggtgcatgtggtatctccttgaactataaaaggaggactttacccacaaaaaaaaacagggacgactcttgatagctgtcacgccccgaactagtaccgaccggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggctcggaccaaacatcacaggcgcgacttgggaactaggccgaaaccctaaaactcaacgtagccggcttgctcctggaagaactcctcatcagccggatccgcttcatcttctttagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccgggccaacaacttttcaaacggccacccgggcctagctgatcccatcagctgctgaatctttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaataggttaggtcccagaccatactgtgccaggaagcccaggggtcctccccgacaccaccccgacgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtgcacgaatatcgagacgcaactggatggttacaaggggacatggtataacaattaacaattgagggatcagatgcaacaagttaggtaggtccgccaaactgtcatgcggacggaacaagcagattgagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccggaactacacgcgaaacgggacaactcaacaaacagcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaaggatttaattaaatcctttttggaaaagaaaaagaaaagaaaaggaaagagggagggaaaatagacttttctcgggcggctagggcgcggcccgagaggaagagcggctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13141 - DNA, 3143 bp, Oryza sativa
caagaagagatgaaattgaggttgatgagaggtacaaatcctataagatcagcatacattgcagctgataatagggaatgctacaattgtgggcaagtgggtcatgtgagctacaattgtcccacttcccggaacattggtggtaggggatcgattcgaggagggcatggtggaactcgtggtggatttagaggagaccgtggtgtttttgggggaaatcgtggtggtagaggaggtgatcgtggaggtcgtgttggaggtcgtggtaggggcagaggtgttcctcaggccaatgcagttaaggaggatgggaaagctgttaccctaataggtgaacaagtgacacaatgggaggaatggcagaagaacaagaccaatgagagctctaacaccaccactcactttggtaacttcgccaactacgcccaagtgggcgaaggtactcaggcacaggcacttgcatctacatatagacatcctatagattggatcatagactcaggagcatcaaagcatgtcacaggattgcataatactttcacatcatacaccccttatatccactctgaaactatccaaatcgctgatggtacatccaagcctattcatggtatagggtcggtagagtgcacatcatcaatgaacttgtcttctgttctgcatgttccttcctttccagttaaccttctctcaattagctcggctattgatcaactcaagtgcattgttgtatttgatgagaattcttgtctgttccaggagaaggggactgggaggaggattgggactggagtcacgcgtgatgggttgtggtacatcaatcatgaggaactgggactacctgcggtggttggagatgttgagaaggagatcagtttgcttcactgttagttaggacatccatcttttgagattttgagtaagttgtatccagacctctttagtagagtggataagcatagattggtgtgagatgcttgtgagcttggcaaacatactcgctctacatatgttggaattggtcttcgtaactgtgagcccttcatattaatacattctgatgtttggggaccatgcccagttacttctgtgagtggtttcaagtggtttgtcacctttattgattgtcacactcgtatgactgggatttatatgcttaaacacaaaagtgaggtccttcgttgcttccaagactttcataaattagtgaaaactcaatttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagtatctatggagtgaggctgtgatgacagcagcatatcttatcaatcgcatgccttccagaatacttggtatgaagtctcctgccgaactgttattgggtaagcgagagttcaaggttcctccaaaggtgtttggctgtgtttgttttgtgcgagatcaccgaccttctgttggcaagttagatcctcatgcagtaaagtgtgtgtttgttggctatgcttcgagtcagaaggggtataaatgttgggatcccattgggagaagactgtttgtgagtatggatgtgacatttcgtgagtttgagccctattataaaagtaaaggagatcttgatcaatttcttgaggaattctcgactgtcatggaggttgatagtcgagagggggagagagagagaggtgacatacatgaaaaaaatgttggtgacaagaatggagaggcagtagtgattggatcaataccatgctctattgatgatgcgagtaaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctggtttaccaaaggaggcggtttgatagtcagggggagaaaagaaaagggttagtgcaaagtcaaattgaagagttaccacacccaaaatgtccagtccctgaatcctcccagagtctctctcctccagcctccttggcttctcttgagacaattggtaatacttctccaactcttgaacatgtagaattacctcttgtacaacgtagagagactagatccaatgctggtagacctcctatacgtcttggttttgagcatcttagttttatgcatgacattgcaaactatatcacatattctcatgtttcaccagcatacaaaacatttattgcatcattacagacaatgcctataccaaaggattggaagtgtgcaaagcaggatccaaagtggaaagatgcaatgaaagaagagttgaatgcccttgtgaagaataagacttgggagcttgtaaaacttccaccagaaaaaagggcagtgggatgtaagtgggtctttacagtgaagcaaacccctgaagggaaggtggataggtataaagcaaggttagtcgcaaaaggctatagtcaaacatatggaattgactatgatgagacatttgcaccggtggcaaaaatgggtacagtgagagctttggtatcttgtgcggtgaactttgggtggccccttcatcagcttgatgtgaaaaatgcatttctccatggtgatttacatgaggaggtctacatggagatccctccaggatttgggaatagccagacagttggaaaagtatgtaaactcaagaaatccttgtatgggttgaagcagtctccacgtgcatggtttgataggttcaggcatgcagtgtgtgatatggggtattctcagtgtaatggagatcacactgtcttttacaaacatagggggacacacatcaccatcttggctgtgtatgttgatgatatagtgatcactggtgatgatgtagaagaaatcaggtgtctaaaggaaaggctgggaaaggcatttgaggtgaaggatcttggtcctcttcgctacttccttggaattgaaattgctcgttcatcaaaggggattgttctatctca

SEQ ID NO: 13142 - DNA, 19628 bp, Oryza sativa
  unsure (1)..(19628): unsure at all n locations
ggaaaaggctttgaagggaaaggatctgggccctttcccttccttcctggaaatggaaatggctcgtccttcaaaggggatggttctttctcaaaggaagtttgtttggaatctgtgaacaaatccaggaattcttgggtgccgtgcaagtactacccctattgataggaatcaccaattgtgtgctcaatcaggtgatcctgttgataaggaagcataccaaagactggtgggacgcttgatctatctttgccatacaagacctgatatttcctatgcggttagtgttgtgagtaggtatatgcatgatcctcgaactggtcacttggatgttgttcataagattctcagatatctgaaagggactcctggaaagggattgtggtttaggaagaatgggcatctaaatgtggaaggatattgtgatgctgattgggcgagtagtatggatgatagaagatctacatcaggttattgtgtgtttgttggtggtaatcttgtttcttggcgaagcaaaaagcaggcagtggtggctcggtctaccgcagaagcagaatacagagctatggctttgagcttgagtgagatgttgtggatgaggagcttgttgactgaattgcgagtgctaagaagtgacactgtgatgcttcattgtgacaataaatcagccatcagcattgcaaacaaccctgttcagcatgatcgcactaaacatgtggagattgataggttcttcattaaggagaagattgatagcggggtgcttaggttggagtatattaagtcatgtgaacaactagctgattgtctaacaaaggggttaggtcctagtgagattcaatcaatatgtaacaagatgggtatgattgatattttttgcccatcttgagggggagtgttggtgtaaatatgtattgtaccaaggacctatctgtaaagtgttatgctaatagaatagatgaggaaggggtgagctgagtaggctaaccctagaaaaattccccaaattgaacaatagtgttttttggggggcatattttgatgatttgatattactttccgaatgcgattttctctctcagttacatgtgggggtcatctgagtcactgaatgtgggtcgggatagaaggttgtcatatgtgttgtttctctctctcgtgtggtgagtcggtgagtaggtggtaccgtggtagacttgtagcactttagttcaggcctggtttcaaacttgggaattttgtatcatgttggatggtttgtaaattgtaatgtctcttgcaaaattccaagaagtttcaaaaacttttttttttcgccgggccagcgatagccatagccggtcgaagtatattaaaagttttagaaagaatttacaatatgccacggccgctgcaggtgctctcccgcattacaatttacaaccacatttacaatgctcttttatggagctaacaaggcccactgtcctccatgaagtttcaaacactagtggagatgttctgatgcgcataaggaatatgtatgattttgagataatttttttgctatctttactctgatgcattaaggcatagctccttccatttcatgaaaaaaaataaacatttcttttttcatgggggatagaagacaaaatgagctaacatattttttttaaaaaaaaagaagacattatctgttgtatttcctaactttttttccccttaagtaaccacattattataatttacaacacctggtgctccttgcagctaagtaccatgaatacaccatccttatcataactaagcccttattagttgcgactgttacttttttatccctagctggtaggctttttacctgtaactaaggtgtaaagtattctactacctttgcccttttcttgtgatcattgcaaccgaatcagaaataaattaacttggaaaataatatatcctatatcttttggttggctgaaatataaagaaaagcttgcatatttataataacttcagtactcagcaaaacctaataatcctttcttaataacaaagaggatcctcttgaaaagaagttaaataggtactacatagtactagtattcagatagttcttgtccattctttttctgggaaaaaaaaggcttgtaagacagtgatgatcaattgtcacaaatcaatcattctccctattatttcagaggatcaaatatcaagattaaaatggcatacataatcagataacttcttgccatcaccaaacaattcctcttcccttaccttttcctagataccagtatctgaaatggctcagcggcacacagattttctgggctgttcatccaaagcttggcatggacatgataatgtgccaaaattgccagcaggtcagaaagcaaagtgacaaccataatgaacattattctacttggaaacggcaaattctaagatcaacacatgatgtgtcatgatctgaagctttccatttttctaatgctctcgagcaagaaaacaacctcgtaacagcacagcacaagctacaatgctgtgaataccactagagatcttccttcaggtggagcttgaatccgagaaagagggggagagaaatcctattttacagtttcgaatttcaggcaagaaaaaaatatagttgaggacttgaactgaatccctctttgtttacattttttttcagagacagtgagcttaagaattctccactcctgcatctctggaactaacctattggtatttgacagtataggagtagcaaaggttaggtcaaattccatctactatatgctactattactaaataatttccaagtacattcacctttgactccaaataatttactattggtgttttcagctttgagactacggtagatcacattaacaccctgtcagagaaaaaagaattggccactgaacaccaccaatacctaccattatgttggttggttcttggagagtaattgggctggggccctaaaaacagtatttttctccatgaacaaccaaatttgtaccctcaatgagatatggtatgctactccacattagtagtgatatcactttagttcaagtgaagtgggtgcaatataaagaagttttattaaaagacaaagtgtgcatataccatgtcactttgaaaatttaagcttgttccactgaaaatttgagcttgttcctgtggacctgaattaattaagctcgccaagattgattctttaagtccagtaggccaatgaactagtcgagtaaagttcattattcagctaaatatacacaagcatcagcaactggaaatattaaattctctaaaacatatgagtgatgctaaaaaagaaaagaaaagcaaaacacttgactgcaattctatataataacataaaagccttttaaaaaaattgtttacatctttggtctctgccgacaagtgtacaaccaataagttttattgttgaaaaggaaaaaaaaatatcgagtgaagggagtaacataaagaactagcataccatttctcaaatttctgaaagagatactccagaactgtgctgtagttcatctttaactgaaatattttttaccaaagttttggggtacctttgcttggagacgaagcagaatggaagaggaggtgtggatggatctccaggaggtgaataaatgcggcctcgtgggcgtgcagttaaacagacgagagatatgagatggggtccctgatccaaaggaaaccgttgtccttctcattgatttcagttgccttcaccacttgccatgctgtagctactccagcattttggatccctacattctttacttccacatgttggtagcatacggcagagaaacccctagtggtactgtgctacttgccctactttgctgcatcttttttttgtttttaatcttcctactggccaggaatatttggagaggatcaactatattcagtatttatttagaacaattttctctactacttgaaagccaaattgtccctccttcctcttctcctaccgtctataagcggttggatctcaattctcctttcgaccccttctcccaccccaccggaggaaagtgattggatttcaattcacatgtttaacctattcctagtcatatgggctcatacaacctctattgtaatgcatgggtatattactagttttaaggaaaataagcaagttttttttttcattctcaatcatgcaagattgagaatgattgagaaagacatgattgagaaagcatgtattccacttgaatatttgcaacaaagtcaagcatggcaaaaaaatactacgaactagtaagctaaaggcactcaatttggctctatcttttagtaaaccaagcaagaaaaccattaaaatggtagtagcgtatatacatacgcatgtctgaattttttttagtgaggctgggaataaatcaatgaatacaatttcatatcaagacttgtaaaggattgatggttctgaatcttgtgatgtcttgttaagaaccactgaagatatcatgaacctgttttaaacgagatatttaaccatttaccacttttagatgtagcaattaaaatctaaaagtgataaatagttaaatgccctgttttaaactagttacattcaggtgattgggttatcttttcgacatttttatatagaaaagcaagcatagtatatgctcttttacacgagacaacaaaaaaggatggggcttccatggagtaggcactggagtgcttgtagcaagggggatcaaatacaatccagtcattttccactgtaacgcatgtgaactggtccagaatacatacaagagagagagaaaaataaaactattgagagctggtattctcatgtcagtgacacagagaaagtagagccgtagtagagctaggcagtggcctatgaccaaagagagcaagtaccacctggagccaaagattttgtgcaacctctactactacaagaaggtgattttattgaatgagaatttgaacccaagagggtgattttataactgaatcttagttcaggccttgtttagttccaaactttttctttaaacttctaacttttttatcacatcaaaacttttctatacacataaacttccaacttttccatcatatcgttctaattttaacaaaacttttaattttagcatgaactaaacacgccctcactcttttttttaaaagcttgcaaagaagaaatggtagaaaccactccattcattgcatgaatgaagaaagaacagctagtggtatggtaacagtagtaatggcagcagttagccacagcaactgctccccctcctctgcttgctgctgccactactgccctgccctccttgagttgggtgagtgagtgacagtagtgtgtgtggtgtagtggtaggagaggaggagtatctcttgtatggctgtggcctgtagtaggctgtagccccaaacctcttgtctccttttcccctcctctctctcccccactctacttcagttctttgcttgtttgctagcttctctcattgcctctcttgttgcttgatgcttttagggagagtagagtggtgtagtgtagtgttgaatcctcctccacatcttggaacttcttcttcttcttcttcttcttcttcttcttcttcaaagtcttcaaaggcttatcttgggtgaagaagcacctgaagcttccatcatttttgctttaatggtggtggtcttggggaaacttctgaagaaatctccgggggaaagattgctgctttgctgctggtttcgcggcaaatcttgattgattgcgttggaagaggtcggcttcgtgaaggaatcttgcttgcgggatcaatcgcctccgctcgcttgcttgctttttgggcggttcttggtgctgctttattggggtgaaaggttgggggatctcgcggccactcgaggtagcgagcgatctccccgcggcttctcctcgttgccggcattgcgggggaggcgagctcgccgccgggtcgcttgttgatgcggtgaggcggcggagcggagcttctcgctgtgctgctgctgcggcggccgccaggtgttcggtgaaaggcgcgagcaagcgagcatgagggacttcccttcctgcttcggggagagcggcgtccagatcgcggacgcgtcgtcgtcgtcgtcgagcgccggaaagggcgcggcgcagaatctggtgacctgcctctaccaggcgcagttctcgggccggccatgcgtgatctcggtgacctggagcaagagcctcatggggcaagggctcagcattggcgtggacgatctgtccaaccagtgcctgtgcaaggcagacatcaagccatggctcttctccaagaagaagggctccaagaggcttgacgtcgaggacggcaagattgagatcttctgggacctgtccggtgccaagtttggtgctgggccagagccaatggaagggttctatgtcgccgtggtgtttgaccttgagctgatactcctgctcggcgacatgaagaaggatgcataccggaagaccggcgcaaaccggccgatgctgaatgctgcatttgtggctaggagggagcacatatatgggaagaagatttacactgccaaggcacaattctgtgaaaatggtcaattccatgatgttgtgatagagtgtgacaccgtcagcctcaaggatccatgtcttgagatacgggtcgacaagaagcccgtcatgcaggtgaagcgtctggcttggaaatttaggggaaaccagacaattcttgtggatggtttgcccgtggaggtgttctgggatgtccacagttggctgtttggattgacgacaagcaatgcggtgttcatgtttcagacatgccaagcacctgagaagtcgatgccttggtcatactcgcaggtttttagggagtctcagttgcagggtcttggtttctcgctgatcctatatgcatggaagcttgaataggttcttgcagaatcataatttgcttctgcaattgcctccgttttagtgctaacgggatgtttattgagtgtcaattcttggaaatgttatggaggctctccaatatatgttctttcaatttttcttggttttgccatcttttataaacactgtttgaatagtttggcaagattctgtgacaatcctgtgattctcaaattcccttccttttgctcctaatgctctcaatagtttactgtggcaatgctccaagaaagaatgttgtcatgatgtaaagtacttcaaagttcggatatagattatttgttaatagcaacatcgtcagacgatttctactacttgttcttccctgtattatcttgtgatcagtcacaattgttacttggagatcaacaaacttgtaaagttcatcatgatataactttgatccctgtggaaaagtgtggattttgaggaatcaagactcatggaatacgcgcgcatcaaggtctatttaccctaatggcggtcctttttatgcttatctacagacatctgattgtgtctgtctttttcaggaaacatatcacaccaatgaggatcctgaagttcaaatgctgcaactcagtgaagagacttcaaattctgtgtaatttcgttctatacatctactaaagtgatgatctaccgttattgttgctgttcttatcacctgaagtgaggtgggtttcaaaaagaaaaaaaaacaaactgaagtgaggtgcctcaatggccattggctaaccaggaagctggttggcttagctctagtgtgctttatttaggagatcgcattgacattagcaatgatgaacaatcaaattaaacagcctgtagctttccgaactgttggaccacatcagctttgacgttttaaacattaaataggacattatcttgtcatctatgatgaatttaaatctctttttttttcctgaaaggtacaccatttgtattgcttatataatcttttaactctagtgagtgtatctaattccattgatgcttccctttgaacagaagatcgtggaaattcatcattaacagtacacaacaatgtctaaactctgatcaaatcatgaatctatgaaatgggctaatattatattattttaatcatggtatcattggttaagtggttaactgaacaagtcctttctttaaccatgctgtaagttggcatttttatccatcaacttattttgtgagtagtacaaaggaacagactgaactatcgttaaaatcagaaaagctcttggtttgcaaccaaaattaccaaatggaactggaaatttcttgccttgagctgagttaagatccaaagtactccttagggtcttacggccttgctagacccccaaatatacaggccatccaagatatacttcagtagaacttgttttgctcaacgtaaattgggttgcaaagccggcttactttgcttccttaaatcaatcttgtagtcttcattgattcattgttggtaaatttaattagccttcctacattattggaagcatttcatatatgatattttgggagtaatattcagctctctgacagttggttttcactagtttcacacagacagacagcattctgtctgttagttcctgtccattcattcagtaatttcttgtagctactgtttggagcaatacacaagattgcatttctggtcaatgcaaacatagtcctttaacagtgacatttgagaagaacctcacaactgattctagtgattgtccattgatagctacatcatatgaatggaattttctgtcactataagtactgactactacctaccggattgcggtgctagtttaacaaggaactgttccaacttttcttagtcaggtacagtaatatggagggatgactttagtacggcagtaatcttactgtggcttaatagcatatgaatacaatggaaagtgaccatgtggtgtttgcctgtttggtacagtaatcttatttaggagtataaattctcttccaaccaaaaatagatgatatcctgttccaactagaagaagaaatggaaaggaaagaaaaaggatgttgatctatctaaatggaagacattgcataatcagtaacagtatgcagtagatgtaccatttattgtcatcgtctccatcatcttgctgccttatttttagaagaagtctatgtagattattgtagataaactccaaatattggatttgtaggccatgcagattctttatttctttggttatatacatattacaaacgatatccataacttccacctttcatattactgtatcctctaagaaggagcaattcagataattgacaggtttatcaagttagtgagtccatgttaggagagtacgaacatcaaaattttaagcatttgtgagtgcaacatgggctgggccaggattggcatttgccttgtggcagcatagagcctgaataggcatcaacaggtagggatgcctattttatttctattgttttagttgatgaaaaatttacctggttggtgctcgactgctcgtgcttcctgattttcacatgttttctccaatcttctactcaacgaattgttgcatgtcatagttgaatacaaccttctcattttgctggtggaagaagccgagtcaaagatgtctatccttattgacaagggcggcatacgacatatcaacagcaggtcagacagtagcagaaaaggtatggttcttgtcgcagagcataatatattcaaaagttacatgtttactttgaagctggattcgtgttaacacacatatgctttgttatgatggccagttacttgaatcttatggtataaatgtaaatataacactacaaatttgtaatggtgttcgtaaaagcaggcaagataatgtttgtgctgactacctatagtcttaaaaaccatccaaaaagcaggcaagataatgtttgttttgactacctatagtcttaaaaaccatccaaatcagcaacagctttcctgtacgaaaagctaagaacattgagttagtgctatacccaaatgtccaagcaaaatctactataagtttagcataattagttcatgtgatacatgtgagtttgcagttaaaatctgtgaaaaatgtattttcatgctatgttttcatgatatcattaagaccaaatgcatttcctctctctctctctctctctctctctctctctctctctctctctctctctctctctctctgtcggaaaatgtcttttcctgcattatatatccaactggacccaaaggccgttgtgaagcccattttgtttaaaaaagggaaagcaccttagtaatgcacaaaacacgcgagcggatgcaggttgaattaaaaaaaatgtccctcaaatttggtgtgaaaatcttaagcttggcagcactcagaagatacaaacaagaaatgctatggatgctatggttgtcatgtaccttgaattattctgtaggtttgtttttgggggggggggtgtaaaaatgccctcttttaaatggagaaaagaggtaggaagagtaagaagtggaaagggacaagataccggaataaaatttctgaaagcactatgattgggttgcaaggaagcacaatgtggcagaagaagggtacagtgcactaaacttcacctcgtgccaaaagcaaacctgatggttacttcctctctaactacccatccttttatttcttttcttttgcatagcttgctccattcctcctttcacctcctctctatgaggccatagccggaggtctcagcagggcttcctcatggggtggctccactccctcttctcccctctgaggaagctctgggttcgtgcgcattccgcacgtcgaaaccgtaagttgtttctgagaactcattctttcaacatgcatcaactcctcttggtgatttccgcgattgcaaagccattttcattgatcattttacgcggtgaaatcgacttgtttcttccttctaacgttgttatggccctgacattgctgtgcttgatgctttcttggcagggaggggaatgcacattctgtacaaggatgtcaagtcttgccaggatgaggatgtgcatgttctatggtccatattggtggattcgcaccgtcacccagctctgatgaagctgaagctctagggttcttgaagaacagagcaaggatgatggcagctatgaattttctgtgattttgccgtttactcggccattacctctgtatagaacagcatgatttcaatggcatcaagattgaaggggcaaaaaaaatagaaggacaaaataggcagatgtttatatgcctttcttgtgtgtattgatgtttctgtcttgtggctttgtgagtgaggttgaaatgtcacctttggttgatgtgaatgcgagtgaggttgagtttaatgtatttgtatatacagatgctctgatgccttacctaatggtatgaagtttggtagcacgtatttttctctccctgtttttttgctgatttattttttataggttcaattgtgtttttggatgtattgtgtctggccaattccttcccactcccacacgtgttcatagtgcccataagaaaataacttggaaggatatgtttatataaaggcaaaattataaaggttctgtaccatataatactgcacatcaatgtcaaaactagtactattcttgaaccaatgcagtgcttattggcaagtattctatatgaaataatcctaacaccaacagtttggtctacaattgaaaaaatctagctactaagaatttgaggacttcaaaaggaagaacatagaataaacaaaattaattcctgcctaaatcctaaatcattctgcaggtgctaccctaactcaaaattgcatcttaaaagttccctagcgtgctcttgttagcctatcctccacaccaaaattaaaatcttggaacataatctttagagttgattttgaggtttgttcatggttgtctattttccagtattagcttttaaaccattactaatataaatacaaaagtttttacccataaattatttttcctttctttatgcatattttatggcttattaaagccatagatctaaaactgatgttcatcatgtcaaaaaagaaaaagaaaaggtgtcgctcaaataacaaaaccctacttgtacaatatagaaagagaaaatttaactatatgggccctcctccttcgtcggcccatttggcctattacaattcacaaatctggctcatttttccgaatcctccctacgacttgggcccgagactggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggtagggtttgctgtctcgcctggatctgggtgtctcgattcggggggggtggggggctttcttgatctggaaatttgatgggattttgttcttgttattctgtatgtgtgattgatccgttgttaggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggtccgttcatttccctcctgccctgatctagtttttgcggcgatggtgtgcagattagggtggccgggtttctaggtttgtgttttttgagagcccacgcaacaaatacgtaaattataggttatcccgattattgcctgtaaagtgaaatgagtgtagagcaaaggggatcgatgcactcattttgggtatagtatgatgttgatgattcttttaggccggaaggttgtggatgcatgattcgggttaacatatgttacaaaacttgttccttgtttgtgaagagggtgtatattcgtcctacgaattcttgatttcggagttacagcttgttacacatgtattcttgtaaaatttcttacctaagaacctgaatacacaattaggccatctttcatctttagcagtgagccagtgattaccattacatttgtcattatctgtactaacccggtaaactgatgtgcttctgaaacattctctctatttgcacaggcgcaacagacaccattcagaggctatttgagtgacatgatggatctggtaagtgtatctgaagatgctctttgtcattgcacttgttcattgcacaaacgctctaattgaatgccaagttacattaagcattacccttataattcttagtatgaggtcttgttgcatttggttatacattagcatgccataatgtaatctatagccttgtaattttctcttgtgctgggtaaaatgtattcagattagtttgaaatggcagtctattaaattcatgtaaaaagggttttcctcttgacgccactctaagctgaagatattgtgtgtttataaatttgcttttgttcttgagtatcctcgagggtgcatgtcggcatgaatatcgatcaccttttttttcttgtttattatcttgctgggcatggtcgcttttagtattactgggttacaagaagcgtgatccctataaaatttgcagtcatgggttgtgactattattttctagtatccttctaactcctcaggggttgtatgcaatctaaccatgcaatacccactgcattcaattagttgtacatagaaaaaacaactgaaataactacctaagaaattcctaggccttaattttatggtttgccattacccattagccatttatgacgtgcagctaattttcatttgaagcttgtgctagtctaaatgccctttcccccccttgttgcaggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaatttttcttttacatcattgtcgtaaattcttcatgtattgtgcttcacatgagaagaatgtctgttgtttgctcagaatggcttttgttttaccacctattgttttgattatgccatggttcttggtcatggttgtttgtgcagagtcgcatttgagcgattattcatgtatattgtgcttcacctgagcaaagaattgctttatgtttacaactacacccactgtttcatattataatacgctttgactttttttctaatataaaaaaaatgtataatctcttacaacaccaaattagtttcattaaatctaacatgaaaaatattttgataatatatttgtttggtgtcaaaggtactgctatacttttataaacttagccaaacttaaacaattttgacttaaataaaaaagttaatatgccttataatgtaaaatgagataaaaatggagagagtattattttgcatatgtcatggatgattttgcagcctttcatttgagcagctactggttatgacaattgacgagcacgagctagtatagtaatagagcttccggcttgttcttcctaacgagttagggttcctcttattatttttggcgcggttaccgcacccccgcggtaagtcggttaccacggtaaccacgagacataccgtggtttcaaaaactgaaaaggttaccgcgcggttttgtaaacccctaaaatagcattagagctctcagcttgttcaagtccatgaaagtatcagcttttggttgtcaaatatactccggcacgatctagaatagtaatgagagcgtaatagagctcttggcctgttgaaatccataagagctaaaataacttcgggctgttttggtttagtgccaaatcttgccctaccaaattttttggtagcctaaatagtacttgtgtgatgtttggattgatgccaaaacttgccaaatcaatagaaatctttgccaaaatattggtaatgtcaaaacttgtctaaaatttgacactaccaacaatttggtatgatagcaatccaaacatgcccttctactcctattaaaaggaaaaaaacaacttcaagatttgaatatggatatataggtgctcttgagatgtacttaatagcgcagtgacaagtagcacatggtttaaaccaatttcaattaccaattactccctaatattagctagggttcattatgcagtaatctcagctagaatgctttaggactcctttactaacgcaaggattttacagatattttgcaggaaatagtttaattttcacaaaattcccgtaaaaaatggaatgaaagatattttctccgcagagccatcgcggagatccgagcgttccgcccggaagaaggaatatcccaccgacatgtggggtccacccgtcgccgtcggccgtcgagtcaacctcccccctagtccacgtgcgcatccgagtagataaagttggctacctcgccacgccaacccagccaccgtgatcgatcgatccaacgacggaaaaccgccgccgcggccgaatccgagccccgccggcgagatcctcgcggcggcccggcggccggcgaggccccacgcgcgctcgcgcgctcgtgccttcctcgtcacgacacccctaggttcatcctaggaggaggggaattcggattttggattttggggcatcgtgttaatggcggtgcggccggggtgggcggtggcggtggcgcgggcgtcggcggcggcgtggcagcgcgtggcgtgcaacccggagacgctccccgccgaccaggtcctcgggctgctctgctgcgcgccgctccacctcctcgcccgcctcgccgcgttcctctgcatccccttcgtccccgtccaagccatgccccgcctcctctcccctcgcctgcaaggccacccgcgccgcctcctcctcctcccgcctcaggagttcgtcgaagtcgaacctatgtactcccctttcccttcctcctcctcgtcctcgtcggatgacgatgacgacagcgacatcgaggacggggagattgttcatcttcacttcgattgaggttcgcggctggtcacttaccgcctttgatttcgtatccatttgttcatagtctagcaatcctagcgtgtggaaaggaattgtgaattgtggaactctggataatatgtagctctagtgacaaatgacacaaattcagctgaaattttcacaatttgtccctttgcaaaaactttttttacaaatgaaccgctgccaaaacttatttcaaaaatgactcttttggtcagcaccaaatcacctggcgctgaacttagacacttcagcgccatgtcaactggcgctgaatgccgtgccaccgcggatgggagactaagtcagcatgccaatgcatatttagcgtcacgctatttggcgctgaggtgtctaagttcagcgccaagggttatttttgaaataagttttgctgacggttcatttgtaaaatagtttttgcaaaagggtcaaattgtgaaattttttgcaaattcaggatcagtagtctaactacccgaactcattgggcattcgttaggtcgcccacttgaacaaaccacagtaaaatttaaagttcaaacatgtgatgtgatgactcagttatggggacctgcttactagacagtataacttgtaagccgctgaaatttatttatatgatgctaatcctcaatatgtctggaggagatatctcacgtaggtcagtaggtcatcatgtgctgaaattctgctgatatttggttggattagtgtgcattttcattgttcgatcggtatttaccatcttctacagatgcagttaggtgtagtttagtcaaattagtcagctaatatagttaaatgagacccgaaccattgataacatcagaatgaacctagaatttaattaccttttttgagttaatattttcttttttaaaataattttccatccaacctcactactttaagtggagagagtgattctataacactatgcacactcaattgatttgtaccatgttgacttattagaaatctgatataaggttgttagactgtctgttccgtgaacttgcataagattgcataccgtgttttactttagcctattgttgtggtattattcaatctatgttggcatctatagaaactagaaagtagtggatacagttatttgcgtatgcctcattcctgtgcaatcaatgacagttggccctgacagacttgaaaggttaacctgatagtgttcaacattctggctgacagcagtttgatagctataagatgatgatgagaaggacatagttctcaaacttctgtctgcatctgcataattgcttgctgtttccaccttcattgtgatgatgggtggtgccttgtatggtcaatctgctggaaacattagatgtgccgttttcttaaattggttgatgggcctaattccatgctcagggaggaagtatgcttctggaataaaatccttttgttgaatgcgctcattcagtcatgcaaaacaagctagatggatctctggccactcctgaagaaaaatgcaacattagttcgtgcagtttgactgtattcataatttgttttgaacttttagaatatatattgtgcttgcttcatttggccatttgggtatatttcttgagtagatttttctactcaaccttgacagttttctagcttctaaaagatggtatagaactatatattttgggactattttgtgcgcagttaaagtcaagctgtagctcaactagaatgcatcattttttagtgaaagtaatgtgctaaaaccattcttttttgcatgggaaataaagtaaccaagtgaagagatttacaacttacaacttccatatttcagtgcacattgatcttttaatatgttttccgtcaccctcacaaagcaggcgtgcatgtttgaggcttaagaattgtggttcatttcttaggacctcttctggatttaaaacttgagttgttttgttgatcccccatcatctctaattttcgtctatttcaggttgcttaggaataaggctctgtgggaggcaacttttgggctttcaggtgcaaagattgaatgcatacttgcattctgtacctgatgcaaaatcattcgcccttgcatctagcactcagaacctaacacgttctgaggttgttcattgataatagttccataggttagaagctctatttttatgattgcattgttttattgtggaactcatcactgggtagtgctgatgaacgccacacactgtatttaaaagttgaaatgcaattccagatattgattgaagatggctgttttctttgttgaaaatatgttatgtattatacttgatgaatgatgacacagcattgtgaagcgcccatcttcgttgtgagtacactggtatttagcacatctttctctctataaggacaggacagaacaaggaaatggatctatcatcttgtcatcttttgctgtctgatggattacttttgctgtctgacggattacagctgtgctctgtaccatgtcggtttttgagtaaaggtaatgttccattcttcctatactaaaataggttgccataaatgttggtaataaaacgattaatatagtcttaaagaaagaaaataggtcatattttttttgttcaggaattgaacattgttgtgaagacaaggagaatctttgattacagaaaacttttgtttgtgcttctgtctgtgaagtggattttagtcagaagcactaattctgtaatgattcagcattgcattttggcaactatatgtgtagtcatcaatttttttgtgtctgcttagcgacttatttagtttgtggaattgcatttcccaagtcaagaaatattataagggctttgggcaaggtggtgcagcagagagagggagggagtgagagcacatatctgattcatcgcatgtgagcacatctctgattcattgcatgtgatttgtgcttctgttatgttacagtgaaaatggttcatcctgtttattgtgatcacctatcaaggtaactgaagatcttatgtcacctcccttttccagctttactgcctctggatatcctctttttctctcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13143 - DNA, 2586 bp, Oryza sativa
attcctgcagccctgttcccgggagggcctgacaggccctgacagcatttgaaccgggactaaagatcatctttagctctagtttttattgtaactgtgactattgtgaaattcggccgaccgacgaaagatggttcttcaacagtgatagtcgggcgacgatagttgtttgtataaattgttagccgagacaatgtagcggtttggcagcgacagtcgacatctacctctcatgattggctgccggtagaagggagtctagcagagtggtgggccagatccatcaccgtgtcacctccctgcctttatcaccactcgatcaaaacgtcggattgtgtgtggctgcaggatcagcattagtaggactcatgcgtgcgaggaggcacaggtgatccggatccatttgtgagatgatgcaagtagcaatggtttctcagttgcttgccatgtctctctctctccctcctctatggaggtcctattttttcctctaacgatgtctttattactagttaagagtttttatactaatctgtgaaccggtgctattttgatttcgaaccgtaggattgtctacatcaacaacccatcccatatggaacctatggacttttggcgtatgcagttgacttgtgttgattgaaagaggccatgaacgcaaattattttcactattaacaaaattcaaaaggacatagggattgtaaatcagttatacaacttaaaaaccatagcaaaacttatccagctagcaagcaagagtactccctcggtaaaaaaattttttaagatgaatccaaataaatactttatctgaatttatctttaaaaattaatatatttttttagatagagggtgtaaatgtacctccctctccactcggattatccccctcctttctctatctaagcttcggatgtcgccatccctgaaccgtgtatccgcacaccaatgcatggtacccgtacatactagtgtaccacgtacggtacacaggattagcgagcatagttgatactccatctctgctcatcacgacaagaatttgtgtcgctatccgcgatccatggtatcccaagccaaaacgattggctttgtttttctgatggatggatggctgactgacacgataagcatgcatatctagttatcttctactactgctattccctctataaaaaaaacaaaccgggtttatctttttttaacaaaccggatttatctttttttttcagataggggaagtacaatacaagtatgaaggaggatcggaaggcataaaagattttggtcaaattgatccaacacagcactgtgctaagattgggcaccgccatgtcgtacgaatctatcaaaatagtgcaaacagtatagggaacaaaatccacacagttttctctgcaaataaattgttctgtccggaaaatatatactccctccatcctaaaatgtttgacgccgttgacttttttaaaaatatttaaccgtttgtcttattcaaaaaatttaattaattattaattattttcctatcatttgatttattgttaaaaatatttttatgtatacatatagttttacacattttacataagtttttgaataagacgaacggttaaagatgtttaaaaaagtcaacggcgtcaaatatttagggaaggaaggagcatatagaagcaaaactagcaatgcttcatttaaaggagtgtttttttaaagaaaaagacgcacagttttccgctgacttttccatgcatatggttctttcaaaaacagaatcaaaggactcgctaaactacattcgcataatttttaggggcaaaatcttccgaaattgcatgctaccttatgcttggatgtgcttcttctccatctctacaggtgatctcgcctaatggatttagggtaccgatgagagtgggggggtggaggttctccggtttagaggaagactgaggcaacagcggcctcacggtgggtggtggcagcgtgccaccaaagtcactgggttggcaatgggcggttggagggtctcatgggtagtggcaaacaatgatgctagattaggatgcggcgggtggtggcagtgtatctggtgatgagagtaaagagaagttgaagacaggaaagacagcggcgtgagatcacaggaaacaaaggagtgtggtgtactggtgtgtaaaaaatgccactagagaagggtaggaaaatgatggggtagagcttctcactgaagggcatggtcattgtgaaggcgatgccaacaaggccgaacagtcatgttgtgtggtgtgaagttagggagtaattgtggcggttgcctagggccaattgaatgggttctctatatagggcctgtttagtaaagctccaactcccaaatttagcaccaggagttgagtctgaagtggagttgtggagcttcctaaacccagctccacctctctagttcatttcggagagagctccacccagctccgctcctattttaggtggagctgaaactgtttggctgaactccagctccaggagaggtggagctggagctggatctgtgccaaacaggcccataataaggtggggtt

SEQ ID NO: 13144 - DNA, 8356 bp, Oryza sativa
gtcaaacatgccctaagtaagctttctttggtacagctccaaatccaagttttttttgaagctggatattcctaactccataaatctatgaatttagatccacaattacattgataacgtttaaataaatcattttatttccgttttggatgaaatttaaaattttgaaccattataattcaacgtacaaacttcaaatatactatagatctaaaatctacagagcctaactataggagagttgtcgtttctattagtaattaaggaaaaacaagacttatatatatagtgaacaaagaaaaagggattgtcagtccagaattcacgtgactaaaactataatcagtctctttttatgtcttttggacgaagatctaacacatctatctagtttatgagacccctctttcatgtttaaacatgatttcttcttattaataggctgaattaattttactctaacctggaggtgaaataaagctacatttaagacaaaaaaaatacaaaactaaatgtaaaaaatattcaacttaaaatataaagtagaattatatagtaacaatactgcaactcaatatgagctaacatttgcatattatatatcattggaattttcagcttatcatgcaattttgagtaactataaatttctatgtgactaatatagtaaaatccaaaaaaagagacatccataaatgtgtggacctaagaataagcaatacactgggaattactcaaattgtgaattgatctaattgaccatttcaagctcgcatttggtctttatgttataaaggacaatagttggaaatatttctatcaatacaaagagtccctggtggttgcgttagtgtttatataaagttttctacctctaaactaggaagccatacgagtaaccgagcatagattgttaccactaccactcaatgctctgaatagcaaaagaaaagttagaacaatccgatctgatgatattcgcatcggtgtagaggaagcaaccaatcgtttccggcctccttgtgcgattatattttcacttcgctgcatcacgattatgggcttgttcactttactaccatttttaaccttaccaagttttggcattgccaaattttagtaaggttgtcaaaattttggtaaagttgccaaattttagcaagattccatatgtacttacttaaatttggcaacaaactaaacgcaaccacttttttttaactttgttaaaacttgcaggtaaggttgaaaatggtaacaaagtgaacaagccctatattctcgcttcaccgcaccatgattatgttctcgcttcaccgcaccatgattatgttctcgcttcgtggcaccaattagtactctagtatcaatatggcagtgcctctagtatcaacactttgaggggtggaacaccaagtgtagttctgctagcatctgcattggtagggtttcccttgagggcagagttgcatcgatgtttcacccgaggtgagttgacgactatatctcgtgtttaatctctcggccatttgtcctcagaatttagagagctatcgaattgggtcttgcttataagtcatattttgtttttgagtaaaattttctgtatacccctgaaaactcactcaatcccttctatacccttaaaatttacacgattccttctatacccctgaaattttaacttgatccctttcatgcccctgccgtcacattttccttcatttcaccattaagttggtggcaaatatctttaatgcccttgatgatttaggtttgaatataagcttgaaaaatgattgaaaattttgcttgagtgcaaatatgtgcattttatgtagaaaatgatactaaataattagtgcggaaaatttttacataaattttaaaataaaaaattttatctgaaatttaatagaacaatagatttttttatcgggagcatttataaaaaaaatatggtgagcattcacagtcctatctttatatgaatgctcctcatttttataactttttaaaaaataaaatacatatatattttttatttcattatctaaaaatattttgtatcacacatcgaactcataactataatagtctcatgcgacaaacttttacatttccaataatgtaattcgtaaatttgtatgttcatccaaagggtaagtcatttttatagaaattatacggtcaactaacggtcaactgacggaagggttatggaagggataaaaatcaaatttaggggggtatacaaggaagtaagcaaaattcacgggtatagaagggattagctaaacttttaggggtatacaagggattttctctttatttttataggataagacgttgaccaacaattgctttactaatatatgggtatcattatatgaagaaaaaataatgataagaaagtactttcgaaaacaaagccatattcagatcacatctaaataagtcgttctagcctactaagtatgatttttaaatacgcaagagaaccgtgtattattttatttcgatcctataagaagaaggggaggttaaacatttacaaaccacccactaacatggtgacggaaaagcaaaggagaaaaacacaaaattcttccaaaactaagaggatgcgaccacaaacaccaaaactaccctagccacccctactacacaaataattttcccgaacaagcaccttagtaggttgtagacggattataagtgtccgcgtttggaaaaattgaccctcattttcgcatctggctccttaagagaccctcgtgcggccctcttgagaagctgtatgcaaaaatagagccttttttttccagacggatctcttaagtgaccacacgaagaaacatattttcacagacgggcctcttaaagtttcgtactgaaatttaagttatctcctcttttccctcttagcgcatcaatttttttttcaagttatcctctctctacccttatctcctccttatctcctctcctcctctcctcctctctctctcaaactcctctctcccggaaactctctcctctctttctcccaggcgcatggcggcagaggccggtgagcgtcctgtgcgttgaaggcggcggctcccccgtagtggcaggaggagcacgacagtagaggcgggcgcgtgatgtgtggccgggccctgcctggatccgtatggatccggcaacagtagcgggaggagcctggtggtggtaggcgttttgcgattttttatttttgcgtgtggacgacataaacacccgcacgcgaaaatcggattttcatgtgcaggtgcgccacccgcatgaaaaaatagcgtttttttgtagacccttccgggctgactggccggaggtccgcacgcgataatcacttttgacttgtctggaaaaatctattaacttattaaaggaatagaaaaaggagcctccacgttcgctctcacggcctagaaattctcatattaattggagaaaaagaaaaacatagtccatatagaaatacaatttagaaatagttaaaattcgaaattaaaaaaataaggaatattgaaagaggagactagagtccatatagaaatacaatttataaataactgaaattcggaattaaaaaattaagaatattagaagaagagtatagagtccatatagaaatacaattaagaaataatagaaaatcggaattaaaaataaggaatattagaagtagagtatagagtccatatagaaatacaattaagaaattatagaaattcgaaattaaaaataaggaatattaaaggtagagtatagagtccatataggaatttaaaactaactaaaattcagaataaacataatagaattaaaattagagtttagagttcatataaaaatataatttacaaataactaaaatttaaaatttaacaaacatgggaagaagaatatgaagtcaatatatgaatataatttagaagtaactaaaattcaaaattaaaaattaaagaatattgaaagatgagtttagagtccaagtccgtataggaatataatgtacaaattactaaaatttgatattaaaaataattaataactaacacgtatataaaatacaatatgaatattacatattagtagttttgtaaagttagtacaaaatttaaaattatgttgtcattttaatatattagaataatacattgagaaaacatatatgttattatatgggagaaaatataatgatgctagccgcgcaatctgcgcaggccaccatgcttgctgttttcatactagtgctccacctaggccaagccactagctcttgataaacatcacaaaaaccatttctccaaaatcttcttaagaaccaattacacactcagagactatgttaaacatgcaaccataatccgaatacataattttggtacacgaatcaatagtggttcttaacatggtatatttcactctcaagtatacatcatatcgattggctgaatttgaagtgtatccagctgagccgcatgcttttttggcaaagaccgaagatacaccttttgctacaataagatttcagttttttttaatagattaatattccgatctttactcaatgaagttacaaccaatttttacataagattttttttggttaaaatgaaatttcattggctgatagctagagacccagattccacaatattccgtactaccgatcaggtaattcgagagaagggaggtgaaagcagaggatgggccggaacggtgccatgaataaggttcggatctgccgaccatttgcatggcatcaagatttactttttgtagatcattacgtttgtgctgctactccatttgcatggagtatgaaacatcggattggaatcgatctcagctggtcaataattagagagagagagagagagaggcagaggcagagaagaggcatgagtaaaaaaaagtgaaggcaggagcagagagggagcagaggaggggcagagggtgcacgagtgggcagcagagaggagagggagggagatctaggcggtgtttgggagagaggggatttatatttttatgagagagactaaagtttaatacctctcttaaaactataagtctttagggaagggatttatacttttgtgagagggcctaaagtttagtcccttcccaaacaccccctggtgaaatcagcagcgtagggccaagtttttatttatgtgctgccacccacgctcacatgcaccttcagtagggctcacacacacatacacatacacacgctctctctctctctctctctctgcaaatgacatctctcattgcccaatccatccaatgaaaacatctcatcttaatctaatcaagcgccgggcatagtgtatagtagtagtactttcgttagttaaatcacagatccaactaaccctgcagctgcgtacatatttccatgtgagggggtgaagggccatctatccctgattgcagaactcatcagcttgctatgcccccatcttgatcttgtaattgctcaatattgttgctttgagtgctgccattctaggtctattcatctaaggtttttttgtggctaagttaaaatgcgtcgtaaaatctaagtaacataaaagcttatattgaccgtcaacaatatattattttaaaattattttgtcaatattgtatggcaatatatttttatcagtagtgatagtgttgcttggcacgagtttcaccatgttgcggaggtatgctgaataaggtctgttcgaaaccatgcaaaaatcaattgtattcattttatggcataaaatgcccaacccataccattgctaatcaataactaaccaagctaggtttaatgtttaacggtttattcaaatttcactcttaagtatacataacagtttaatcgtagatggcgccccggatgatgtatacactcctgtatgtgcagatgcaagcacgccccatcctggtcctccaatgggaaccaccccatgtgccacctcaatggcaatgcaaccttctctttccatgttttgtttacttatcctttgataaatttacctcatccattatttttttctaatataatgtgctgtttgatttggcatagttttgtttgatttaaaaagatgcatatgtaaatataatattttgatctttcaaaatgtctgtggtgccttttctacaatataatcttacatacattttataaatctgtaaaaaatgtcttgagccttatagttaaatgggggaaagtaataactagtggtaccatgtagacattgataggtttactccacttataatgaaatcaacccatccacctataaaatctcattgagcactgtgcatgatcaatcagtagctagacactaccatgtatcgcgcacatggcgccggtcatcgacaccaatgcactcatgcaattcctcttttcagtttctttattttacatcccggacctcatgattgattggatcgacccactcacaaacaaatcaacattcaagatcaaggacacaacaacatctttcgttgaggaaaagaaaaacgagctagagaaagccaagagcaaattaaatgtgatctcttccaataaaatttgtgatgttccaatggtggagtacgcaaattaactagaaccaaaagccttaacttttttttagactactaagcggcttgatttgtacttgttgctagatttttcctaccaaactttgtgcaaatgtggtacgtcaaagtttagaaacgcaacatccatcaatgattggaggaaaaaattggcaagaagatgaacctaataggccctagccaatggcaaattaagagaatcttgtcacatatagtagccatccaatacttgctaaatcttctagtgattgcctctgctagaagttcaaaatatagttagtgatcgatcagagagacagctcctggataggtcgatcactataaaatattattagttgagtccaccgtagaatatattataataactataaatattagcagaaattaatacgacagatcattctctaaaattcaagttctatagtgctggttgaaactgaagatatgccttatattagtatatattttaataaaccacgaacacacattaatatgtgcaaattaatgtcgtgccttttgttataaacgaaggccattataaattgcagggtgcacgtgcaagtctgcaaggttggccatccccagacgaccccagtcctcccagccggcgtccatgatttgctcccactggtctgaagccgtgtgcagtgttgtgctcgtgtgtgtgctcctcgatccgtcgtcccatccccatgcaccaccacaccaccgtgccgtgcgtcgcagcgcaggagtagtacagtacagtagagtacagaagaaatttcagcagaaggaggctgcacgcctgcacgcccatacgcacgcacgcggcggctgggtgggtgggtgtgtgtggtgtgcgtggacggggatgcgtccaagcgagcgtgcgcgcggcgcagggcggcacacatggccatccagacgcgccacctgtaggcagctattctacgcacgcacggtggtggtggtggtggcatctctgtctctcttgcgcgcgttttattccttttgaccggtgcgcgcggtgccatcccaccaccacgcagtcgcggtcgcagtcgcagcggcgcggctcccgaggccaagcatgcgccgcgccgcgccgcgccgcgccgactactactccagtggataggccagtgctacccctgctgcctatgtaggtggtgtacgaaataccaacgattctctaccataagagcaagtttaatagtatagcctactattagctccaatttatttatagccaattcatttaatagttgcttactatactattaatatatggtcctacatgtcaaacagacatcgcttcttggagtcaacactgtagctagttgcagatctatagcccgttgttcttctctctcatcttttatctcattaaaatatgtttacagctggctaatagcctgctattgtacctgctattgtaacttctctaatgtcataaccattattggctctaaatcatctatagtcaacttaatagtcaactcatacaatagttacctataaacatatactacataattaatatctggtcccacctatcatacattcatgcaccctagagtccatgctgcagctggctataaatctatagcccgctgtccttctctcttctcttttatcttctcgaaatgtgtttatagttggtttatagcctgctattgtacctgctcttagagcaagtttaatacttccttcgtcccacaatataagagattttggagggatg

SEQ ID NO: 13145 - DNA, 9484 bp, Oryza sativa
  unsure (1)..(9484): unsure at all n locations
ggatgtgacatattcgtagtactagaatatgtcacatcccttcaaaatcccttatattataggatggagagagtaatataagggattttgacattttgcttgcattgtttgaccattcgtcttatttaacaaaattttggaattattttttttgacttactttattatccaaagtactttaagcacaatttttcgttttttatatgcacaaattttctgaataagacgagtggtcaaacagtgcaagcaaaatataaaaatcccttatattatgggatagagggagtagcccactagtagctccaattcatctatagccgatttaatagccaattcatacaatagttgcttactatactattaatatatggtcccacctgtcatacacacattacgtcttggagtccgtgctgcagctggctataaatctgtagcctgctgctcttctatctcatcttttatctcattaaaatatgtttatagctggctaatagtctgctattgtacctgctcttatgatcatctgtatgtgggttttattcttttattgccctataagtcagtgttcataatgatagcgctattatgacagaggatgtgaatctcgtggctaggtttaccaacctgttaatcttctcagtttttaaaagccacataaaccatgtggataaccatcatgataaccctatgcgaaaagatttgatgaaccctgtccgtagtaatgcttctctctacatttgtactcactccatctacttttgatagtcatattttcaaatctgaaaaatttatttttgataagtatatttcaatccaacaacctatcatcttaataactttctcggatttaatgcgtgactctccattcttccacacatgactggctacatgggcattaaaaatataaatattaatgaatcgcttgtttacgaggaatgactagtagcatgtttaaatggatgataagtagaattacttattcttggtctatgtgtcaagatgaaatatgactatcaaaagtagatgtagggagtatttatgaagcttatgatagctacagtttatcccaaatcagaagtttcatataaacatttgagcttttcaatcaaattttgttaaaccgtagtgtagagctcaaagataaattagaagtcaaaaaccgaatcttctagccttttttaattcttattagatgcttgtttagagcaagtttaatagtatagctaactactagctccaaatcatctatagtcaatctaatagctaatttatacaatggttaacttcaaatatatgctacattattaataattggtcttacatgtcatatacacacaatattttagagtccgtgctgcaactggctacaaatctatagcccacttctcttctctcctctcttatctcctacacatatgcttatagttaacttatagtctgttattgtacatgctttgagtatccaaaacttctccaagcaaacctatgggcctgttttggggagcttaagattctgaaaagcagctggttggtagccatcttataagaatctagaaaagctgggtttcccagcttctggcttctagttcattttctggattctacaactacaacttctcagaatctagaccaaaagctaaactgtttggggggagtttttgattctgggagaagctgctgcagctagaagctccccaaacagggcctgggcgggggtgggggcgggtgtgattttcgacccgcaggggtgtcagggatagggccccgcatttgggcgagcaggggacgggggagacattttaccgacggtgaccctcgggggcatggggatgtatataaaccctcaaaatatagcgcatagaaggcccaaaaagcccaacccaccataaaaagctactaaaccctagcctctgccttatctctctctcagtttcttcccatatcccctcccctcccgtgagacacacaggcgcctcccctcctgtgagacacacaggcgacgacgcaacagggcgcactggatctcgctgtcgctggccaccatctcccctcccctcctctccagtctccccttcggcatccggcctcacgaatcccgtcccctccacagctctacctctccctccggagtcagcaaggggtggcggcggcgcacagggcacggcggggaggcgagacaggcaagggcacggcgagggaacaggcgcggacagcgaggttgcggcagccggcgagacaaacaagggtatggcgagggaacaggcgcggccgcgtgaggttgcagcgcacaggcacgggcgcggcggcggccggcgattcacgacgagcttcacctatgcacaggtggcgattcacagatagtgagaggtattgctacatctccaagattccaactgtgccttgtgaatgaaactgtgcccgcaattttctcgtgtatatttaatagatttggtagtacatagcacataacataacaatagaatctaatacggggctctggtcaggttgtggggccccggaggggtcagggacgagcgttgtttttgacccgcatccatgatcagggcaggagtgaagttgggggtcggggtctggagcgttccagcccaacccggtccgccccgccccgttgccatccatacctatgcctatctaacaccctagaattcaattccccttttctttattgtttgaaaaaactaattttcctcggtgcagctgcaaggcatctgaccattgtctcgacacatacccatagtcaaggccttgccttggaatgtggacccttaatcagaacatgaaaatacatattttttctatataaatgctactctcgtatagtaaatttatttttcacccatctcattcgttattactctatcaaatctcttgcctactttaattacttctaatacatttattactttcataaatattgatgtaatgattctttaaaagaaacttattttataataaatgaaagaagttaaaaataaacttgcttttaacaaaggaagtagccctgtctcaaaataaatttatttttaatctttataattcgtcataaacaaattttattttttaatacttcttaccaagtataagatgcattttgatcataatcacaggagcacaggttcaaggcagcgttcctggcccgggaacgtccaccacgtccggagaacgaaagaacattttcatccagactttttaaaaacttcacgcaaaaaagcatacaacgtttctcaaccccgttccttgatgagaaacctcgttccttgatctcatcagaaaccatagtttttcaatcatcttaatttgggcttcaatagctaaagataaattatttcaggaaagatactacacaatattatttgtcttatcaatcatctttcatttaattcttttcatcttaatccaaacgactctctcacattaaccatctcacatttaatatgaggtatcaaggtctttttttttgctctattaaagaatctaaaagtgtttatgttttgtaacgaagagagtagtaaataggtttattaatagcaatacatagtatattctcctttagataggttaaagtacaacatataaaaaaagagagtagaagcagtaatttttcaaaaaaaggccgttcgtgtgccaaaatctttttaagtatacggatacacatttgaagtattaaacgtagactaataacaaaataaattacagattccgcctgtaaactgcaatacgaatttattaagtctaattaatctgtcattagcaaatatttaatgtagcgtctcattgtcaaatcatgatgtaattaagcttaaaagattcgtctcgtaatttacatgcaaactgtacaattgattttttttttcatatttaatactccatgaatatgtctaaatatttgatgtgatggaatttttggaagtttgaaggtaacttaaacactgccaaagttaggagaggggagaagtaaattaaaaaaaagaagaagaaaaaggcacaggcaataattcttgtgctgggggtggtggtggctggctggctcgcctatataaagggggagggaggggcttctcctcttccagcacaagcaagcagcttgaagcaacccaccacagcttccttcttcctctgcttcagcagagcaggggagcagaggagggagaggtcactcattcacaacctcatacagaaggaagaagaagaagaagagaagaagattcacacatacatctatagataaaatatatttatacatatagagaatactcagagagtagccaagagaggaggaagaagaagatggtgttggtggcgattggggtggttgtggcggcggcggtggtggtgagcagcctgctgctgcggtggaacgaggtgcggtacagccggaagcgcggcctgccgccggggacaatggggtggccgctcttcggcgagaccaccgagttcctcaagcagggacccagtttcatgaaggcccggaggctcaggtatatgctatattactccactatgaaacaagcaccaaaccaaagcaacacaacaactaactgcttcttttgacatgctacctgacgcgccatacattccttcccctgcaatctctgcatcatgcgtgtgtatatctatctatccatcatatgctctgctctctgctctgcaatagcaagcttgaagctttggccatggggggagaggcagaggaagaaggagctgctgcagtgctgctgctttgatgatggtgatgatgatgaagatgtggggagagagagagagagagagagagagagagagagagagagaggaggtgatctggaggaagggagggacctcggagctgtgtcccccaaaagctcacactcatcactgttccagctgggagatcctctctcccttccagtccaccaaaaagtgcccaccctcataacacacacacacactaacactcttacacaaaagatatgattttttttcatcccaaggaaaaaaaaggagcgattttttttaattacatccatccccacttggccccctcctaaacttttctcccttcaatgatcaactaaaagagaacatccacagcacaaaccaagcatttgtttttcttctccttgttgcagaatctgtactactagcagcagcattcatccatcacaatcattcattcctccatttccttttattatcaacgagaaaactaatcaaacactaataccactagcagtagcagcaatagtagcagtagtactaaaagcgaaagattttgcaggtacgggagcgtgttcaggacgcacatcctggggtgcccgacggtggtgtgtatggaggcggagctgaaccggcgggcgctggccagcgaagggcgcgggttcgtcccgggctacccgcagtcgatgctggacatcctggggcggaacaacatcgccgccgtgcagggccccctccaccgcgccatgcgcggcgccatgctctccctcgtccgccccgccatgatccgctcctccctcctccccaagatcgacgccttcatgcgctcccacctcgccgcctggtcctcctcctcctcctccgccgtcgtcgacatccaggccaagaccaaggaggtactctctctgcttctacttctacttctccttctccttgcatggatatcatcgtcttcttttcttttcttgctttctgaaacaacaacaacagtagcagtatcaggcattacgatctgtctggttattagtagcagtaatgagtagtaaattattggggagggtggtaatttgtgtggggcccaccgtaagaaaatcttggtctctactacgagtactaccctgcattaagaaaatctcaactgttgacattagttagcactagtactgtactgtggttccactgatgctgcaagttggcaacaaagaatgggtggcaccactagcagccagcagcagtaggaagcacacagtaattacctttttgacctttctttaccgcactctactgctgatagtacaatggcagcagacagaatgatggtgcctcttgcaaaatggggaatggagcaaaggaagaggaaaggaggggagaaggaagatccccctttcctctctggacccccaaaaaaggggaatctctagcttttctagaacacttgtactgctggataacaaaagaaagagattgatctatcatgagctctttcctcagccagaaataaaagacactctaccagacacagcatctctctcactctcttagtactaagtagtacatattcattccaaagtgaaatctatccataattatggccatcacatgtctcaaatgcctaaggaacttgttttttttttttttaaagtagcagtagcattgtatgagtacctggtttgcttttggttggcatgctgaatttcatacttgcatggcagctcacaccaatgtttcactttcagatggccttgctatctgcactcaggcagattgccggcgtctccgctggcccactctctgacgctctcaaggcagagctctacacccttgtgcttggcaccatctccctgcccatcaaccttcctggaaccaactactaccaaggcttcaaggttagctgactgcagaattgtactgatatggtaattcagttaaaactcatgcactgaagaactactctaacaaggcactcttttttttttcaggcaaggaagaagcttgttgcaatgctagagcagatgatcgcggaacggcgatcctccggtcaggtacacgacgacatgctggatgcgctcttgaccggtgtcgagggcaccagggagaagctcacagatgagcagatcattgacctgatcatcacccttatatactctggatatgaaaccatgtcgacgacctcgatgatggctgtcaagtacctgtcagaccatcccaaagctcttgagcaactcagggtatagataatctgaaaacaaaccacttgaatcccatgatgaaaaccatttcacacttcgagtttactgatgatctgttcacttctgcagaaagaacattttgatatcaggaaaggtaaagcgcccgaagatgccatcgactggaatgatttcaagtccatgaccttcactcgagctgtaagtttgatgatgataaactcagaaagcagccacagtaacagtgtagtctgatcatgatgaactcatgggcacttttactatgcaggttatcttcgagacattaagattagctacagttgtgaatgggctgctgaggaaaactacccaagatgttgaaatgaatggtgagatatgcatgatatatacgctgctgcaattagcatctttttgataaatctttggatagccctaatgcagtgcttatttgtttcttccagggtatgttatcccaaaaggttggagaatatatgtttacacaagggaaataaattatgatccattcctgtaccctgatcccatgacattcaatccatggaggtggctggtaagtaaaacagcaatcaagtaatttccactagcacaccaataacaccactattgattgaattgtaagtttctaaccacgtaatacttactgataacaggagaagaacatggaatcacatccacacttcatgctgtttggaggaggtagtcgaatgtgcccggggaaggaagtaggcaccgtagaaattgcaacattccttcactatttcgtgactcaatacaggtttgttcatcttgtcaaatcctctgttgcttagaatatgtctggttctttactgacaaagaagacatggtgttaatcttttctttgcagatgggaggaagaaggtaacaacacaatattgaagttcccccgagttgaagctcccaacgggttacatatccgcgttcaagattactgatcctggaacattttgcgaagttagataggaattcaaatcagatagaaaataagagtgcaattctgatgctgctgccctgatgacaggattagaacagccgtttggctcttgtaacatatgtccatgaaaataggaatattatagagataatataggcattataggaccattaggaagctaatgtagattgccatcagatgctcctgtattcttttggtccatcaattgttgaactaaaacagaagtgtcatttggcttctatgcttctgaacatgatagagagttaatagacaccagctgtccataagaacagaacacatggatgaagacttgacaagatacacgagttctcatagaaacagggatgaagacttcaaatttctcttctcatgtccactaactgaaagaaatatgaaatatgtaaaagaggaaatactgatagaggaacagtaaaggtgtacctcaatgaacaggctaaagcaagtaaactgcttcaatggtggctctcagttttccctatagataccaaggaactcatgttaatgaacaggggatgcttcaattggttggacaatatattgatgtcgggaaaagaacttgcctcacctcaacatactgaaaagcagtattgattgctagtacaggagatgttaacagttgttgaaatccagaagtgtcactgttggctgttgctgctattcataggacacgaaactacattgtgtaaacacagaggtgccagcccacaccatttataaattatataattcatcataccaaagattatacaaagggacaagtggacaacatttccagattgctacaggcaaattttctcaaggactgaaattcccctctaaatgaaggactaccaaaaccctaggtaaggcatgcaaggtattcaagtaaagaatgaaatgatacaaaaaacacaatgcagttctgttaacttgtagtaccaattccaaactagtagttctgctaagtcacatttttcataaacattactaccaaaacatcttttttgtggtgctgttatagcttttcttcttcgttttaaaaaaaaacaccctttattctggaagatacccccaattcagatcaatggcgttctttatcaccatgaaatgtctaaaataagactacacagctcaggtgagttgtatattggaataaaagtagcctgtcaagttattttgtggcaagattaataagcccttgaagttcattatgctcaattgtcacaatgaaaaaataaacctgaaaatggaaataaacttccatgggacatgagctatcaactatatctatttgaaacagttttgcactttaattactactacaataagttaatgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13146 - DNA, 6394 bp, Oryza sativa
gaaattagtggaaggcacaagcattggaagtacaccagaagatctatcagagtctgtgcagtagttccctaaatatgagctgagcacttgtaatgtgcatggtagggataaggggctactaagcctaattaaggtgttgcttgaccaggcaacccaggtgcaccgtctgggcagccccactacaagggcaaggaagaggagggagataccaaagacttttatttacttcttggttaatgaaaagagatacaaacctcatccttacatcaaggaatttgacctataagaaaattctctctaaaattaaggaaatacctgacagctcaacattatcttatctctaaacaactatgatgcacaaacacttcagaaaagttgagcattggtgtctaatgacatgtgcagctctgatacgcttaggatgcttatcgaccaaatgtcggatgattatacagaaaaaataacttcttttattctccgagacaaggtcgactcatccccgaatcatatgtgacaacccaacccacttggccaggacactaaaccctaaccccatctcaatccttcagctcccctcatctctggttaatagaattctagaacatatagacatctactgaaattgaattctaggagttaaggatcctatttgaggtacattttccttgcttaaagctcgcaatacattatttcagtggcaaacgattgaggatgtgaaaataatgcatatatactacttttttattagaacgtgtagtggtgtcaccatatcagtgtcatgcacgtggaacagaaaaagggccctagagtgtagtgattccttctactatatgagtctattgggtgatacatgacagcaattatgcaataacgaaaatcaagatgaaatgaatatattgcaaaaaaaaatgaaataaacaaaaaagatttcagtgcaggtaagtggtatgtacagctaggactcaaggaaaacatcattgagaaagatatagaagacctacaagattgcaacacaacattagacttgatggttgctcagattatttagctaaatatttaaaatgatgtaagtgtttgtggaacaaagaatttctcttgaacattcaaatacacaaaggacagttccgcacaagtgatgctttgatcattaagtaactatggctggattaaatcattagatgcatggcaatactactctgtggcaagataatactactttttttgtgaacgccgatgcagtgattcaggaacaccgctaatacaaattgtagtatgtacaataaattatatagtgtggtcattcttgttcttttcattctcataaaaaaatttctaagttcatttctattcttgaaatatagcagtcttgtaataaactgatggttaaggaagtcttcactctcatcggatgttggcgcttcctaaaacattatccttcattttaaaaggggcctaaaattgaatgatattttcagacgatgagaaatggagaatcaccaaaatgattaccatgacctaaaaaggacttcattaacattgcattatttgtttgttcatattatcaatacaagtctctaagaatagcagtctccagtgcattgtgaagggttgcaagtcctggaggaagaacatcaagttctatattatgggaatagttcattactaatagtatcgacgtgctttcactacacagggatcacaaagtttagccttctacattcctgtataatctgctaatcatgtattcactttcctcaaagtatacatcaacttatgaaataatttaaatgcccagtaaaacaaatcgagcacattaccaggctaattaatgaaattataatactgacatagttagcagactgcattggacagagaacagttaataacctaatataggttatcgaatagagtgatgaaacagtagccagggctaagtagccattcttgactggcatttcaaacttccagattttaggaacagcaagtgcatgcaaatgcagtacgcacctttggtgctactagtgttacacgtttttctcagaagaatcccaagctagcatgtcaatagagtccgtcaaagattgttagaaaacacttacggcatccaatattaataggaataatttcgcatcattggctccatctattagcacaaggctcatgatctactacgatatacagttttgtaatttgtacagactgaagacacaagggtcatgatcttatataagttaagcttgctctttcctacagcagttgcttattgccaccattacaactgaatcaaattgaaacatttggagtgctacagattataattgggacttttagcactgtgatttcgacctaacctagcaaacgctgatgtttaaatatccaaatgccctattagaaaaatataaggctccagaatttcaagaagcacctaaaacacactcattcatcaactactaccaattgtaaagtaatcattgcaagcctcaatagaggtctaaattctgcaaattcaaataatgttaagaactaaaattttctgtggactacaagagctgaattttatcacatgagatagttctacttccataacagaaaatcaaattttgtagggcatgctactcattgagttcaatgatacgccactctcatgtctcactgactaatggccccaggacccaaatgctaaagataatgttgaagaaacaaggatcttcaacattttaaacttttcattgttcacattgataaccccaatttgttacaagcaaataaaaatgaatggaagaaaattcatggcagtgaaaacctaaagacaaatcatgataaaatacaagtcatgacaaaagacaaatcatgataaacttttgccattgtttactcttactagatcaggcaaaacacaagtcctacaatcaaaattctttgcgactcctcaccctctacgatctggggtctggaccacgcatttggcatttgcaccacattgcaaataaaaatttaagccaaaacgaggtagtcaaaaccagcagttctagagttctagccctaagtcaggaaactaagcaggtataagcgatgagcaatggagacgattggacaagcaataagaaggaaggaaggaagctggacatacttggctgtgctgcccacccctgctctcctcccttgatgcgctcagggaaggcgtagttgacggtgaggacgcggccgaagagctcggcgccgtccatgttgtccatggcggcggcggcgtcctcccgctcgaggaaggtgacgaagccgaaggagcggtgcttctgcgtggcctggtcgagcggcgtcttgacgtccttgatctccccgaagggcacgaacgccgcgtgcaggatcttctcgtccacctcctccgccagcccacctgcggcaccacaaaaaccaagaaacgaggcacgggttcagctcagctcactaccacactgctactccgccggcggccaggaaaaaagataaccccgtgaaggaggaatttcgtcgagcaggtggcaggcgtggaaaagaaaaacagaagagaaagaagaagacgggtgaggagagctctagcttggagctcgtggcacgactggcacgtacctacatagagcgtgttcttctgcaccggctggttcatatctccgtcagcggcggcggcggcggcggcggcgacggcgggatggagatcagcgcaggcggctggcggactctcgtggagacgggagccgaagcccggggggagggggggacaaggagtcagagaggagagtgtgcggcggaagcagcagaggaggccggcagcggtgctcgccgggatggagatcggcgcaggcggcgcggcgcgggcgaaggagacaggacaggagaaggggaaggagaaggcgagcccgttccgccgcgatgttgttcgcgatatgggcttttccgtacccccagtctcgtttcggcttacgctttgggcttctctggaccaaaaacagcattactccccggagtagtactccgtatcagaacttccttttttaaagactgacagaatgttactttgaacttttgttttttttttactttgttacagaattaaaagaaacatcaaatgctgaaaaaattgtatttcttatcattgtaatttttaggttttatttaaatatatattatataagtatcctatcttactataaagttataacccactaactccttaaacttaacatgcaaaaataccacatcatcatccattaacaagatgtcacatcatcatccactaacaataatcacatttaaacattatgcaaacatgctatattatctactccctccgtttctaaataattaacgccgttgacttttttaaatatgtttcaccgttcgtcttattaaaaaagaattaaatatgtgaattaattctttttctatcatttgattcattgttaaatatacttatatgcatacatatagttttacatatttcacaaaagtttttgaataagacgaacggtcaaacatgtgctaaaaagtcaacggcgtcaaatatttagaaacatagtgagtataattttatagtttttataatttaagagcttttaaaatataagcattttaaattatcatcctagataattcacataatatttcaatgtatatttttattatgttttatgatatcctatatacttatatagtttatcctcacttagttagtgcttaaatgattaatctatggtccaaattatctttctctttttttctctaattaagtcatatcacctcaattgtttttagcctttagatgattaatctacggtccaaactatctcccaacttttcttcttccataaagtcataccaccttactttttacgtttgaatcaccattctacatactatttaaatttaaattatcataaaccacattaacttacttaatctgatgttatctagttatcttacacgttatttttttattgttatcatactaaattcccgcagcaatgcgctgggtttcacctagttaattagatgtgcatgctgtaaaagataatcactgtgacttcatcgtgggttgcgaccactttttatttcagagtaaattttataaaaccacaactattatggttaaatttgcacaaaacaacagaaattttggcaagcgacatataacccagatattatggttatgaagtttcacaaaaccacattgttagccattttgacatactcctatatcaaaattttgaaaagtaacatctatattatggataaaatcctcgtaaaatctgagatatgattgtaaaactcaaagtatgatagatcaaagttaaaatgatcaatagtgtggtttagtgaaactttagaaccataatacctgtggttatatgttacatgcaaaaatcttcatggtctcgtgaatttgtacataataggtagtgttttacggaatttactcttttattttatcatactcatccactccaaaggcccaagtccatctttgctaccattgaataaaaaaaagatcagtctatcaactatagttgaaaagtaactctctaacaagggggatttataattatgacactgcaaacataaacctttgctataatgaccctggacccacatttcatagacatagatgggcccatttgtcatccactcgaagtgtcaaaacaatgaagccccaatgtttgcagtcccaatattgcaaaattagcttaagggtgtgttcagatgcccctcttcccaacccctctccctcgttttccacgcgcacgcttttcaaactactaaatgatgtgtttttttaaaagtttatatacaaaagttgcttaaaaaattcaaattaatcctttttgaaaaaaaattagcaaatatttaattaatcacgtgctaatggaccgctccgtttgccgtgcgcaactgtgcacgttcccatcccatctactctctatttctcagctaccgtgaggcaagaaataaagtttgatgactttgctatgtttaatttagattataaagcagaccattgttatagattatctattggattatagatataaattaaacatttcaaaaattcgatgaataacttgaaaaaatcagagcctttttaatgcattactacaatatatcatattagccacttcctgatcaaaccattatacttcctccgttttatattaaaagactttttagtattgtacatattcatatatatgttaataaatctagacacggcaatgctataaagtcttttaacctataacggaggaagtattatttacttcaatccaagatcagtctaacctgatctcgctccgtcaacagtgccacccttgcacccacactcaatggccaggtgcccatagtttcttcattatgtgtttgattg

SEQ ID NO: 13147 - DNA, 14699 bp, Oryza sativa
ggggggctcaagtcgtgcggccgaaggcgcgtccttgtgaagatggatgaatttttagaacagaagcgatgtcatgcaaggcaagcgcgtgcagggaaacaaagtcgaacgaaaagctagctcagagtagaagttttcttccagagcaacagatgtaataacagacgatgagtacaaagttatctttaatttttataatataggtaatgataataaaattatttttggtggccttttgtttcgaaagaattacaatcaatcttccggatattgcaggtcgaattactgcgaattgaataaaaacgacttagattactagtctaaaagcaaagatacaacctccatttatatataattggcaaaaaaaaactgctaaatatttcatctgcttgaatgttggatgtagtccttgccttgcttaaatgaggatacaaaatatccaaaaacaatatccgattattatgccgattaaattttgctcagatcaccactaatgagagtacatatgcgctggattgtttcacttgccaccgcccctaacaactaaaccggccaagttagtaagtttcaaactaaggcccacgatcattagagcgtagaaggccggacggttagcccaacccatacttggttggggttggaggccggagtccgaagtgccggagaaattaatggagtaaaccggtgacttgtccgggttgaagagcccgaagtgcttctcgatggggaataagttcactttgagaccctcaaaagtgatcgaaatctaatccgtaaccctaaaccacaaaaccggatatcttgaccccttaactcttaaaagcggtgcaatttaactccttcggtggttttggaggacggtttcgctgatgtggcgcatacgtggctttctactcatcaaataagttaaaaaaaataaagtgaggcccacctgtcagtgagtcctctcctacgttctctctttcttcattgccagcagcggcgggaggacggggtgagcagcggcggctggtggcatcggggcgcagcgcagtcggcggctaggacggcggcggctcggccgcggaggctcgcgatagtgggaggacgagggaaacggcggcggcggcggcccaatatgctgctcgtcatcctcgcccttgcggttaccggcgcggtctccgacggctcgcgagtcgctggaccacatctccatcaactgcatcggtgtcgggggacatgtccggctgccgctccatccactcgcgcccgttcagcaccgacgaggagggcgaggctcctcgtccccgctcagccgcggctcttcttggatagtcccgactggaggcagtcggcggcggggagggagtgggaacgggagcgggacgatggcgacgacagaagaggaagctggctcgcgtcgggatcttggtggttcgtcggcgatgatgccgtgtgcgctgatggatattttgcaatcttgagctttttaatttctgttttgcatgcatatagtggctggctgaagtctggcttgttctttccagttatgcatgtaacgaactgctgatggagatgaataaatagagaagaaaacagagaagctgcggtgactggtgagacttaagcagcacaaaaaccactctgatcttcggtttttcagtttactgttcacagtcttacaatcttcagagtttcaaagattcagtgaggttgagcgtgtgagttgtgagcgaattgcaagtttcctgacgatggtggtggtctccccctctcccccgccgtaggcgacgacgcgatggtggagagcgcgtccagcgcgccgttcccgagcgacaggagcgtcacgctggtgatcgtcgggagaggcggagcagccacgagaggcccttgaggctagagcagaagtacaccgccgccgtgtcaccgagcaggtagaacagcacggcgagccaagccgccatcacgccgtagccaagaacccgccgctccacaccgaacacgcagtcgaacaggtacaggtagtcgacgtagtcacgcgggaatcgccggcgatcatggccatcctcctcggcgacgtgctcgcacctctccccatagctctcaacctggaatacaccgccgccatcgcgacgcccccggatcccgccctccttggacgacgataccacctccggcggtgtgccgccgcgcggcaagatgatgaagaagaagacgagcaggagcaagaaggccacggtgacgctggcaccgatcagcacccttgtcgccggctagtgcgaagaacagacgccgaccccatctcgccgagagctggcctcgccatcgtcgactcctccactgtggggaccgcttcagctcccgccgggcggcgccacaccgcagcccatgccctgccgccggccaaaggggaagaaggggagagaaaaagagagagaagggagagagggaggaggactgacatgtgggtcccacagttagtgggccccacatttttctgtgtgtgaatgacaaacgggtcccacgtaaattttttaattttaatgccacgtaagtgccacgtcaaacgccacgtggatcaaaggctcggtcaatattgccacgtaggtgccacgtggcgtcacgtcagcaaaaccgctctctaaaaccaccaagggagtcaaattgcactggttttaagagtttggggggtcgagatatctggttttgtggtttatggtcacggattagatttcgatcactcttaacggtcatgaagtgaacttattcctctcgatggcatctcccttcttctggttctcgtcaaacatggcgaatatgtaagtctccaatgccacgggcctcttgggcgtgccctttccgacatggttgatcaagttctggttgtacaccctggcgttgtccttgctcgcgccacgaccgtcagccgatggccacccggtctcggaaatgacgacgggcacatctgaccctccctccttctccattgccgagtatatgctgtcaaccatggcatcgaagaggttggtgtaggtgtgtccgttgtcatctatcgtcgtcgagcttggccggaagagcgcgaagttgaggtcgacgccgttgtcgttcttgtaggcgtagtaggggtatacgttggccagcagcggcgatccgtttgctcgccaagaacttgacgatgggacccatgatggagggggggtcggcgaacgcgcttccggaaggcagcggcgagccggcgaccaagctcatttcaacggcagtggacaccttgatgtggccgccgaggccggccgcggagagcgcgtctctgatgttgttcatggccgggaggatcttgggcttgtcggcgccgtctttcacctcgttgccgacggcgatgtacttgatgttgacgtccgggtagtacggccggacgttggcctggacccaggcttgcgcggcggaggacgacgcgttggtggcgtcgttggaggcgagagagcggacgtcgggggcgtcgaggacgacggcgattctggtgccgcggagggcgtgcaggatggtgtcgttggggaggtagatgcgcatggcgtcgatgtggttggactggtaaagctgcaccacgtcgcccggccggcgccggcaggttgtctccgttggtgccgtagcacacgccgatggccaaatctccttcgaccatgtacgacctccgacgtagtttgagagagccaaatgcaaatgtgtgtcggcgtggagcgtcacataggaggtcgtgcacggttaaaagaggtttagacctgtgatacattaagccactactaaaaactgattttcctgtgcaatgagctctttagattgcagacgaaccataattggtcgcgtctgcaaaaatcgtcccatcatttttgcgtgcggatgcttaagaggaccgacacgtgaaaatcaaatttcgcaggcggacctctccgtacgcgaaaatcgatttccgcgtgcggtcctcttaaaggcccgcctacaagtttattctccctcactctcttccctctcatcaatttcaaaaatctaaagtcccatctccccacagctttatctcctttctctctctccccacagccttatctcctcctctctcacctcctcccgacggcgacggtgacagggacggctcaggagatggagagacgcggtgggggggcgtgggacaccacagagacgggagcggcagcgagcggctcggcagctggcagagaccggcgggtgcgtggcggctcgcaacgatgacgaccgcgcgtggaaggcggtaagaggcaacagtgaccggcccccgcctggatcttggcggcggtggcttcgggcttgcaggcgcggcgggctggctccacggcgacgaggaggtggccggatccgcacacacgcccctaccgacgaggaggaggaggagcggtggtggcttcaggcaggtgggctcggcggcgaggaagaggtggccggatccgcccgcacgcccccaccgacgacgaggaggaggaagaggcggccggtgtggcggtggcttcgggcggacgggtttggcggcgaggaggaggtggctggatcagcgtgcacgcccccaccgaggacgaagaggcagctggcgccggtggcttcgcatgggcgggcccaacggacggcatggatttggcctcccctcgctcgatctcctccgtgcacggtggccccctccagcgacagatccggcagtgaggaggcatgggggtggcggatcaggcgacggcgctggcgacgacgaggacaacggcgaccacgagggcggcgtatagggttagggtttcggattttattttatttttcggtttttaatttttgtgtgcggacaacataagcacccgcacgcgaaaatcatattttggcgagcgccactcgcacgcaaaaattccatttttgcagaccctttcgcccgtgcggttagctctaccacatgtgaaaacccctctagaaccgcacggaaaaacctgttttgtagtagtgagccaaaattataaatttaaatatgtatcttacaagattttgaacataaatgacaccaccttacaactttaaacacatggcatgtatttgactgatgaggaaactacttcgttcggtgtttctgatagccaccaaagctttgagatttgtgtgaggggatagagatacaggtccattggttcaatcgctgttttttaaattttaagaattcatttataaacaacaaacatgttccagcagcatcattaatcgagcttcagtgttatactccctttgtttctttttagtgatgtcggttatttgttttgaactaatcaacatcatacattttaacatgaggggatcatcgtttatgttgtcatatggacttgccattatgtatactttcttcgttttcaaatatggttcattttaggatcttgtatctgatacgaccatggatactgttgatacaaccgtcgctcacatcaatattaagttgaccaagttttagaatccaattcggccacctgctatagtactgacttcaaacggccgccaaatatacgtacgggctccattttgggtccatgagtacttcatggaaagccctcgaagtactctttccaacgaaaccagcctcatctccaaattccttcttagttggttgcaatcgcaaaaacacctatattggaccgatgggcttgtaactttgtttgggaccatgacccaagtgaggccaatgtagggtgcaccccaaccaggcggagcatgagcctagggaccccttggtcgtcctctcaccttcataaatagctagatacccgttcagggttttgtttagattaaggcaaattttgctataagacatcgtggcttcgtggttttagctataggacaccacgcgaagtgacttttggggaaagacactcgcaaaagttggatatttgctggtggacaccacaccattaaaataatcatgtgaaagagaagagagaaatcacgtgaaagttctaaaatgcccttgggcccacatgtcagatctgcaactctctatatatatctctttctcaagcacatggggcccgcatgcaaacctctagcatcgttttccctttcttcttcttcttcttcttcttcttcttcttcttcttcttcttcctcctcctcctcctcctcctcttcctcctcctctgctcacaggaggaacaggtaacgtgaggcgtggcaagcttgatggcggctttccatgggcggtggcgacagaggaaggagatgcataggccggcagtgggcgagcagcgtagtcgcaggaaagacagccggcggtgaagccggtgtcgacgaggtccgcggggaaggaggtggatccaagaggagacagccggaagaggcgagtgacgccgcacagaggtggtggccggcgccgatgcgggccatgcggctggaggagtccagacggggttgaggacgatagggctagtggcgcagtgacagaggggagggcacccggtgttccaggcaaagaagctggcggggagcttggggacacggaggacgacgacggtagcgaaggagattcggtggtcagcggtggaggtccctaggcggtcgagggcaggaggtgaggtgaccatcctctaggtgtgatgaggacacaactagctcagatataaccatgactaccttatgtattaatcaactaaaggtgcagatgttttacattagatttacatgttatatatttgaacaaacgttgctacacaatgagtttcctatgtttttgtttgcataggtacttgcttgggcgaaggaaaagagaccaagcgtaacaaattcatggatgatcaaagaagttgattggggaccatatcaagaccttctccaagtacacttccatctcatcacgtcacttttggtccatagaagataagagataaagttctacacgttttggattcgaattcggccctcctgacagcatcaacttcaaacggacctaggcactgatctagaaggaatttcggggcccatgagtacttgttggaaagcttatggagtctgctttcagatggttttggtcccatatcaaaactcctaccgagctgccgagaatctgcaaaacaagccacgcaccttatccagtccgaatctgattttgagttttggccttgtaattgtgtcgtgggcttagcccaagggggtgtgcgccctagggcaaccctaggacgtccctaatcatattaattcagtagccgtcatcgtttagagttaggttttgcttagattactctgtcaagaatagttttgccgctagatcggtttgtggaaccccaaattcgtgtgcttaatcattcatatgcaatttggttgcaatctatcttgttcttgcttgtgttcttcgattcgcatgcagggattagccttctcggcgaggtcaaccgggtttcagcacggttgataaccagagaagacgtggtgctgcgattgcggggctcggtagcgtgtttgttcagaagccggatcgagttgtgtcgcgactccgctcaaatcgattgtttatcaatacctatcggaagatcgggacctaacaccccttatcagttggtatcagagcgcggttgcccgttaggtaatttatcttcccataaccagaaaattgcaacacaaaaatatttactctttacctagacaatttgagccgttgcattgttctattagattttgctttgttaaattctagattgtatcatcgtgtcgagtgctggtttagttttagatttaacttttagttttgagtattgcatctgttcatcacctagatctagggttcatcactcaagtgtgagagttgtacgtcagttttgggttcagtttttcatctcgtcgattgttgcagggaccttgaaaaattgaatcgtctcgtcgtcgggtttccgtttttgtgatttggagaaatttttatcgagtggttagagagttgcttgatttctagggttcctgtgttgccgtgtgttcccgagcttatgtgtgccatgagaaataaattaaaaaaaacgcacgaggttggttgatatgggttggatctgttagatataaaaaaaatattagtggggccacccttatcctgtggaggccggggccgaaacccccacccccacgtccgcaactaccacctcccctcacggccgaccacctccacctcacggcaatttctcccgtgccgcttcctcgattatcacattgtttggtattttggtggttgtagatttgagatatttttataaaaacggaacctacatgatgtgagcattccatttttgaggtgatctaattttagttttacactttgtatttgagtccctgtaatattcatatttacatttgagtctttctttgaggtcagtggttcagttcttgttgaaaaaaaaagtaaaaaaataaaaaagaaagaaaaggcagaaaggtgcaaagaaaaagaaagaaaaaaaaagccgcacctaaaaaaaggaaaaaaaaggcagaaatgtgcttaaaaaagccgcattaagaaagaaaaaaaaaccattcatccttggagtatgttttcagagtgcagagttgtgcattgattcatatctagtccttagtgttgtcgggtgcttgcttgagctagagttgagtctagactaggccagcacattgactagtaatttgaactattattcaactttgcattttctgattagtacaattgtgttcctttgctactatatattgtgcctcccaagttccacatatattcttctggtcagcactgctttgatccttgcaatcgccacatcacgtccttcaaggtgtcacgaaccagccactggttgtaccgtccttagcattgctggtaagacacttgtaagagcttagtaggacgcttccatttgcttgtctccactacaatccatgttctatagttaatagttctctcttttctattgacaatggcatgtgcacgtgatgaaagtactctggtgcaacaagtgctaagttctcaaatggagaaagcggagcaatggcagtaccacgaattatttgaaacaaagtttgtggttaaggatagagcatgtcatgctataattgatagtgaaagttgcaacaactctgtgagttcagatttggttgacaaacttgagttgcctacacaaccgcatcctcatccatattacatcgaatggttcaactcttgtggtaagttcaaggtaaatagaattgtgagaataaacttttcgattggaaattaccatgacactgccaattttgatcttgtccctatgcaagcatgttctttgttgtttggtcaaccataggtatgtgataataatggatcgcatgattttgttgctaatacatacacatttagacataatggtcgggaaatgaaattggtacccatgagttttactgaaattttcgaagataatcttgaaaggatgaagaatggaatcgaggaaattttcaaagatagtattgaaaggacgaaaaatagaatcgatgagattttcagacataccaggaaagatactaatattgcgatgccttcaactaagtctgagttattacaaaacgaacgtattgttgtgcctattgctttggatattaatatgttgcaggcatctgagaacaaccaaggtaatgaggaggaagagaagaaagacgaagagcaaaaagatctatccatagctccatgcatgcttgaggaatgtttaattgatcaagcgcctacaatttcagaagatgagaaaaaaggtaaagataatggtgctacaactgctcaaggtatgcatagttatgatgtgccaattatgtccactacttatactacgttagagaaacccatagtggaaacaattgttgaaatacctttgtcacaagacaaattgcttgatgtctcttgtgataaagaagagttgtgcgatgcttcacttatatccatgccacaactagtgaatgaacatgttagttctgtagtagagccacccagcattgagtttaaacatgttattcacattgatagcgagaatgaagagcttaaattgctatattctttaaatacttggggttatattcaatttaatgatttttgtccactcaactgtttagagaaaaaaattatttgctagatttgaattgccatgccgttctgatgtgatttttcatattattggcaattatgatagtaaaggagaatataatgtgcatcgagtatatatttgttctaatttgactatcataaaatgtattgtctagagtaccgcatgcatataagtaattctctatctatggccatcaagaaatgttcctcaccggatgttgtgatacataaagataagttcaatacgctctatgacaaggtgaaaccgaggacggtttctaatcaagaaggggaggatgatgaggacacaactagctcggatataaccatgactaccttatgtattaatcaaccaaaggtgcagatgttttacattagatttacatgttataaatttgaacaaacgttgctacacaatgagtttcttgtgtttttgtttgcataggtacttgcttgggcgaaagaaaagagaccgagcgtaatgaattcatgaatgatcaaagaagttgattgggaccatatcaagaccttctccaagtacacttccatctcatcacgtcacttttggtctatagaagacaagagataaagttctacacgttttggattcggattcgggcctcctgacagcatcaacttcaaacagacctagccactgatctagaaggaatttcggggcccatgagtacttgttggaaagcttatgtagtctactttcagatggttttggtcccacatcaaaactcctaccgagctgccgagaatctgcaaaacaagccacgcacctcatccagtccgaatctgattttgagttttggcattgtaattgtgtcatgggcttagcccaagggggtgtgcgccctagggcaaccctaggatgtcactaatcatattaattcggtagccgtcatcgtttagagttgtgttttgcttagattattctgtcaagaacagtttcgccgctagatcggtttgtggaaccccaaattcgtgtgcttaatcattcatatgcaatttgattgcaatctatcttgttcttgcctgtattcttcgattcgcatgcagggattagccttctcggcgaggtcaactgggtttcagcacggttgataaccagaggagacgtggtgctgcgattgcggggctcagtagcgtgtttgttcagaagccgaatcgagttgtgtcgcgactccgcccaaatcgattgtttatcaatacctatcggaagatcgggacctaacaccctcatcaaggtgggtcaaccgaggcggcggcgatgagccgaagggcgttgaccatggcaatgtggaagggagattgtagatctgacatgtgatctgacatgtgggcccaagggcattttagaactgtcacgcgatttctctctcatctttaaccagaaattattattttaatagatgcaatgtttactagcaaatatccaacttttgagagtttcttcccgaaaagttacttcacgcggtgtcctacaactaaaattttgaagtcacgatgtccttttgccgtgtaatcccgtgatcggttagatcaccggtttgctcgttatggaaccccaacatatcaattgtattcaattcctatttgcaattcagattgattttatcttattcttgcttctttcttcgatttgcttgtaggaataaggttgatctgcaccgacaagattaactacccacagagaggtgtatcgatcgctaagacacaacacaacaacgtctcgtacgattgtagtcgggtcggcaacgtttctcccaaatcgtagttatcttcaactcaccgaaaaagcaggccaataatagtcgtgggtgcattgagtggagctcagggttcatcatagtcggtcaaacctttttaactaacttagcatatgaagtattaactaatatataaatgctatgtagctacattgatgactttatgtgcagttattagattatcatggagaatactttcatcatataactttatctacttatataatactttcttttaagaaactgcaagtaaaaattatcatattggagaccgatgtcaatgcttggaatcatagtgaatatgtgatggcatgaaaatgtatgcatgctatgtactacttcccttttatattataaaacaatttgatttttttcctaattaaacctttttaagtgtgacgaagtttataaaaaatgttagcaatatctaaaacgtaaatttagtttatcaaatctaatattgaatatattttcataatatgttaatattatgttagaaatattgctatgttttttataaagttactaaagcttaaaagtttgattaaaaaaatcaaagcgttttatagtatgaaaaagagtgtaaccgactctatagttcatggctcatgaaatcatctccagccttacaggtctagattttgatcgtcgcaacaatgtggcttaggaaatgatttctggcatcctacaatcgatactggcttagaactatgaatttggtgatttggcacgattttgaactatgaactgtgaatcgataccggcatttctggcagtttctctccccaaggtcgatagcagatcatgaatttggtgattgtttcccattgcgacacgttttgtgccgtccttataagttaacaccagtaagccaaactatgaaaatccccaatgccacactcccaaatgccatattcccaaaaaaacttgaataaattgccattggtacacctacattagttgatttcctgccattttggtccattcttaacgccacatcaacagccacctcatgacaccatcaagaaaatgacattgatacccctgccctttcagtccaatttttttttcggggactttcagtccaaatttaacacagcccacatcaaataaaacacaaccgacagatgcacaataatttcacaagcaaacacagcttggaacatacaaatagaatttgcaaacgctagacagatcaatctaccaaaaaaagaatatcagggaaaaatccgatgccaaaccaaaaggagggaaaaacgaatgatctattgctcttttacctgggccaccgccggcagagtcgctggagaacggagcgacgcgaagtcggacgaggagtagggacgcaaagcctagagcagggggcaatgcaaatatcagagtttttctcctactcccagtgtgcaagggcaaaacagggatttcaccccatccaaagctgatgtggcataaaagaaaagaaataaaatggctgggaatcaactaatatatggatctagtgacaatttatctaaacattttgggatgatggcatttgggagtgtggcattggggaagatagcaaatagtaaaaaaaaatcctgtcttaccttaggttcatacgagcatagaactgattgtgatacccacctttcaaaagtatccttcatacctaccgttaaaaatgtctatgaacaagcttctaaactgatggacacttttttgcacaccattacaaattctgagtgatccagacctcagacgggaataacccgtagatctgttctttaacatcacaaaagggaacagtacgctcaaattttcctgttttcacgtcgtacgtccttacacctccccaaacacgcagtccaagaagccaatcgaatgcatgtatgatcacgggggcagagaaatatatacagtgaggccgtatcccgggcaaattctgggtgggtaagcatgcggagtgattcaatctgaggaatagcgcatgatccatcaaaacattcccctgcaccacccccttgcatccatccggatcaaccttgcagatttggaacgcgatgccatccgggtagtgacgcgcgagaatcacacgaacctgcaggagatcaccccatggcgtcgacactagatgccgagtgaggatacatcctaatcctccgtagggccttgcggcataaatcacctcccttgttggtccgttgctcgctccatcaagatcccacttctccaccatcctgtgcaatgtcacggcgtggaacctccccttgtggtacgcacagtcgagatatctgtctcccccgcttagagttgaagccacctgccacctgctctggcctgccttggcaaaagaaagccgctcgccgttgttgtggatgatcatcacgacgtagtcgccgcctctggatggactgcaagacagcactgccttttggtagaaccatatccctaaccgatacgcttcgaacctgctgtttgtttccaaaaggtagttctccaagttccctccttcgctgccatagaccgcctccacgcaggcgaaatcggtaatcggtgggagggggatcatggccagtgtgacagggttgtggagcacgagattggagaggtcatttgccaaaaccagccagccgtgagaggccccgtagcacgcaacaaaggagccctttggaaaactgactctgtagatcttgtcaactgcatcaccagggtggtagaggttgcaggtcaccgccgagcggcgcctttcgtccagccttttgtcaacgtggttgccccatgacatgatccatggagtgcgagaacgcggacaccggcagccgtggcggcggaactccatgtggtgcaga

SEQ ID NO: 13148 - DNA, 30156 bp, Oryza sativa
ttttgcaattggggctatcagaattagaaccggactcccactcttctggaaaacgatctacgtacgcaactcatgataggaacgaattggacgcctaatatatagcaaaaaagaatttaaaaggaaagctacccgtgagattgtaaaattaataacaatttaataagaagcagatataaaattaatagtttttccatgtataacaagataacaagtgtttgtcatctcgctaacgttctctttcaagatttacatgacccgaatactaaaaggatatctgtactgaaatttgttgatggcaaaagtacatgtttagaaagacgacaaaagtacatgtttagaaagacgtgttaacatatagccatgttatcaacctggtgtaaactgaagcatgtatcacggtatggtatggagaacataattacacgaatggtgacgtcgtgttgtacaaagtaagtggacattggtgagtaacattcggatcatcaatttactatcttctagattatgttttcgaattaattttgatcatgagaacctacctttgctcaccagtcgggaacgtctttatacacgatattttattgccaggtcccataaccaacactacaatctttaagcaaaactaattccgacacactgggagagatgagaaattgaggaattttatggactgatgcatttgttgctattaattattatacttgcccatgatttttttcattaaagtatgcgtctgtttttcattagtatcataaggtcattacatcacaactgttatattacgtgtcgactgtaccatgtaataaatagtgttcccatagaccctttgtctcataagatctacactcccctaaatatgttagctatagcatgtgacaatccaattattgtggactgtgtaagtttattttggtcatagattcagaaaataaaatgagtttgaatgaatattatttacttaaattgctcctaagttggttcaacagtctccaaaaagatgtgaggcaatgactgcagttagttagttctgtatacagagtgtatttgccagttgccacccttgcaattatttgaggggcaatacttttatgaagcttaaaaaatgaatttcaatacatctgccctggcttgaaagtaaacatgattttatttttaagattgcattttagtttacaggagatgtacagtgtagctaggtctgtcatttttatttgtaaaactcaataggtgtaaccgctgctattttaatgcatatttcaaaaccatgtataccacaactggtactgttaagcagttctgcatcaacactggttattatttggtttttatacaataccactatgttaattagtgtggaatcacttacccatgtcctcttaataatttatcctctgattgcactaataaaattagggtgctatatggcataagttatgcacgcaatacactacactaaaattctgaatgtcttgtaataaaattgttatgcacgcaatacttcttatcaagatattctaaagtaaaacgtctcaaatgcatttacaaacaagttgacaagcgggcatattacatccacacaacattgtattgtttcaggtccctagaaatatacctaatgctacgagagctattcattcccaatttagatggtgaaactttcttgaaaacaagaattaatcattccatatgtgcttaccttttactttggagcaattaggcacgggcaaggtgattctttctgttccctcaaggcattctgtttataccccttggaattggttgggcttgaatccaaaaatccagagcataaaacaatatataaataaactcccaatgaaatgtttcaaaactcccgatcacaatagattcattggtctactttacaatatcttcctccttgccctctactacatgcaaatgtagtaggaccagcccagttgaaacaaaaacgaaattaggaactacatgaaccatctatttaaatccatggttgtggaagtaccgtaggttaggctcgtataaaagggttaactcaaatacatcactcttcagttattcgccatatgggtggcatgctaacgctacatacaccacaatttagtaaagcagtatccttttaaaaattgacagcatctttttagagtaaatgtgacacacatgcagaaatagatcatgtgtgaaacatagatgtatacaattgagtaaccggagtatctctagagtaactttgatagcttgaataactggagtgtggagtgaagtagtcaacagcagagcagatttttcctgattcatgcaaaactgtaaacgtcggatacaaggaagtggacataaactattttcataagataagatgcatagattattttcagttttattggcttgatctcttgcagttaagtgccatatatatattagtatttgacatgtggaactatagccacgaatccgtttactgacagatcaaatcctccaagcataattgactataataaagaacacattggatttgaatccaaggaaacatatcacacatgcacgccatcaatcacgggtgcatgtactccaaatatacaagggtctaaatatacatttcactgatatagtacacaataaattatatttgtaaatatacatgtgtcaatcaattggacaatatcaaatatgtttattttttgggagcatgtatattgtacctgattggagccggcctatgtaacctgacgaatgagtttgaaccggcaacggcgcttccaatggaaggggaggttggccacgacgaggctgtgtccctgaccggacggcgataaggctttgcttgataccgtgacaggaatcagggaatgcggcggcggctgaaaggccggatgagagtgatggcacctatagaaccatcttctcaatagagtaacataacaatgcatagtagtcaataaaatcagtttaggccatacatcagtgcttgcacataaccaatgcagcacattttacatattcaggtgtcattatttgaaaagcaatattatggcgtaactcatcgaatccactgccacacggataatagacccaccctggatatttctttaaacaaatagacaaaagcattatggaattttcagaaagtacatagtttagctcatgtaaattttatatgtggctggaattagctcaaggaaagaacgaatcccatcatcatgacatcataccatctcattgtcatgttacattttcaagggaaaaaattatcactgcagaaagcagaacttggatataacctaaaagtaccagaagccactttgaaacttggattaattccattgttgcagcagttgaacgatataatacttgaaggttgtatatgcacgctactaattaaagcacttcatctgaatttacagacataaacatcctgatcataagagaaattaaatcatttgcattatataaaaagttgcagatgctaatcaaattgtttaaaacaggacgtcgtcattgataatttagtgtgatatgtgcacacacatcagaaacatagcactgtcaatccgcaagtaaatgaattgccattgcttattaaattttggaccaatcgaggaaaaatcaagaagaggaaagagcaaatgaaataagagaaaaggatctccatgtaccaggcagagagggccattgacactgatcaggtagaccactggtgaatcgggtagatgatggacacgacctggcggcagtgaatcggcgacggggctacggccgagtcggcgctttgtgtggtggcggcggtgacagcgtgagtcaatctggaggcaggaatcgaatgagaaacacatgcagataataactttttgtgtcacacatgcacataataatttgatttcaattatctcactggtgtattctatagtgggagggaggaaaattaaacagcaagtacaaattcatttgtattcactattttatctctatttcagtaactttgaacagatgcataatagccattgataatttaatattaggatgattcatagtagaacggagccgctccctaatgatgaagctcaccacgttgatccaatgcaaaaaaaaaaaagaactaaacaatcaggcctgaaatgttcagactgttcatgcttatgctctaccaattgctatacaattaaagaagaagatccaagaatacatatgcgtaaaatatgagtttccacctcacagcaagtttcttctctgacaaataaaatgatctaaactcacatcacagtaataaaaataccacaaccaatatcaaaacttaaatactacaggacctaaacctaacttatatctggattggatcgtaactgctgaaggcaatactactcaacacaacggtagaaaatgtgcattatcgttaaaatacctgctcatgatagtgtaacctataaagagatggggatttcagtgcattcgcgtttgggaggggaggaaccggaatatagatttggattttgcagtgaataaagatgtactaattatctgacggggaattaccatcgatccatccaatctgcaaggtgctctctactattgtgaccttctcgctcccgctgtcctgcacacacacgcaaataacaaagaaaaaaaatcagagaagggggattggagtcaaggaatggagataaaaaaaaaggaaggaccaggaagtctgggcctctccgttaaaattcaaagagttagggataggaatttaggagatcggggatggagaccttcaagtgtacgatgcaggcaaggaggcggtcttcgtggtgggacgggcgtagaggaggcggccgacagcgacagggttggcgcgacggagtcttggcggcatggacctcggtgactcatgtgtagggtatggcgacggggacggagatcctgaccagcgaaggagaacgtgcggagcggatgagggttgcagcgacggcggcgtcggcgtggatcgtgggtggctgggtgcggcggcggttgagggggagcggctgagaaagaggcgttggacgatcggcggaggcggcggtggcagaacggctgaggcgcgatgggagagaggggagcgatcccgcaaagagatgggagtgaggggaaattgcgaaatcacggatgaggagatcacgcgaggggagaggggggaggtgggagccacgggatggtgaggggatcgcgattggcgtgaggcagcgtagtggttggcgtggtggcagggcggcgtccgttttttgcgcggcggtgtggcggcggcggcgtcgtgcagtgtgcgagagagaagggagagggttgcgcgcaggttgggggcggcgaatcagagaggggctgcgcaatcacgcgattgatggagggtgattgatggaggtgggaggcggggatagatctataccgttcaattttacacagagatgatccggaccgttctatgaggaatgaaaaaaatgagtgatgaatgaatgagtgaaaccatttgttgaactatagggtagactatagggtagatacacagaacccataaatttatgcaccgaaaatgcagattgttttttttcgcaaaatctaaaccgagtgcgctctcgattttgtgttaaagagcgatgcactcattcgtgagagaaggtccagtgcttctagcacgtgagagaaggtcctgtgctgctagtacagctacgtgagaaaaggtacagttgttattagtgcacacaatgcatgcctattttttctttttatagaattttctctcaaattacttatccgatctacaatctgattacaccattacgttcgttgcaattaaatctttacaacaagatcttacatgattatattacgatgaaaaaatatttctatttataaattacttttattatatacgtaagttacttttatcatatatataagttacttttagatttgactaaattacttctatacattcataatgctctaagttgattatttttattattgtttttagttaattctttattttgtggactttataaatcttatctacactttacttgtgaatttactttacatagttttttatttcagctcactcacaatataattatttctactacagagagttactccccccgtttcataatgtaagtcattttagcattgcccatattaatatagatgttaatgaatctagatataattttaaattaaagttactttcttttcttttcgttataagttacttctataatatatgtaaattacttttaagctttactgaatttacttttatatgtctaaaaaaataacttagtgaaatctagaagtaatttagacatatcataaaagtaatttatggtttttcatcaaaatataatcatgtgagatcttgttgtaaagatttaattgttacaaacacaacagtgtaatcggattataaatcagatgagtaatttaagagaaacttctctaagaagaaaaaaatacatagatattgagtgtactagtagctttttttttttggaaagaagggtgtctctctttagtactatccagctagcactctcggtatagttgtgttcttcttcttcttcttctttttttcgtccaaggccacttgtgagttgtggctacctgcaagcacaaaccatctgtgggcaagtggagccgagaggacctgagagcaagtttaatagtatagctaactgctagctccaatttatttatagccaatgtaatagccaattcatataataactgcttactatactattaatacttgttcctacctatcatacacatattacgtcttagagtccgtgctacagctggctacagatctgtagcccgctgctcttctctctctttttttatctctttaaaatatgtttatagctgacttatcctgcaactgtacctgctctgacacgaccattccaaacatatcgaaatagcaaaacccttgtgtcgccttccctccccggcaaacccctcccgccgaccccctcgtctcgcaagtctcgcaatccacctaacctaacctagggtttggatttcctctcgcctccgccgctcccgaattccccaccgcgccaccgcctcggccccatcacctcgtcgccggccggcttcaacgccacgatccacctcccctgctcccggatcccccgccgtcacgcccggggtctctcctcctgattcggcaccacgatccacctccgggattgccgccgcgccacctcctccggctccatcagctcgtcacgaccggcgtctctccctcctgcttgcttcgacgacgccacgatccgcatccccatccgcgatcgccgcctcctggacccgggtcttcaccgcctctcgacttcgtctcccagtacgcatatgcagctgccatgccgactgctacaggtggggaagcgccggcttcggcgcaggagtgcacttccgtgggtttgggggctagattggtccgccttgatggcaacgccattaccacagtggccgaccttcagttgtccggtccaattccttctccacctccccaagacattgatacagccaccatcatctatggagaggatatcaggccgggtacctacctggttattcatgcaggagttgatatccttgacattgccagactcactttccttgaggaactaccggtggctgccaggaaagggtatcccacggaagcggaagaggagaaggacgccaaagctgtggcactggcaggcaggaaggggactcccactgaaatgggagaggaggagaaaggggtggtggcaacgccccatcaagagaaaaacatggagaaactggaagaaaagaataaagaagctgagaggttgggaatggaggaaagagaggaagaagaggggaacgaaagattgcgggaggaaaaaccatggcacaaccaactgtggggcgaaacagtgcgggaagaaaagaattggcacaatcaattgtggggtgaatcagttgaggaggaagaccattggcacaatcaattgtggggcaaaacagtgcgggaaggaaagcattggcacaatcaattgtggggcaaatcactgcaggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacagtcaattgcggggctgatcactgcaggaggaagagcattggcacagtcaattgcggggcagatcactgcgggaggaagagcattggcacagtcaattgcggggcaaatcactgcgggaggaagagcattggcacaatcaattgtggggtgaaagattgccaaagaaaaaacattgccaccaccaattgtctttgagactgtggcctggattttctcgtgcggttcttgttttacactgttaagtttaccccctataagtttttcttaaggaaagctgtagaagtttctgccgttaatatattaggaagaagatagcaaagggaccaggcagttagaaaaacaattaagttcttgtttcttgtctgagaagatactgcaatacatgtaggtgtgtgtaggagttggatgtaggtctttcttctttgggtgcttttgctttgaggtgaaaggacttaagagttttcatctgtatgcttaatccaggttatcctagaacgttgcccaattgttatcttattgaggacggttagtgtccaaacacttttgattttttttaaagaactgctgaatcttcttcttcagttgttaagaacttacgactatcttcctgggctgcatcaagttggaaaatgatctcatcatgactgttgccaactgtaaacgaatgttgcccacattgtctgttccatcttatcagatcttttgccagctgacctaactttagatgcagctttaggtagggattgcatgttacgactggtttttcccaagatctcttcacatcatataaaacatgtgcccacctcttacattacttcccaccaagagaagtggggaatggtctgaacaatttgtcgagaaggtgtgccatggacgctgttgagaacattaaatcccattcagttgaacagactgctctatcattttttttttgtctgagttgtgttgttagtttcgtttgtccaagttaagcgacgcccattaagtggaaattcctttatgtgtaatcatgcccttaaaatggttatcattcccaaattcaagcgattgttatttttgtctgtggccctcctgtaagttttactcctgtgcaatttatctcataatagtaacttgcttttccttcgtaggccaaggttcatggaaagcaacaaaatcatatagcttacagtggctgagatatgacaacaaagaagcacttttcggattcataaataaggaacaaaacagaaatatcaaagatgctgagattttgttaagcaccatggtaacagtcatcttttatacttgtcattgtagggaaaaattccatttgattctcgcaaactattttgtgtcgcttaaaatgaacatttcttcattattctttattgtcttataacatttaattctgttgcagaccttcaatcactggaaaacaggtttgatgtgcaagctagaatttgaaggacacctggtacataaataacaactttctgatataagatgtttgataccttttctgttatttatcgcatttcatcttactctatagcccaatctctgtgacagtatgggtatgggattaaatcccagcatggataacttcaaaatcaataaactgttaggtaagaaacctatatatatttgcatgcattaaagtgttgcaatgacaatcaatcttgtcaatgaaatctttaacaggtaaaggtcgatatggggaagtgtatgaatgcacttattctaatggtcaatatgcagtaaaaacgattgatgtaaccaattattttgaccacactgaaccaaggtttgtgagtgttatccttctctaaggtttatattcttaaatatgccattttctaagttgtaaatttctttatttcagagaagtcagcattatgtcttgccttcaagacgcaaacattgttaccttttaccaggtactcttaagtccctaacaaaaaggtctttacacttctaactgcaactgttaattatgtttctgaatttgaatttattaggcgtggtgtgaaaacaagaaagaggaaaacaaatttcatggttttggtgtacatgagccgaaatatatttatattcatatggaggcctgtgccaggtacaaacacattttctgtatgcttgttatcaattacacttcccttcaggccacatgagaaactacaggcagctaaaaaaaatccttttaaaacaagccgattctcttgttgtggttgacatgattatatctatagaataatgttaaggatgcttccagaaacatgcaaaactgtagaaacgaatttgagaagtagcgaattggttgaagcattataattcaataggagcttgtattgaataagagtcgatatattcttggaataagaggccactacgccattgcactgtcccaagcgattagaatgacggctgttaatcaacttttacagcttatagacttctcctgaaattttatatatcacatgcaggaccctttatgattttctgtgtggaaataatgaaggaacaattcaggacaggtggtctctttttgagagaatcgtaaaaggtgtaagatgcatccatgctactgggataatccaccgtgacctcaagccatggaatattttccttggaccttgtggcgctgttagaattggtgatttaggacatggttgctggtctaaatcttactgtgatggtcgacgtggttcacctgattgtggaaccatgttgtattcggcaccagagctcaggaatgggctgttggttactgataaggtattccttatcacagtttcacttttcaaacgttttcaactatcagttaatagtttcacatataatttattcttgctgttatcgtaggttgatgtgtacagtttaggagtgatatatcttgagatcttcatgcctgctgctgttagtgttaacaacagagttgatgcattgatcgatttgatggaaagacgatacaaaccagaatggacagcttggtccatcgatatggaattcttgaaggacctaactgctttaaacccatgtgaccgtccatctgtgggtacaattttggtacgtacttacgactagcaataaacattaaactgcttgcatatagcattaatttgatcattttttctgtttttatttttattacaggaatatatcgccgaacacgcaagtgactgttgagtgctaatgtcagatgtgcaaagatgatgataatatcgttagtacgttgttccaaagaataatcagaccaagcatttagtacttagtattttgcatcagcagacgtattattgattgtatgatcaatcattgtagctatgtagtacctagctttggtactcgatgtagatttccattgagatgaactctcataatctgaactagaaatttctgtcaatcctcaatgtgtattgtcctatgatgaactctcacatcagaaatactctctctgttgtcccaaattagatgttttaactttttacttgcaatgtttgatcattcgtcttatttaaaatatagtgtaaaaataaaagaatgataagtcgtagcagtgatacacccgcagcgctcgaaatagtaagtcaagcgccacacgccgatctcccttttttttcccttttttctcaacctccctcccttcgatttttcctcccactctgtttcctgattttccgtttctctcaacctctcccttctgaattttcctctcactccgtccgatcaaaataaatagagtaggtctggctcgtaacagcgagagtaacaaaattactgcttacgagaaaacaccgagagtaataaaaatagaatcatgctatacgtacgacccatccatccaaccagcttacgacccaaacggtgtagcaacacattgcgagacggtgtgaggattcgtgctgcatgctgctgacggcgcgtacatcgacgttgtagtcgtctgacagagtcggatgtgtgggtcgtgtgtgtagcattttccataaaaatactaatctcggtttctctgttccacacatccctcctattccttcctggttgtaatataagataagtgagaccatgtaaatgaataaatgattttggttttcgcacatccctctcgttccttgccggtcctaataccaatcctattttactataaagttataacccactaactcctaaagcttaacatataaagatgtcacatcatcatcatccactgacaatcaatacatttaatatcatgcaaacatgttatattatctataatttaaaatttattacattttagagcttttaaaataaaaagcatgttaaatcatcatcccgcataattcacataatattttaatattgttgatataaaaacacgaggcctgagagatctgcttaactccagtgcaggtcaaaaacttgcctttgggtgtgtgagcatgccagttgatttgatcctgcaattaacaagaaataaagacaaagaaaccatgattaaatccataaacgatagccaatcggctaggtgccgatgacatataatttatttttgagccgatgtcatatatgcatcgatcggcagtcattaataagtaagaaagaactaaatctactcgatcggctgtagatattagcaatatataatccttatgttgatatatacttaaatcaagtgattgagatagatcagtcgccatgccgagacagtataaatcacttagatcgaaataaatattaacatcgagaatatatatgttcatagcatagccgatcagatagatctagcatgaatcggctaatactccgataccactctatattaaaatattaaagcaaatagaatataccaaacagaagcctaatatacttaaatgcaacaagatcttaacataaagggcagatttaacatgtcaactaagcacataagataaatatcgtcaaagggcagatttaacatgtcaactaagcacataagataaatatcatcaaatcaggtaggatcggctgaaaccctgatgctaccctaatcggcaaccaaaggcaggctagagattgagattctaatcacgactcataagatcaaactcaactgatgcagctataagtatgaaaagaaggacaatatctagataatcaaaccgttggatgtgtcatagagtggtggatatcctatataatctaagtcaacatcggtatttaacctaatcggctgccttctactgacagatgttagccgattataggttagatagcgatattgccgaagattatataagatatatgataactcgacgaattaaataaataagattagagtgtcatgaagatggaagcactaatcccgagaacacaagccgccataacaagttttacctcttgttgaagatcagaacagatgcagctcaacccgaaagcaagaactcgtcgagacaaaacgaaagtaaaaaagggtggtgatgcgccgagattgtattgaacgtgtgttagtttgattatatggggctcggggtctatttatacccaagattacaaaatatgtccatatcggacacgactcttatctctaacaaactctaagataccataagtctttgcggcagacttttgtccaagcaaatctctaaggaaattacataaaatatcctaattaaaagatataattgccttctcaggactctatatccatgcgtggcaatcctcatgaagcacatcaacccaacccgaccacgtacgccttgtcatattgtcggattcggcttagtcgattaaccctgtccaactcaaactctatcgatcctggtcgcagccgattcggactccagctgatctttactctgtttccgggacgatctccatctcgaactccgtcccgattccttcttcatctccgatccttggattaccaaatttggtcgttaacaaatatatatatcttcattattgtttataatatcttatgtacctatgtaagttcatcatcacttggttaatgttatttctctcttatctaattaagccatatcgatatcgcatcaattgattttagtgcttatgtaaatttatgttgtttagctatcttacacattatttttacttattgttatcatactgaagtctcgcagcaacacgtggagtttgacctggttactaaaatgattattaccagcctctcccatgttgatactacctaggcgtaaccgcctaagtaaaaaaaataatatacaaggtaaaaaatataaacactttagacggtgcccacagtttaaaaacattaccagccccgttgataaaaaagggatttgctataccacagcttgctggtccatttatccattgaacccattcacaagtatactccaatggatccaaaattctaaaggggctaaatggttcgaaccctagaaaactgagaacatactaatcgatccagactcctctcgttgctagacaccaaaaatcaatggcctataacaatctcaagatatcgtctccattaagcattctcacggactgcgagatccatcatgtatttataaacattcattttgatgaaatcatgattaatagggtttcctatttccgtgtgtacattgttttgttttcatcaaatacatggttttgatcttcagtatatttaacatcatttatattgtatgatcacagcctccgttatgtccttacgttagacgccactgacttttcggtatatgtttgcgtattcttcttgtaaaaaaatatatataaccattatttaatttttatgatttattttatgtaagtatagcttaaattttaaataaaccaatgttcaaacatacgcagaaaaaatcaacggcattaaaaaaaaagaaaaaactgaaggtaggacaaatttttttctaccgttgcaaacgcattggcgctaactggtagaagggaaaatcgctccaacagttcatctacaagcaccagaagtttgcggccagtacattttgagttcccacaagagaatgcatttgcaaacctataaaaattccagccattagagtacatcctgccatcacaaaagcaatcaccagcaatctcccaccacaaaacaaatctgacatcactgccacaacaaatacaatcagaaacagatttgtacaccgccatcaacacatgaatatcgatctcaatgttccgaatcttgaagtagggtaccataaaaatgatcgatacaagcttaaaactgatagtgagtacctaactataatgtccatagacatgcttctaaacagataacaatcttgttttctaattattgcaaattctgagtgatccaaacctcagatggaaataacccgtagatctgttctttaacatcacaaaagggaactgcacgctcgaattttcctgtttccaggtcgtacgtccttacacctccccaaacacgtagtccaagaagccaatcgaatgcatgtattatcacgggagaagagaaatatatacagtgaggtcgtatcccgggcaaattctgggtgggtaagcatgcggagtgattcaatccaaggaatagtgcatgatccatcaaaacattctcctgcaccacccccttgcatccatccggatcaactttgcagatttggaatgctataccatctgggtagtgatgcgcgagaatcgcacgaacttgcaggagatcaccccatggcgtcgacactagatgccgagtgaggattaatcctaatcctccgtagggccttgcggcataaaaaacctcccttgttggtccattgctcgctccatcaagatcccacttctccaccatcccgtgcaatgtcacggcgtggaacctccctttgtggtacgcgcagtcgagatatctgtctcccccacttagagttgaagccacctgccacttgctctgtcctgccttgacgaaagaaagccactcgccgttgttgtggatgatcatcacgacgtagtcaccgcctctggatggactgcaagacagcactgccttttggtagaaccatatccctaaccgatatgcttcaaacctgctgtttgtttccaaaaggtagtgttccaagttcccttcttcgctgccatagaccgcctccacgcaagcgaaatcggtgatcggtgggagggggatcatggccagtgtgacagggttgtgaagcacgagattggagagatcattcgccaaaaccagccagccgtgagaggccccgtagcacgcaacaaaggagccctttggaaaactgacactatagatcttgtcgactgcatcatcagggtggtagaggttgcaggtcaccgccgagcggcgcctttcgtccagccttttatcaacgtggttaccccaagacatgatccatggagtgcgagaacgtgggacaccggcagccgtggcggcggaactccatgtagtgcagactgcggcgaaggcaagtgcatgaggaagctccagtcgttccaggatgattaggaggagatcaatagaggtcggaccagctggggcttgcacaaggtcctgctgcagcaaacatttgcatattgtgaattatattcaatacaaataagataatctacatgcgaactgtatttgttactagttcatatataagaacgaacaaatcaaattcatccatagttcggacaaggaatcccttctggtaagcagggtctcccaaattggaaagggacatcggatccaattcggacacgaagaacacaacgattttgcacaaagattggggcagtcagaattagaatcagactaccagtcttctggaaaacgatccgcatcacacaactcatgatttggacggattaaacgcctaaagatagcagtttttttttctacccgtgagattgtacaaaatttgttgcattcttgagaaggtacatgcgaaatttacgaaacaaaattgcttttttttagaagctatatgtgagattttagggggaaaaattgcatctttatcacagaaaggagacaacaaacactcattttggaaggattgagaaatccgatatagtcgctgtgtatcgtagtgtgatttgattgcaaggttaaataaaagcaggcttattattactcacccaagggcgacatggcagggagaaatcggatccgtttggagggattcctccaattattttactgaatgaatcggatccagtcaccgggaatccacgttggcccaagaggggagggcgacgagctcacccttggcctgaagatgcgccggatctggccggtggatccccgtccaagcagaggggatgaagggggaagcacggccaccgatgaagttgatgccgacctcgtctagactagacctcgccgcgaagcttgtggaggtcgatctgcccacggatgaagtcgccgccgacgatacacctctcggacgggtcgtggctcgttcaatttggagctaggacgagattaggggtctgtttggttactacctgaacctgaagcagtatttatttaggtctcaactaacgcataataagcctgaaacttttgctactttgtttggttcaagcctgagaaggcgctggacgcagggcaagtcgactcaggctcaggcgtagtctgtatcgaatatatatatatatatatatatatatatatatatatatatatatatatatatatatgtatagtcggttacaatttataatttagagttgtaataggtattagaactagagtatgagtcaaacttgtcacctagcaactatggcatccctgttggattcgagacacgtggccacgcacaaatcttggaacaacttcatcttctaccttcccttcctctaatcacccggcaaagaatcaggtttcgaacgcttctcctaattaccccgcatggaaccgctcatccatctcttcttcttatctaattaatgatctaatccaccggcacaaaatcgagggaacgcgttgctctcgtcctacaactacaacacaggcgatactagtagtccatcgccgcagatcatgaacctgttacctgtccagccggcctcattcatcaaaaacagattgtttctccattacttccaatgaactacgaaaatacatgtgaccaaaacgctaggtaattagtttaatcacccgaacttaatatactattcaaagctagtcatttaatctccgattaatcaagtaacggtgtaaatatgaactctattgttgatctgcaaaagaaagttctgataattcacttcgtatatgtgtaaggtgatttaatttggtgcaaatgaaagttctgataattcttcgtgcaagaagagacaaggtataactcacttcatcgttgtatggtagattaatagatttcacggtaggggatgaagatgaagatgagatggtttcgagattcgtatagccacgtgtcttaaatccaacaggggtgccatagttgctaggtggcacccggtgccatataactttttttcccagacgctatcctaggatctctcataaatagatagacgtgtctattgtaactgtatggcgacttagcatagcgagagggagtggctgccggcggcgactgaccatgagtcgttgtaactctgatatgctgtaatatgctggatcgaggaggagcgcccgtaatcagtgccccggagatgtaggctacaggtgaactccgttaccaaatatcgtgcctcggtgtcgtcatcgtgtttggatctcctatggcgttttcttccgcggtttggtttccgatgtgatttcggggctggttttataacacagatttggtggcctctcactcaagcagctatgttaaaaaaaattgattacgttgggttatgatattctgactattcccttcctccagagaaaacctaatctagctaggaatgaaacactattctcactacttaaaaaatacgtagtggtgatggtgaagccagcgcagacacgcgatccaacatagaaacgtacatcaacacgttcagagcgaaaaaatagtgcacactcctcctccgaaacgaaaaaaaaaataatccgacccacgccccgtgcagccctcaaccgccgacacgggagcaggaggtcgacgcgtgatagactccaaggggacgccacggcattctccctctcccgcgtggtccttctcatcaccgctgaggtgctgcctcctcgccgccatcgctgcgacccgcgccgccctcgaccgccgacgcgggagcaggaggtcacgccgcgccatcaccgccgaggcgccgcctccttgctgccatcgttgcgacccgcgccgccctcgaccgccgacatgggagcaggagtcacgctgtggccttctccctctcccacgtggtccttcccatcatcgccaaggcgctgtagtcgctgccacgggaccaaggaggtctccgcgcgacggactccggggacaccgcggccttctccctctcccgcgcagtccttcccgtcaccgccgaatcaccgcctccacgccgctcgtacactgatctcgatctccgccatccaggccgccaccacctccaccggtcacgattgccacggaggtcgatccgtcgcctccgcctccgcctccctcctcgacgccaccgtctccctctataggtacaggtcccctcctgcctcaccccaaccctcccccttcttactctaccctatctattggcttcaccatcaccctatctgttgatgcaattttcgattggatgatattgaatatgccccatgatttcttagctgctgggctgtactcctgctcactaactcagctgagtatttcttcgcagttataatggcattgctcactatatggtttgtcatgtcatgctactgcacaagtagctttaactataagtgggcatagggcctcatacatcaggaaaagagcaactttcatatacaaacaaatggaatcatttttttttgccccatcaggaaatggaaaacacaagttgctttgatttgtgattgttcaatgactatgattctgaacgtttaatcaaatggtacgttttatttttcctaaagggtttcagtaatccatattattatccatttactgtcagtgccactaatcatggttgctgctctttcaaatatgacgttgtgcagcatggaaataaaaatggtttctctttcatgttaaaataagctatgaaccatcctgatattaaattgtcaatggctattatgcatatgttcaatagtgactggatcagttatctgatctacatcagtgatataattaaaatcaaattatttatgtgcatgtgtgacaaaaagaagttattatctgcatttgtttctcaaatttagatagcaggcctaatcttttatcgagctaggagaaaccctgagttccctggttaggaacaacctggagctatggatgatgaatcatgaataaagagtttttcagtgttatgttgtagcggccagaatggaaaatgcctgaccatagctctgaagatgagtacatcttttgcaaatcttgatctgtgcacctcttcagctgactgtcagcatgaaaaaaatatgattatgatcaggctttttgcaagtcttggatttgtgcacctttttagggatggatagcaatatgccaatatgattgccgtagcttgaggctttgaggtagatgaagagttaactagtttcagtgcttcttcctaacttttttttttctaaatagtttgcgcaaaagtgactcatgcaccatctgtggtgaataggtcggtgccctagtatctccttcttgatggaattcaatatgccagtgtgcctattagatattatgcacacttctctattcagcccaatcagacgttgtctcactatgtcaatgaaccactcctagttggacgtgttctcactctctaccagggcaaacgccaaaagaacaaggtgtaaccatgtatcaatccctattactgtgagcaatgtgcctctgaatttaccggtcaagaaggtcccatcaattgctaacactggcctcaaatgcttgaatgcctccactgactgccaaaatatccatgaagcacgaccaaatacatgcctagggactccatccaccattcttgatttctccccttgaggttgatgagaacacaactagttcggatataaccatgacttccatttgtattaatcaaccaaaggtgcatatgttctatattagatttacttattatatatttaaacaaacgttgctacataatgagtttggtgtgttttcgtttgcagatgtacttgcttgggcgaaagaaaagagaccgagcgcaaggaatgcatggatgattaaagaagttgattggggaccaaaccaagaccttcttcaagtccacttctacctcaccacgtcatgtttggtccatagaagacaagaaataaagttctacatgttttggattcggattcgggcctcctgatagcatcaacttcaaaccgatctagtggcgaaactgttctgtcattcaacaaggaaatgcatacttgggttcttacttttgatagcattcggtagcataggcaagcgaaggtatgcctcgtcccaatctccccatatgaccttcatagcaactcgcttagcatgccaagctttgtcgtacgtaggccaatagtgccatatgtgctcaactgcctctacaatagctacaggagacaatgtaggttcagcactaacaaatgtctgtaatctattacctataaacctcgaagttagctgcaaatgtttgccagatgcttccgcattagagcatgtgtggtgtttgcctacactagttatcctccacctatcacccgccctctttcttgtacgaatctgccattcacaataacaatcaaggcatgccaccatgtacttaacagatgcattgaactcgttaccatggaatgggcggtgcacccagatagagtagctctgcaaccatatttttagctcatccatggatcgaaactccaatcccttcctcggttcctcccccattgcatcgaaggctctatcgtattgtggatcaccgtctgcaacagcaagcctgccattgctaaggccctcgaattgagttatttttggatttcaaccaatgattttctcaaacacggtcctctcctcctccgacatcctgctgtcacatcctgattttcatcttaggatttataaattatttaataaattattattagaatttatatgaaatgttcattaatttacaagtgaagctaaatgtgggaaataaaatttcctaaacataaagcatggctggatttaattttattaaattatccatggttaattatactctctgaaattttctcggatttttcggagctcaattcttaattttaataatacaaagagcagttcagcaattatttaaataataaattaatcattaaatggtctgattataaccttgttaagtactttgagtgtccaattattttcaggattgttcttgaaattatttgagaattggaagtatttttaacaattcaaagatcatttcagtgattaatttaattggaaaagtaaattgaatcctcttttccttttcgggccgaaacaggaaatgtcctctctccttctcggcccattctcccttcctttcagctggctttattcctcctctgaagtccatttcttgtccctccaatcgggctggagaaaaagaagcccagtcaagtctaattcgcttccctgctacagtgtcgtcttcaagcttggacagagcccgtttggagggttatgtccaagtttgaagatgaatttgtaggtgaaacttttataaatgtgttcttggtgacttaaaagccaatgttgaaaaagaaactatattgaaaatatctcaaaagcaatctcaaaattaagcttgaaaattcaaattttgactttttctttaactgattaggccatccgatgggagcctgaatttgtaaccacgcacagaattcgacgcgaatttggattcgttttcgagtttatctcttcaccaaaccctaggttttcccggcgcgattcctcgcgttctaagcccgatctctctctcccatggctataaatagagtcccctccctctcctctttcggccgccacctctccctctctctgccgtcgcttgtagcgccgtcgccacgttcgtcttctctgtccaccgccggcagccgctccagctgcccctagcagccgcctcggccatcgacgacctgcgccatcgcctctctcggccctgcaaggtcaagctccaccccgtccaccccttacccgaggccgaatcccgccggaagcttgccgtcaccatgaaccagtgggttgttgccacggtttggtctccagccgcgtcgttcgtcatcgtccgtcgtcgccttcggtcactgtcacttcctttggattcgcagctgtgaggagaagcccatccatccctctgttgccgccgaagatcaccggaacatcgctgtcgttgtcgatcagtaccttgccgccctttggaactcgtcaccggccatctcctttgctgtccgtcgtcgtgtaagtgttggtaaggatcgtcgcgttctcctcttcctccctgtgctcatggtttccgctgtcgtgctgccgtccaccggtgtaggtttttccctagggtcttaatccaatctaacctaatccgttgtttgtctagtgttgttgtcgtctctgtgtgttgccgctggatcgtcatcgttgtctctccctctccgatcgttttggttcggtgagacttctatccgtgttccctcggttaggttttaatctctagtttgtgttgtcgagtagccgccgtcgtgtcgcgcttagctgctgccctagcgtcaccgctgcgctagtcgcctagccgccgttgtgctgctctctgctatagccatgctgatgctgctgtgcgaggccgcttgccggatcaatccaagccatccggtcttggtcgacccggtcaaggttaatctcagccatccaaaatcaatataaatcttgttatcccttttcaatggcatattagttctttttactgtatatcgtctactaaattcgttccaataatttccggaggatgttttagtcttatatctcagtcataaattatttataaattgtttaattaaattggaatagtcttttctttaatagtctttaattggaattaatcttgtaaaacataactaattcatatgaagttggaattaagtggttcaagtctctaaattcatctaaaatcttgatctacatatttgtttatttttatgtactatttatttggtttttattagtctttttattcgttttgcgtgttagcttgtcgtttctgtcgttgcgaagatttgtgaatgcgtcggaagtgttcaaaaagattaattgaagaccgattattgcaaggcaagtcacacagatcccaaacacaatcctttgagcatgttgatcctatatttaaattctctatttatttcaactgtgcatttattttcgaatgtcaccgggtcgtgtgaacctattcctttgtttatggccaatttgcattgattaccctattccttgataccttgggtaataaattgattagcttgaaccttatatattggtttggttcagctaaatgccatatatatataattgcttagccatgcttagaaacattagttcattaatgggatgaatcatactacattattatttatgattatgtttaatggtagctcacgatggttaatcgtattatgataattaattgataattaaaaattgacaatggtgggttgtgagcacatggttttgaaggccgtgctcatgacaattaaggatcggttcacgagctactgttgtgagacattaaccgtgccaaccacaagccagcgtgggcaacggctttaccttttgtataacatggttcattacggggcaccagactgagaagcggtgagaagtccgtgggggtcgctggggagtccatgcctcttgttatatttatagagggggtgattatgatccaggattgatgcactgtggtgagttgtgttgtgtgaggggtactgtcacagttcctttccgaggtaccgtggtggtattgaggtgcatggtgacatgtcgtggagctgtatcttgtgggtatagtggtacacctctggccagagtaaaactattcgaatagctgtgcccgcggtcatgggcgggttgagcagtgtttttcgtgattagtctcacacctctcacaataattatggatgctataactggtaataatttgcttagctcctggtttggagttagatctgtacagccgggtatggttgttcagtatggttgggcctgagcagcatgggtgtgctgttcagtgttgattaaaattgatgattaaattactctattgttttactgttcttaaatgtttgctatatgctgcttttgcaaatgagcctatattatgccatcctttggtatccttgtgcacttgcatatttgctgtgtggcttgttgagtatgttatatactcaccttgcaataatcaatcaacctcaattgaagaaaaaggatccagaaggagaagaagttgcttataccccagttgagctgcctgtgggagtggagctgaagccatcgctagaccgttaattccgctgctgttttttttttcttttgtagtatgtaacgatgttattatgatggatttgtatattaaattgtcagtttgtgtacctcggctgattcctggacgaggattttatgcacaaattagttcggaaattattagtgaatttccgggcgtgacacctgcccattagatgatcgtcatcagaaagaatcagatgcagactcatccacttcattgtccaaatcagcatacaacaaattcgagtttaatccattaaatatcatgttttcctcacactcctcgcgagtgtaaatttcttcatcaagcaagtctctgatgaataaaatcaaccgcctctcgtcaagttcaactgtattctcattatctgattgattcacatccataccatcatctgacatttcctgctctacctccccatcctccacatcccggtgcctctcctcacctatatccacatcctcctcaacttgtttttcatcccctacctgcacatctccctcaattaattcttccttccaatccaccacgaacacatctttatgtatttcgtcccctacctccacatctttctcaattaattcttccttccgattcaccacaaacacatcattctttaattcatgacaatacatgggggattctatgtgcggactttcattgaggtctaaaaattctttcgtcgattccctacgctctttcttccaagcaaacacctcaagcgatttgaactgtaaacccaagactatatctacatatgtttcccattccacctcaccattcaaatttaacatgaacatatgcgacattgcaccagcacctatatcatatatccccttgcataccaacagactcatcactccaatccaatttatccttcgtacgtgaaattaactcatcaaatatgagtttggcacgaaacactgactgcctgactaacatcccctcaaattggctaccatcggtactttcatctaccacactgccaccaaaatggagtcataccaatctatctatctacatcaaataaccgataaataagagtgcattattctactatgatacgtcgctataaagatagaaacttgacatgggtaccccagacctaatgaaaagatttttgaatttcgaacgactaaccaccagtctcgatgttcctaggatctatgccaatcaacatcaacattaatcaatatgaatccccaaaatatttacaatacaacggctctacacatccatctcaacttcaccattagcaaaatagtgcataacttacaaaaaaaaactatatgaatcctctatactaacatcaatatacaactataacgtcgcatcgttagccacattcactaatccacaccacaacccgagcaacatttaacaacccatgatttcaaccaaaatactctataaaaatgagggaaacattgaggaaattaggcttttggaggggatttaccttgcaaaccaatatccaaagcaatgctcactaaataaccttcgatttgaggtggatttgagaggatttttggaggggaggaaagagggagttgcgcctgcggaagaaccctagccgagtgcggggaaaagaggaccagtgacgggccggggcggctcagccacgaggtaaaggctgctacctcagcgccaacatgcctggcgctgaggttagccgcatcagcgccaaggcggttggtgctgaggtccctgccacgtcgacgtgggggaaaggctgggccgccacgctggcagggctcaatgccgatgcggctggcactggtatggccaaccacagcaccaagcaccctggcgctgagccccggcctatttttggatgaagttttttcgcgggcgagtttcgaaataagtttttcaaaagggccaatttgtcaaaaaaaaaaagacgggctggtgttatagtatagtatgtatagtaccataaaaatcaaaacatatggagtaacacgatttgtactcatacccatctacccaacaggtatgaatttttatctattaacagatccgtgggtaaaaaaattagaccgtagagtaaaacaatttcggctcatgggttattggaccctgttgccttttctaaacacgaggaatggaagatgtgatcgaacagaaagcgcttgaagacagccagttttttgctacacttggatggtaaaggcacattaggcatctataaacagcagggtaagccagtggatttgaagttcaaacccatagtttaagggaggctttatgctaacttccacggaaggaaagaagcaaacaagggcatatggcccatgcacggcaaacccaaaactgaaaactcacacgacacactatatcagaactctcatgtgatgctatgtatatatatatagaattatagctagacatctccgagagaaaaaaaaaaactagcaaaccattgtgacagtctcaattttgcatttttgctatactgcttgcagatccatggggcgttgggttaggcctgaggtcagtatacagtctcctcttaatatattattctgcacgattattttgttgagatattgtactagtcaagagaggattcatcattttccccaaaattggttatccacttggcttttgtcccaacttggataattttggtagatctaatccacaatagatcgatgaactacttaacttagggtctgtttggtacagctcccactctgagactctaatctcttgaagctagagttgtatcaaatactttcgagaacttgaataataaagaatggagcttttatgccgtttctgaaaattaattatactatgagggtgaagcgacatttctaccgctcctcaattccgctccacccttggagtaacagctgtgccaaacgggcttagttttgctccactctatgtatttacaagaaaaaaacccaattttgcacgcgccaatctcctgccacacccgtctactcttaccaaggttgacaatttttacacaaactgatcgaaaccacgaacttttgaggtttcgacatgggatgaaagcatatcccgaatgaaatttcaaatggttttcaaggattcaattttggaacggcaaattcaaccaaaatttgatcgaaatgtggtgaaattggatcattagtggtcagtatctggcgctcaattggaaatgtgaacccggactattactcatgctcatgaatttgttctttgtattcccgcaactcagtcctgctacaccagctctgcccacctagctagttcccttgtaatggcatcctgccgcataagattgaaagtggcttactcgtgaaacccactaattttctgatgtaaaacttactaatagatgacaaaaagctacgaaactgtttattttgatcaaccagtgggttcgtgggttagccacttaaacccctaccctcgcatagtaagagagtgaatagtgatagcgcatgcatttggtggcttgtttactgttagacctgaaatagaccgctcagatcaaagcacattacagtaatcaatagagtaaattttcccgacaggtaaatcaggcagtggatcgcagctgcattaaactgccattaattgtttcatgcgttgaatcaccgtagagcaatttcagtttactgttgcgggatgactccgtattacagcagaatgaactggatccgcatcggccatgagctgagtagcgtcagagatggataaagttgacagaattaaaggctaggatgtaactgcagaatagtccgtcgtctattcattggaagaatgggaggaggggaatattggtaggaaggatggaggatgggaaaaataatgggatagagggctggtaggtttgggccggggacaagagctaccacgactgcacgagcagctggttggtttgggctgcggcccatttccagcaagcggtagcagtagtttgtcgacaaaaactccttgtatacctcaaaattttctctaatcctttttatatcttcaagttttaatcatctctcttagggcttgcagcacagtacctacatttagttccatgtctacattttactttccgtggatgtagatttttttcattattatacgaaagacgcatacacgcatacaaacatatatcaccactcacttaaatactattaagatcgtaaccgtgtatacataatatataccactccctccgtttcaggttataagacgttttgacttttgttaaagtcaaactgctttaagtttgactaagttattatgaaaatatattcaattattaattttatgaaactaatttagtattataaatattactatatttgtttataaacttagtcaaacttgaaacagtttaacttt

SEQ ID NO: 13149 - DNA, 8817 bp, Oryza sativa
tgtgtatgtgaatgaatgtatatgaatgggggatgttggggtgtgatatatcacggcctagggcttaataggattaatagaatactcataccaacaaactacaactattcttccggaagccgatcttcaaataactttgatattaagcgtgtttagcctggagcaatttcctgatgggtgaccgattgggaagtgaactttgtgcaaagtattggcctgagaagggcgggacggcatggaaaggctccgattgggaagtgaactttgtgcaaagtattggcctgagaagggcgggacggcatggaaaggctagccaaaaataaaaatttattttttttaggattatactcatcagtgacgggcattaacttaggcccaattgagatgactcatctgtgacgggcattaacttaggcccgattgagatgactcatctgtgacgggctatagttaatgcccgtcacagataagggtcatctgtgacgggctatagtttaggcccgattgagataggtcatccgtgacgggctatagtttgacatgtcgtctgggttaaagctatcagtgacgggctttaattagggcccgattaagataggttcatccgtgacggccgtttgcccgattgagataatttttcacatcagtgacttctagcctgttacggacgccgtacccgattgagatgggggttaccgcccgattgagatgatgttatccgttctagtgattcaaaatattccattgtgtggcaaaaggaaaacttatggggcaaataatacattaattttgcctagttaattacatgcgtgccattcacatagatgtaataatatatatacaaaatgtattcccctggacgctgcatctattacctacatatgcaggtttatcctctgatggccgcgatgatgttggcatcgggcatggttgtgttccagcttgggcgcaacgtgtgcaccaaccctgaagtcaagtatgtcaatgcaaaacctcttccaacctaactagcctagattacagaatgtcaatatactgcctctaggttaagaatatttatcatttgagataagagctaatatcaaacttttaaaatctttgaatataaattatttctaaaatatttttagaccatatatatagattagcaaaaaagttctttaattaaattaaattatatatctattaatatttctattatatatattataatataaaatagtggttatagttaatcttttagcgttctagtcaaaaccaccagtattatcaatctgcactaattaagttatggaaatttaacttctaacatgtatttttttcggctatgctctaaataggatcagcaagcgcaaccgccgcaacgcagtgccagacagcgcggcggaagcggagaggtacagcatgcatggtttccgccgcttcttcggccggcgtcgcccagaggtgatgccctccatcaaccgcttcttctccaactccgatcgacccaatcatgatgagaacaatgatgattgatgagtaattcgcattatgtggtgtatttgttcgctataaggaccagcgttatgtgacgtaatatggttagatgtgaactggtttattattttaagaactcggcctgtgtgcatgcaaaaaagaaaaagcaagattggtaaatgtaatgtacttttactttatttgttggttcagcacttgatttttttcttttatcaacaaacttacctatgtgagtgttgacagagcctaagatataaatcatttctattataaaaataaacagaattgctaactgtctactgacagaaatttgatggttaaatctttcactttctaaaccgttagatgtgtttgagatttgtgctagtcgttcgatatgcatcaagatccgtgctttctaataaaaatacgaaaagaatcatgtcacctgatgggatgcaggcgcatgacacatctaccaagctattatggtttttatgacttgatgtcaacttacatcctatttatcatataattgcatgctagttacatatgtaattatagtacaaatataatgtaattattaaaattacattgttctttattgtactccgtagttacatttgatagattttaatgataattttcagtcgaatgtcatatagattgtttcaaaagtaaaataaatttcaggtattttggttctgtaaagggaaacgataagggaaaatcaatggtttttctctcaaattaactgttggtggcctttcgattgtcaagtcgcttctaacttttctcattgttgaggatatgcgtaatggctacgtacacggcatacatatccgactacaaatagaagatggattgaacccatgtattatgtaataaagtaggattcggtcgttatgttgccttatatgttaaagtatggtatagagccccgaacggatactaacatgtaatagaataggaaattgatgtcgtttccggctaggttttcctcattggaacccttcaccccaccctatataagatgcgcagagagctccttaagggcaaccacacaatcatatcatcaaatcaatacaacatgagagaggggggaggctcggcacatgagatgggccgcgcgacacgttggcctgtggaggaagtgaaggagaggggaggacgaggctagcgggctaggaagagtaaggggaggagggtgcccggttgaacaagaacatttataaatattccaggagtttggaagggggaaattgatgagttgaaatttgaaatcaaacttgatatttgaactcagggaattttggggaatttttgtaagcgatggtttagaaagaatttgagatgcacaccttggcacatacttgaaaaatacaaaatatccaattttttggctccaagccggtcttcatttccaatgcctcgggaaataggtcgagatagatgacaacacatttttatcctcttccttacggggaggcgcacttctcttcttctcctggccttcacctcctgcccggcctggaaatagaacccctttctgatccattcattaagtttttattcaaatagattttctcaggcacaaaaacacagtcattacaaagatcgatgccaccacaccgtgcagtcgcgccagcgctcctcttgtgcacgcccatgccatctgagagaaatggatggaggaagaagagagaaaacgcctcttgtgcacgcccattacaaagagttgttttagttaaattctctctccaactctaataaaaataatatttcaatcgtctttatgtcctgcagcaaattatcacaattttgaagtgtcctcgggcattcatgttttttttgtctacaagcaaataccacactttttcagtgtcgtgtagcaatttttaccaatagatttttctttgggatcagaataagttttataaatattatgtttttcttttaataagcccgccagccaccataggctagagaaaatacataatctttataggcaggctttcaaccgctaacaaaaattgattttcgttagtgcctatcttaagccaccagtcaacgaaaatcgattttcacaggtagagctaggttaagacgaccactagcaaaaaatcattttcgtcaaagaaaaatgaagaatacccacatgcagctcccctctgatcggctgcaaagattatttttggcaaacaaggaatgaaaatgcccacatgcagctgcattctatttccagatatcaaaccacaaatcaagcaaatataggaagaacaatcatcacaatactctataatcaataagaaacatagagaatccattcacaatttcatctcagatgtacaagaaagattagagagaagagaaggcagcctagcttgtcttggagccgttgccaagccacggtcatcgacaccaatgagccatagggacactagcgctgaagtgtcctgagcttggtggatttgagataggaaggtcggcgccgctatatctagagccagaggccttgccctccccctcatccactggcattgctcccttccttttttttgccgtggagaagctcgtctagatctaggactgtgagggaggtagggcacgtgggggcggaatgcactcgtcagacacttccgagccgataggaggctgtgctcgccggtcagtgatacctctatgaccaactcccaattctacgtctccgcaactctcgaacactgtcagcccttcccattacggcaaccaaggcttacgcggcggatccccttctcctgattttgttgcaactcgctgtcgccatcgccgccgcggtcatagtcgccatcaccgtcgctgagagcaccgcgcggtgtggaggtaggaaggatacagggagtatggagggagagggagggaggagaggtaagggagaggagggagaagagggacttagctagtgtgctggccggggagactctgccttttaataccgtagtttttttccctaaaggcggcaattagcgaaaactaattttttgttagcagtgacttaacaggtcccttgtaaaaacatcctcgatcttgtttggcacaagtttaaggagagacaaatgaaaatattccttggactccaagattatttctttgatctcttagaagggagagaaagaaatcccttgtaaaaacatcctcgatcttgtttgacacaagtttaaggagagacaaatgaaaatattccttggactccaagattatttctttgatctcttagaagggagagaaagaaacccagccatacgagtaatcatatatatgctccctctcttaaggctagatgatcaggcaatctctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcaatctgatttaggaaacgctgtgaaagatgtctgcaggagacttggacatggaagatacaggattatcttctcctcaataccaccaaaattcacaccacctgttcgtccagcaattcattatatatatatcatgaatggacaatttaattttcaagaagacggtcctagcaaactatcggacgaagaggaagaaatatatacaacaattgctaatcatgaaaattggagattattttctgaagctgcagaaattgaagaagctatcaccacagattatgaatatcagctggttttccaaaacaaaatcacaaggatttttatcagcaaattctacaaccaaagttctgaatactttaagggagcaggacgcataattaaaccggattttggaaatgaatgctccaagaaaagttactacagaagcctggctcagtggtttcagaaaacagagccatcagagatcgacacggtgcaatcagcacccatgataatcaacgaagataatgaataaagatcttgtcatccccgacaaagatcactattcaagataaggaatctacactattccagataagataagtctatggtcaaaaggcgatattatgacatctttattgaaggtcaaaagcgtcatcatcaaagattctctccatgaagtctaaagggatatcatgaactctttgaagtcaagaagagatatcatgaagattctctaccgagcgctatataaggggctcactatcacatttcagaggcatcgcattccacacacaacacatctcgctcaaccgttcctctcaccgctccaccagccatcacactccactccactccatctaagtgttagtactatagtataacctaaataaaagactcatgagagtctaagtgtgagagtctatgtaagagtctttgtgagagtcatgtacctgtataattacgaacgtgttgtaccaagtccttggtgtaatcttcagaaggaactaccttcaacctatcaaggtatatgaatgaacacctggaccgttctatataaacctattatgttctaaatatctaattttatatcttgtacataatttgtatttacatctttatttcctgtactgcatttatgtttgcataataatataaaaaaaaatttaacaacctggattgccatccaattgtcacatactaatctcacatccaagattgcatatagataagcattcctatcctcatatctggtgactagacccctagtcactgccctgggcaagagctggtatcagagccaagtgctcgtaaccttcccaagccatcttctccgaaagtgggggagaggggtcgggtggcgtgctgaagtcgcggtgatcccgaacggtgtggttgtgttctgaagttgtgattaaatcgttctccatggcctctgggcagttggggcagtctccatgaactcatattcgtgagccattcagacttctgtgaagccatttccctgcatatatattcaaaatctctagtagcttttaataaatatttatcttcccatgacgtcttacctggcaagtccatagattttggaagatatgatgggaaagaatcgtcatgtaaatatattgtattcacaacttgttctctcttggtctgaacaagctggtcaagaatctcatctgtgttagacgaaaatcttaggctcacctgtttgcccattatcttaaattgaatatcttcgtttgtgactaggaaaggacgaataagtgataaaaatggtgttcctaaaataacatcttgcttaagatttttaacgagtaggaaagatgttttaatgcaaacttccgagatgcaaatatagatttcagggatttgatattctactgttaaaagtcctccatctgccccacgaattctgtgggcggctttatagaaatatttatgagggataataccttctcgaatgcaattgacatcagcaccagaatcaattaaagtaatatgctggaagtaggatccgtctataaaacgatacataacttctgtgtaccatttttgcttcatatatttttgaatggttccaacaacatgatcatcttcttgaattggttcgtccttttcttccatatggaatccttcttttgattctaacatgtatagacgctttcttatttcttctaaatcttgtttcataattttttggtcttcgaataggctgatcaaatctggttgctcattcttctttttctattcatctaaccttttaaacacttcatcaatagagaggaatttgctcttttgaaatccttttttagtttatccttatcagttttgactcttgaaaggaatttttcgaggactcttcttttttcttctggatcttgaatggtttcaaaagtatcgagaacaaattcttctaaactggttaaaacgagtatattttcatcagactcttcttctgaattatctggctcacaacaagagcaaccactgtcttggcaacagttaatttctgtatttttttcttcatctgaacttgagtcattgtctatattatttagtattgcttcaagtttttctttaacgtcttctgattctgaatctaacaaggcttggatctattttttaactttggatttgaaacatctgttagctatgtgtcctttcaagccacatttgtaacaaatggtttctttgctttcagtgtcttgtgttcttatattcttattgtaaattctttttggtttccttttggtagcttgaaagctcatcttgcttttatcatttggttttgtcatgggtttggaatgggtttttctttttctatagacataaggatcttgaaaaccaaactgatagcaaaaatctcccatttctcttttaccaagaatcctttgttttttgagttgatctttgatttttaggtcattgcaaagctcagcccctactaattgtatcttttgtgtgatttttccaatatctagatagtgataatttatactccctcccccttcttttcttagggaatttctaaccttttcagcaaataaaggaggtaaactagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccggcaaagtgataaattatgttatagattagagtggctaaggcatcagaaatgttaccggttggattcccattaccatctctatcaggtaatggccttccttgatcatccctcttaactgcgcaaagaatctcctgtctttgagtttcatttaaataattattccaccatccttttaattgaccagaaaacccaatgacaatcatattggcagcttctctttctttgtttccattagctatgcaggcattagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgaccatatcatatttctcattatcagaaatctcattgatgtttttatttacttttaaattatttagttttaaggctagcttattgactagttcttcagagattgcgggtccaaaagccttttgttttccaagtttgatgttaggatcaattgttgggacaaacataggactaacagactgagaactagaagactgag

SEQ ID NO: 13150 - DNA, 14197 bp, Oryza sativa
aatcttctgcttcggatttttgctctttttttatcatgttttttcttttgaagaattcttcgaagtgtctgacttggctactttcataccaatcaaagaaaaagatgttcttcctttgttctctcatttctttatgccaaagttctcttatctttagtctaaatggttcatcgaccctttcaaagtatcttttcatcttgggtcggttcttttgaagcctgagttctcttttaagcaaatatttatcaatttcaaactcatcttcttctatagcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctggtgtttcaatcaaggattcgacttccgactgatccatagacttaggttcaacagcttgagataaaacccatttctcaggcagggtgatctcatcccatttcagggttttggggatagtatgtctgttattaggattggtttgaaggagagtggttaggccttttggtgtataatgtttggcacaaggtgctaaagttgtcatggctttgtagtaaactctgtaggtaacggagatgttttcactccctggttctagatcataaccagatgtttgtaagttgagagtgataactttatggatatttttgtctgagagggatacagaaaaatcgggaaaggtattaaaataaacaggaccattactaaggctggcttccaccatgccaagtaaggaatctttgaaccttttatttctgcaatctcttagacaagccagaacagagacgttcaaaccctttctagtcaaggatctgatagcaacttgtataagaccaaagtgaaggtagtgatattgatgtttagttcttatagaatcgatttctctttctgaaagaagatgcagggtttcatgcaaagaactgattggaatagttttttcaattgttttttgtctgccacaagaggtttatatatatatatatatatatatattgttatattctttttctatagcattttttagaaaacttttttatatgaattattttcatgaaaactttctacaaatatactttttatatacaaactgtctatatagaatttatgtatataaactttcatatgtatagatttatgtatataaactttatatatatagactttatgtgtatgaattttctatatatagactaggctcagtcacgcagcgatgctccgtttttcttttttctgtgatttcctttttttttctttttatacatgatttctattacgcgtcaagtctttctgtttttcccactcctctcctttttcaaatatatattttttgttatattctttttctatagcattttttagaaaacttttttatatgaattattttcatggaaactttctacaaatataatataatatatatatatatatatatatatatatatatatatatatatatatatatatatatatatatatatatatacaaactgtctatatagaatttatgtatataaactttctatatttagactttacgtgtattaattttctatatatagactttatgtatatagactttaaatatataggctttttatttataagctttatagtatgaattatatttgcggttagaaagtatagtgtataaatttagtaaaaaatcatcagattccggatttttctttagaaaatagaatccaatcaaacaacttgataatagaaaaaaataagcatgcaacgatctgatcttgtaactgaaaagacagaatactagtatgtactaggaagtaggagctgaagcacgttattgagacgaactgttcgcgagatgcgaatgttcgtgggctagacccacccatgagtggataaccccttccgtttcttctatggtggacttgctgacccaaactatcaccaggtcgtcgtcatgatcctatgggcttcaccaatagtgaattagctaggccggcccaggataggaattgctagtcatgtactccgtagttctggtgggccatatagagcttccggcccagccaaaaaaatgaccttggattattactaatagatacatgtctgttgattatagtatttattaattagggatgaaaatttcgtgtaattgatagttcaggtggtcgtacggactatatatagagaatgcatgtgtcaactcgctcagagaaaaaataagaagaagaaggaagacaatgtgccaacgagcggtgagcagtgactttgctatagatgtatgatgaacaagtatcacaaattgtgcaagtgtgttgcacttgcacgctggctggagcagtaggggcccaaagcacacatgggactggagtggatagtggcagttggtgggcggttaattggaaccaattgaaactgcctccgggtagggatctcgtggccacttgcacaaatgctcctttcatttaaaaatcttctgcatattttattttctatttttttcaaatgagatattatatttaaagttttcacacattcaaacttaaataaatggatttatcttttcctttttacagtgttggattaaattattgactggaagcagtcatgatgttaatactcgttggttgcatgcatgcttatagtttttgtcttttggaataagttaatttctttttaatcttagtgataaaataaatatacccgaaatttttgcatatagggagtatagtgctatgcctccgagtgttctggaagctagctaatgtactctactatactgtactagagtaataatgttaggggtaaatcttaatgaaaacaccttatgaccatcccatatacaaattaattaagcttctaaaataataaataaattaagagttagtatacattacaaccgatgcaattatcattttttacatgaaaagagactttaaacattgtcatcgatcggtctaagacagacgcatctagaaattaagaaaatcaaaaccacggccatcatatattatatattctgccattctggatcactctagctagctcgaccgatcaatgatccgtataattgcgggcgatcaaataataccggtttgagctggacgagagatgggggatcaataatttaggaagcgatcgatgatcgatgttggttaggtggatgcatgcatgcgcacgagcgcatgatcagatttgttaatctcgatcgcgagtggtactagtactagtagctatagcagcatgcatgttgggggcgcaatgatcagtggccactggccagtggccagcgccaacctgacgaaatccagcggtggggcccacatgtatgtcgcagctactagctagcatcctatgcaaagcatgcatcatcgccgttgcattgcatatgctgcaagaacaaattgctgcttcacagcaaagcagagagagagagagatttggattttggaacgacaaccgcaatgcacgggtgcgggcatgcagcagatcaagctcagacgatgcagatgcatggtcatggatggactaaatatcgatcatgctgtgttgcagtacgcacgggagcgagagggccactgcagggcagaggtgtcgggcagcgatgaagacgatatatgttgtcaacttgtcatactaggatcaaataatggatcggtgtgcatggtgataggccaggggtcaccaacctgatccagtgatagatttgatcggagatgtatgtgttgcagcatgatcttggattgtggatatacattgcatcgtggggattaatcaatgatagggggactggataacaagttagctcggctcgttaaaactcatcttatttaaacttattgtctcaacaatctagctcgattcatatcgttaagcttaacgagctaaaagcctaattcggttcagtagcgagatagcttggtaaacttgttaggcttgatgatgtatttaaactatctttgtgatttcaaatttatcattttatattatgtgaatacaataataaacactaactgataaatagctcactaaatataaataatttagatgtaattaaaaaataaaacactaagttaagaagcagtaaattcatctcttgtactaacgagctaaagctcgtgtattggctggttaagatacgagttaaaagactaatttggttcaactgattaaaactatgagttcaaccgatccgaatcaagctcgctacgagccgattcgacccacgaggcgatcccacaatataattaatgtatgtcctgccaccactattgtgtacttgaaacttctaaaaaaacaagtaatgagttcagcctttgataattaaaaaacaagaattatctgctccctttgttctaaaatataatagcttttaggatctatttggagagcttaagattctgacaagcagctgatgagaatctggagaagctgagaaacctagcttttggtttctaattcattttccagattctacaattacagattctcagaatctgggtaaaaagctagactgtttagggtagcttcttacaactggagattctaagagaagctgcaactgctagaagctccccaaaatagggccttcaaaatttgtcctaaaatataacttcaccatctactttcttaaccaattacaaccttccttcatttaattccacatatttccttaatacttgtatccaactcttaaactttttatattttgagatgaatgtagtagctctagctactttagctaatatttactccctccgtcttaaaataaattcatttttcactcaccttacacatacaaatgcaatagcaaaaagactaaaataccactactttattaaataccaatacaattattttcattttatctgctcccaatacaaactccgatgcaacgattccttagaaataatcttattttgagaccaataaatattgtccaatgtcaatcgaaaaagatctacacatatcccggcaaattatcgatgggcataacttttcaaccaactactagggaaccgaagacccaaaaaccagttatgaaatacggcccggtatagttcacaaatttttttttccaaaaacattacattgaatctttagacacatgtatggagcatcaaatatagataaaaacataatctaattgcacagtttggatggaaatcgcgagacaaatcttttgagcctaattagttcatgattagccataagtgctacagtaacccacatgtgcgaatgatggattaattagtctcaaagattcgtttcgcggtttccaggcgagttatgaaattagtttttttcattcgtatctgaaaacctctttcgatattcgatcaaacgtccgatattaaaaaaaaaattccttttcgggtactccatgctacaagccacctcatcgaatactttggaccgggggaggcaggttgtgggccgcctccgcctgcagcatctgcacgtacgcacacacggccgtggtggccggcgctgcctgcacgcggctgacacttgacacaggcaccgcaggcagaggcgcacgtactcatgacgcacgcgcgcacggatgggcactgcgccctcgctgccccggcgcgcgcaccgagacaaagcagagcagcagagcaagcgtgcggacagccgcacgtgtgggcacgagcgcagagcggttggacggaccgcggatcgatctcggcggggccgcatatcgatcgtcgtcaccgcgtcgctgacgatccctgctctgccaccgccgatggccggccttttaggccatgcacagtgcaccactccggcgagtatcccactcgatccacgtgggataattgatgatgtggaggagagaagaggatggaccccgtcttctccgcaatatcaatgtgtcttgcagaagagtttgtttcctcccgccagaaaaggaaatagcgagagcggtctcctctgcttgtgtgtatgattcttcccaactccgcacaaagaccacaagagtgatctctctctaatcccttccaacctccgccgggctccgcttcgtgccaccaagtccgtcgtcaggagaagaggggataggcagccggcgcagacactggcccgtcacccgacgccacgttggatctagcgatagctacgtcattgttgtcctcctgccgtcgaagaagacggtcatcctggtaataaagctacctctccctgctctttcttcccattcttcccctctcttgcttatccccctaaggagatggctaaattttctagaaatctgagtcaccttaaaactagcaatgcctatggattagtgatggatgaatgtagtgtggtagtgttaagcaaaactgtctttcacaacgtcaccccttaagcgagctcccagcttgcagagaggcatgaacagtacaagcccctctttgaaggagcctcaggtgtcggacttactaaagccacaccttatctctcccaatacaaagtggctccagtggtggttttaacttttcgtctcaacccctggtattttctattttagtcctcctagtttttaatttacatacaaatccaatatttagactgagtacccttgaaaccgaaaaataataaaaataccccttcctctctactttcccctcactctctctagcacgccgctccatcgacctgtcgcaggtgtgccgttggcgtggtgccccttgaccggcgcgtgatgagcttgggtcgaggtaagaaagaagctgacatggcagtgaagctagggatccttgtggctatggcaacactggatggcggtttcctcaggtagtgtcgaggacgtcgagtctctccaccatcaccgtcggggcctttccctctcaagaagaacaaagggcgccgatatacggaaggggagcggatgccaataggggcggagctagagaaaagatgagggggttcctacctttctttgtgtaataccgacatctacagatctagggcgacattatactaaatagttgcataactaataaatataagcattatttctttaattgaagggaatataccacaataaatacatagagaagagtaaaaaatgcataccgtaatgaagaaatcaactagtaatatttgtgaagttgataatggttcaaccatagacaaagacttccatcaacaaaacatatgaatatatcatgcgaaatgtgacgtcaccatcttcattcctccataggacaacgaccttgaaaagagatagatataatttaattttcaacaaagaataagtcatgaaatgatttgatacaaattaaaacattttttttttcatattggtactatccagtgcttttcttttgagatatttctacatagcaatatattcagaccaaataaaaattcaagcttttatattggtgtaacaagtgttgagggaaaacactcacttgctctgagtgttggctaactgttgtttgatagaatcacaattcacaaactccggtactgccctccgtggctccgttgactacaagcaacaaaaaataacataatcatgggtagactagcatatattaaaagagaggaacagcagggacgcaactgcgcaagatttagtgacttaccgattggatttggaggcgattccggccggcgttggggccactgggcagcacgggcagtcagccgcacggcctacactggcgggcggccagccggctagggctggcgacctagcgtcagttaggctcagggcagggtggcaggcagggcgcacgggcacgacagtgggcactgggcaggtaggaggcagccaggcagaccactgagaggcaagagcgacagagacgcagacgggagagtgatagacagaggaagcgacatgcgtttgatttttggaagaggaagcgccaaaacggtgccgcccgcgcgctaattccaggtcgccgcccttcccccttctgtcgcgcacgctcgactcgaaatcagaagcgacttctcgtatcctcctatctgttgggctacctgttgggctgtagttttgggccaaagacttggagggggttcctcagtttgggctgagggggtgcctatgtggtggagatatgggggtaagaaggtatttagaattttgggcaggtttcctaggcaccctgcctggcccattgagctccacccatggatgccgaggaggctgaagaacggcaagggatcgagattgacgggccccactgccagatcaggctagcccattcctctcggtgatggtggccctcgatcgtgtgacgatgaccacaagctccttctcttctccggtgatagcgacacccaaactctgatgtaggatcggggttgcgtcaggatggaagcggggactagtgggactagggatttcccccggcttagagccttaactgcctaagaggactgccatctgttgtcactatggtgtgcttgtcttcatccgtatcgttgagcttggcaaatagctggaactgattctctagggctggaaaggagggatggagtagcaactcgacaacccgcgagcaaaggaggaggcaccctagtaacgtgcaatgatgatggtggtagcaacaatgccaaatcccttctttctccactcttgatggagccgcttgggcccctagctatgcccagatctagagttggcgcatgaatgcatggttgattggagtggcggggttgtatggtggagcggttggcaagtgttgatgtgttgttgacgataggggcatggcatggagcccttaggctggtaacggaggataggaggagtatatctatagcgtacctccgatgccaccatttggcccctcacattgtttgcatggtcttcactattgatattttttatgttgacagataaatccgcaagcgtacggataccgttgtagcatttcatatatgagtatcctaacggtatcgtatttataattccttagggaagacggcgacataaacatatgatttgtatatctttaatcagcatataattaattcaccatagtctaaaaggggttaagataataatggataaggtagtggacaaccagaagatttacctctgtaataatgtctagtagaaaatagtattagtgaactacagtacacatgtatttctgtactaatcatgtttaatatacacttaacatatacatatttacaacatagaaattagttccaggcacccaagtactctcgagagaccactctctgttggtctgctagtgtggttatggcatttacgcttttacgtcatacccaaatgtggaggaatacaaaggacggatatagctgtcaccacctaccgcttacctcactttccgttggaacacccgcatgcaacgacatttatctaacttaagcactatgcttgtgctagtaaataatatcactaactcccgcagaactctcaccctcggatgaacaagttggagctagagcacctataaaggtcattagacaattatcgtagcatggatcgacttgcttaggatgaaacagatatacgaagtatatactactcatagaacatatactcaataaagaaatatataaactatgagcataaataaataaagaagataattatattaatcaaactatagccttacaagaagagtaaaatactaaagacatacccaaaacttcgagaagactacaggacagaagctcataagccttattcctactagaactatagatagtactatatggaagagattgaggtgtaagttgtgaagtgagaagctcctctccttttatagcctcccaatgacggttttatgcggttactagtccgggaaaccagcataccgccatcaggactgcaggatgaggcaccacgtggaggccgccgccgtcgcccgccgcctcccctcccgccggatccggtggaggggagggccgccctcaccgtcgcccgccgcctcccttcccgtcggatccgacggaggggagggcaccgccgtcaccgcctatcacccgctgcctcccctcgtgccgccgcccgctccctcccttcccgccggatccggcggaggggagggcgcaacggccacccatcggcgagctgcgccgccactgatgcctcttccgggccgccgcctggccgccgccgcgcgcaagagagagagagagagagagagaacgagaaagatcgagagaggatcgataaggccgactccacgcttatgtatagggaggccgatgctatcggctcggtggctcggcggctcgtcttggtttggataggtgttgggtgtcggtttttaattaactgacacctataatatgttaaaggtgctggtttttgttttagaatcggcagctatagtataggtgtcggtttttgtttagaaccggcacctatagcgccgatctctatgagttttttttttaagtagtgcactcaactgaaaatcttagaatgtataagaagaatcatgctcttatccgatcataccactacataaatcatcgtcgctaacgtacaggtgataaccctcgtctgtattaatggatcgatatatggttgccattacagataaatcgtcagttaaaaggctatatgtatcgtcggttgaacaccccttagcaatcaactcatctgtaatagcaaccataagctgcagatgttaatagcccctaacatttgacatgttgtgaaccattacagatatggaattcagactaaaaaagaaaaaaaaattaatgcagctccggtcccaccatcaagatgtcctcattgccaatgtcgatgtagccgataagagcacccgcaatggtaaagtaaggtgctactataaaacatgtatatctcgataatagactagattaatagtaaaccacttcaatggtatgtctacatggatatctatagctctctaatccattgtctcgtttttctctatagactatctacaggttagtagatagctttgctctctctcttcatttaatctctttcaagtagaaaaatatgctaacatggattttttataaagagcctataaataaccattgtgggtgccctaagccgctcaaatgctcaatgccatagggtcaccatgtccattaattgttgccaaagacgtgcgtagtttgctcatccatgcatgttgtcgaatccacttgacagtagatatatatatagaaagcacacggtaggaaaacaaataatgggacgatgaacaactagtaagcaaagaacagaaaaaagtgtactccatccgtccaaaaaaaaaagacaaaccctggtttccgtgtccaacatttgaccgtccgtcttatttaaaaaattatgaaaaaaattaaaaagacaagtcacgcataaaatattaatcatgttttatcatctaacaacaatgaaaatacgaattataaaaaaatttcatataagacggacatttaaagttagatacggaaatccatggtttatctttttttttagacggagggtgtagtagataagtaccacacaatttgtagaacgggaagagagaagtggcgtacgtcagggtggtgattagtgacctagagatcgactgttccaagctactggtggcctcagctacaactatagtttcaccttgtcgttggctgttattgtgtatgcatgctcatccgcatgcccatcgtacgtcatgctcatcgatatgctagctccatcacctcgttgaggacaaggcagagctcagggaggggaggcactagctcgaatttgacctctctagcttgccaccgatgtttcggagcttccttgtgatgctaggtacaccttttgatgctagagagccactatatctggatgctcacatactattttctccagattaaaaatacttatcgttttgaataaggacacggtcttaaaaataattttggccactatatatatataagtaaaatcaacaaatatatttctattgtagcatttttaagattaatttacatattatcttaatatttctaagataaatattttaaaaattatttataatcaaagattttaatgtttgacaacagacttatacaaaataagtacttcctctgtcctataatataagggattttgactttttgcttatattgtttaatcagtcgtcttattcaaaaaatatgtgcaaatattaaaaacgaaaagttatgcttaaaatactttggataataaagtaagtcacaaataaaataaataataataccaaattttttttaataagacgaatagtcaaacagtgcaagcaaaaagtaaaaaaaaatttatattatgagacggggagtattatcaacatgcacagacatagtttgcttaactcgacacgtggtaatacgttttgctacctttaattttttttttacctcggtaaagaatgaatcgcaatgtcgttgtcaccctgcgcccacatgcctttcacattggcaacccacagccgcgtcggcaggccggattaaagaatggcagcaggatcgtgttaatccagtggagtgaaaaggtaaaataaaaggacaaacaaatggtcagactcacatcgatcacttcccctttttctccgcagctccaacaggggaaaagataaaatcacttgtccgtttctcgtctaaccggatcatatcatcatgtcattcaaaagctgagatctactagagcttgctccatcgatagaatcgtgtcacgcgacaattaacaatcactttgccgatttgattagtcaagtccctagctacatatccatcgaggcgacctaatctaatggctgtcggttttgaagagatcctcccatagtttaaattacttagcacctattccctccgtcaaaaaaaaaactcaactacttcaatgagacatatccaaattcattgtagtagattatgtcttgtcgaattattagattattttagacgaagggcgtatagctagctagttagtgggaaacaaggaaattactggtaaagactccgaaacttctgccctaaatccaatctctctttctttcccaccttttttctttctttcaaaagatccaagcttttgaagaaagtcatcatacacacgacgaaattaaaaagaagttgttttgcatgcatgtactctggactacctagtgcatctaacacaaaagacagattagtcatgtaattggattcttcttttgagctgaaatcaggggggcctttcaaatgtcgggttcatgcacacctgtagtccactttgagataaataatcagtactgccacgcaaaattaaattcagacaacacacctgacaaagtcaaaattttggcgagtagaaattaaatattggatatatatatatatatatatatatatatatatatatatatatatatatatatatatatatatatatatatatatatatatatgcaccgcatatagcttgtgatcatgagatttacacgatgaaaatcgaccggctagagttacgtttatgcttgtatcacctatggtttcatggacagttacgtccacataacaattctataattcaaatctgtcccttttacttctttaaaaagtgcatgcgtataggcgaattaatcattctcgcgcatcactctctcacgagtgcgagccgaattaatagtgtatattgctcacgcattaaaggccttgacctaaattttcatgcttggaaaggcaatgctgaccaaacctgagcttggtacctgtatggtactaaaatagagcaatcttagattgttccatccataatgtccctattaccacttgtttttctctcgttcatgaatcggtgcccccaagttcaaacgccatgaatgtgccacgtaggcacctcgtaagttccttaaaatatgggcaaatactttttttttctcgatgaaattctagctagttcttggtaccacacggatgaagtatctttcccacacatgaatttttaaagtaagtagacatataacaaataaacctatgtttctatttggcaaggctatcttctctgggagctgaagctacacacacacacacacacacacacatatatatatatatatatatatatatatatatatatatatatatatatatatatatatatatatatatatagtatatatatatatatata

SEQ ID NO: 13151 - DNA, 4107 bp, Oryza sativa
agaataggtggccatgacttgtacacatggataaatcaaactattaatgatggagcgatggaggcatataaatactacgctccaacaacgttgttgattttttatcattcatcttattttaaaaatttacgtaattataatttattttactgtgagttgttttatcacttaaaatactttaaacataatatatatatatatatatatatatatatatatatatatatatatatatatatatatatatatatatatatatattatatttacataaaaaatttaataagacgaatggttaaacatatatttaaaagtcaaccgtgttatttattaaaaatgaaggcagtaataattatctacaattttatctatatatctccagtgatctttaatttctttttccaatgacaatagctagtagtactagctccggtcaatggaagaaaacatgaaaagccaagccaggcgcacgtgtgatggggagaccgacacgactcggcccgatccggttccttgaaccaataatccattctattactacatccaccccgtcacatctctgctcggcctaagggggcatccggtcgttgccgcgcgtgatttgtgcttctactgtcactaccagtaaatgatttttccatacgaggaccaatcttaactaaatctgtattttcatatacggtttcttaaaaagtcagcaagaaaaattaatttttacagataatgctcttgacatacccgtataaaaaataaatatatttttgttatacggatctcttaaagagccgtatacaaaaataaatttttacatgagagatacataaaaagcacgtgggtccccgcctttttttaccgcataaatttttttatcccctctctctctccagcacacctttttaactttctcttctcctctcccaatccttatctcttccccactctcacctctactctcctagtctcctctcccccttcactccaatcacctctctcccgatcacctctactcttctcccctccctctctctaaccttcctcgacaatggcgacggtgggaacgagcggccaacagatggatccgctacacctgctcttgggatcgatgatggtgtgtagatctgctgcccctgcctcgcgaatgtcggcaagagcgagcggttggcgggtagatcaactgccccagcctttggtatagcaacggcgcgtacgtgcggatctgctgcccccgcctctgggagcggtggcggcgggctcaggcggtaggagcgggcagccacggcgaccggcgcacagatctattgcccctactctcgaggatggcgatgatgatagtggtagtggctaaaacgacaatgacagcagtgacggttgcaatgacgacggcggtaacagctacggttttgggtgattttgtttttcggatttttttcaccgaaactattttcatgtgcgattagcataggtgaccgcatgcgaaaatttcatttcgtatgcaattgcgctacccgtatagaaaaatggtgatcttcatagacagctgggtgtgggctggtcagccggatgcaaaattttgttttgtgcttttggccgtctggaaaaaaaattatagtgggtacatgtggcattttgtagatcgtgctcctttaattaacgagaagacatctacccacgtcacagtaatatttataaacaacgggatgaaagcttacgattctaccaccaaatcacgcacctttttaaaagattgggcatgaattatgtcctaagtatatggagtactccctattaaaaattagagcaagtatacagaagtattttttttaagtcagctaacaatatcactgttttgtctggttaattaattagtatgtattatggtgattgttatttgacaatgcccatgcgtatttctaaaggcaaaacagtatcactagtgagcaaatccttattggtaccagttgggaaccggctattggtgtcggttacccagccagaaccaatttgacggctccaatacccaaacacatatgtaccggtacctatagagattatatgtatcggttcttaccccaacaccggtaactctagttttcaacgaatgaaaaaaaaatcttggccaccaacgccgccgccaccaacgccgctgccgctggtaggagaaggcagtggagaggagaggtcattgcggggaggaggcggatgcataggagaagggctgccaccgctgctggtgaccaccgtggtcctctccgctgtcactgccagatctgggtggccctgcggtcctctccgttgtcgccatcggatctgggcggccgctgcggtcctcctccaccgggagagaggggccggaggggaggatggcggaggagtaggcgacgctgcaaccacctccacctccgccgggagagagggggctggagggtagggtggaggaggaggaggaggcgacgccagccaccatgttgcaacaaggaggcggatatagaggaagaggagtggagtatggagaggagagagagagatagaggagaccgcccagatggataaggactaggaggaggaggccgcctggacgaagtgagaatgggtgctcggttcaacttggctctggtgccgggcacctatagcttattataggtaccggtttttatgcaaatctgacacacctataatataagtataggtcctttttttaaaaaaaaaaatcggcacatatacaataggttctagtttttatggttggattttagcatgataacaataaataaaaaaatgtgtaagatagctaaataatataaacttacgtaagtgatatggtgtatgataatttaaatttaaatagtatatagataattcaaatgtaaaagtaagataatggagttttatgagaaaaaaagggagtgagatagtttggaccatagattaatcatctaagtctaaaaataattgatgtgatatgatttaatgggagaagagagaaataacactaactaagtgaggatgaaccaaataggtatatatatatatatatcataaatgatgaagatatatattgaaatattatttaacattcttagattttaaaactctaaaatttaataaattataaaattatagataatataacatgcttgcatgatgtttaaatgcaataattgttagtgggtgatgatgttgtttcttgttaatgcatgataatgtgacatctttgtatgttgagttttaggatttagtaggttataactttacaataagataggataggtgccagtttaaaaaaataaaaaccgacacctatgaaccggtacgtattatatgttttgtagtagtgtatctcatagtactgcatgcagcatagcatcgtcacaaatgggccaagagcctatcataacggttctgtgaaccatcatattttttatgtttgtgataatatgaggtcgtcattgaatgtttttctgccataggaaaatttctattggaaaggagggttgaaatacgtgtacaatgaaactcccaatttagatgaaaacttgtgtaaaacaaaaaaaaatcatctaaattcacaaaaaggaagatctcgcatatagatgaaatgatggtggacaatagtgaaaaaaatcttgtctgaattcgacttcattataaactgattgcgttgggccatttgtggtgtatggtagagacattagaaaaataggcttgggattaggggatgtttggctgctgagcatagtttgccttgttttttgtatgccaaacttttctttaactttatcccatacttcataaatacaataagttgtggtacttgataagaaggctaagagcaagtataataaataagtgatgcaagtgagcttcagaaattgctacattagatttgtgtttaagtgaaaaagagagaagaggggagaaaataaaagcaggctacatatttgtagcaagctgtagcacaggctctagctcttaagatgttgcgtgcgtatgagaagtcgcctaggtattagtagtatagtatacatttatatgtatatgtataggcaggctattagattgactgtaaataatgtatcaattttagactatacaattaaactttcttta

SEQ ID NO: 13152 - DNA, 2573 bp, Oryza sativa
taatggagtatatatatggtgaaaatagctgagttactgggctccaccctaaatatatggggctccgcccgtgattattgttgtagtagttgtttagaacggtgtgctgtgtagtatgtgtctgcatgtgcagtgtccactggtgaagaaaccctttgtagtcccggttcgtaacccccctttagtcccggtttccaaaccgggagtaccaatccgggactaaagatcgctatcgttagtcccgggtgaaataaccgggagtaaagatcgatctttagtcccggttggtaacaccaaccaggactaaagatcgagctgaccttttttttttgcatgcccctgttgctgcatggtttatatatatatatatatatatatatatatatatatatatatatataaaccatgcatatatatgtttcaatacatatatatgcatacatatatatatatgtatatatatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacagtccattatatgtcctagctagctacaatttcgatgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttgatctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcggcgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctccaggtttggttgctctccaagctgagggactggtttggactttccagaagatgctttcttcagcgttcgctcatagtccgatagcttgatggcctccttgacagatgcagacatacccctgaagaagttcctgacactggggtatataggaatcttcttttctagacttcgaggcttgaattgtctcttgacttctgatgcaacgtaagcgtcaagctcctcttgcgtgcaatcgtatcccgggtccttgttcttggcggcgtcaactttcgccttcttcgttgcccttgtgtgggcaggcggtggagctgggggggcccttgactttgaaggtgccggaagaggagcttgtgggggagtaggtgtaggagcacgaggaggagtcggtgcaggatcctgaggaggagtcgatgctggagcctgaggtggagacggtgct

SEQ ID NO: 13153 - DNA, 21348 bp, Oryza sativa
tgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcacctcgtccctatctctgtctggtcggaacgtgccctgagaggaggcttccactgcatctgttagtcatcgcgcagcctctcgtatctgatagccgaagaccagtgagccatcagctgggttgagcgttccaccgtgagcatagtaccagaacttcgatcgttccggccaattagctgttgccggttcgataccccatctttagtcccggttgttctcaacaaccgggagtaaatatcttttcctgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatacgtaattaacatatgccatacatcaattgatttatatggataatcaatacatccaaaatagtttacatcgtgtacacaataattacggcacgtactttctcctcactattgttccctccttgtgatcgttgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacacttcggctcatcaggccctctgcccttctttcctttgctagatatgtccttcacgtaaaagacttgcgttacatcattggcaaggacaaaaggttcgtctgagtatccaaccttattaaggtcaaccgttgttatcccactatcatcaaccattacgcctccaccagtcaacctaacccattggcaccggaacagagggaccttgagagaaccatagtcaagttcccatatgtcctcgatggcaccgtaaacgtgccagttgttccatcgtgtcccatggcatcgatacgaacagcgctgttttggttcgtgctctttatgtcttgggctctcgtgtagaatgtgtacccattgatctcatatccctggaatgtcgcgatcgacccaaatggtcccctcgctaggaaggccagttgttggttgatcgtctcgttacccatgagatgttgtcgtagccacgcggggaaagtatcgatgtgatgccgtgtaatccatgcatcggacttaccgatgttcctggcgcgaactagagccaagtgctcctcgatgtaaggagctactaatgaagagtgttgcagaacagtgaaatgggctttacggaataaattgttgtctaccgtcattattgctttccttccgagagttccctttccccgtagtctcccttcatggcgtgattcaagtaccccgattgggcgaaggtcttcgataaattctacgcaaaattcgatgacctcctctgttccataacccttggcgatgcatgcctctggacgagcacggttacgaacatacttcttcagaacgcccatgtacctctcgaaaggaaacatattgtgtaggtacataggcccgagaatactgatctctttcacaaggtgacaaagcatatgcgtcataatattgaaaaatgaaggtggaaatatcaactcaaaactgacaagacattgcaccacatcattctgaagggcttctaatctatccggatcgatgaccttctgcgaaattgcgttcatgaaagcacatagatttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggttggaatcaagtaatagcttcctttctcttttgtttccgggtgaaggtcgccgcgttgttccatatgcttcagatcattacgtgcttccagtgtatctttcgactttccatatacacctaggaagccaagaaggtttacgcaaaggttcttagtgaggtgtatcacgtcgattgcatagcggacgtccaagaattcccaatagggtaactcccaaaatatagagttctttttccacatagccgcgtgaccatcttcgctctctatatgctggcttccaggcccctttccgaacactactttaacatctttaaccatagcaaacattgttttcccgctgcgatatttaggcttcgtacggtggtccgccttatgttcaaagtgcttgcctttcttccgtaccgggtggtttgctgcaagaaatcgacgatgacccatgtatacaaccttcctacagtgcttaagatacgtattttttgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcaactatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgttaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttagccacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcatagactaaagttaagatctttagtcccggttggtagcaccaaccggggctaaagatcaccgggatctttagtcccagttagtattaccaaccgggactaaagttaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggtctttttttaattcataataaaattaaagaaagtaatgagatgttagtatgaatcactgttaaaagaaaaagaaaggaaatttagtttgtttttttaagctcctgtccttttgaaggccgggcctttttgggcccgtctaaggtctattaattcctcattgtatatatataggatacctaaatactcctagtatatactactgagaatatattgcagtccagataaggcaagagcacaacaaattgccttcaccattcagttttgccgtctacacatgtaatatatatcattatctaaaaaaaacacacatgtaatatatatctccaaaacccagtagtagtaatcttgaacgaatcatcatcatcatcatcatcggtctgcatcactgaggtgtcccaaagtccaactttcatccatctgcgcgtacgtgtgatggaggaattaacacgagtatggtagtaagcccatacgaaaatcttcctcctctttggcaaaagaagtcttgctaaattctctaattttaggctcttgtcaatttaagaatcttaactttttccgcagaggatgaaaaaacgagttaaatgctggcactaatccaaaaactctgcacctagatctccctcagtctcttcaatgtattctgttcagattgcatatattggatcaagatcgacccacaggacccatcaatacttataatagtacatgaaacaaaccaaaccgtgggtaacaattcaagtcctaaacttgacatggttgctcgtacttactgttatttttttattcaatggtataagtaacgtacctgtcgacagcaaggcatccatagtaacttcatcaatctcaagatatatcgaacctatctttgaaaggtcatggtaatttcattcaacttaagatatgcccgttctagctatctttcgaagttgtgtatgtatacgtttataggggtaagtgtgggcacgttgtgagcgacggtgtgtttgtagtgtgtttaaaaaaatcaatgaagtatttaactaattaattactacgtgcttctttcttaaccagtccaaaattaggcagtatatatatcaaacgaaactgatgaatttttctttttccttcttttttctttgcaaaaattaactttgatgtattgtcatgttggacgatgtccatgataggagctctgttatatatagggttggccggatatgtgatagtgaatcaaccagcgtccctatcacacggggggagagccccaatcatgtgattttggtcctatatatggagagtagtacgccaacagcaatttgatgattggaagatgagcttaattaatcgccatctcttccattaattcgatgatcgattggtatagtacgtacgtactcctctgaatccgataggtcactcatcgatcgttaattaaaattaacacgattttattaattatttcttgatgcttatatattagtactagctagctgtgttacgttggtgttttaaggatatagggcctggattctccgataggaacggcacccctaccttgaccatgatatgtactcccaaaggtatagtcgtggcgaggtaagagacgacaaacacacaaacacacacacactgctctctcccaggaccctcaatgattagatgaggctagtctagtgacaaatttgcatccatctgtccctttttctcaacattggggagcttgttctctttcccttgtcatctgatcgtggagcaactttgtttttgttttgccagtacatgcagcactatttggtgagtgggatgtccatttttcatttaattttcactgtgctgcctagctatactagctagagtatttaattgattattcttttgttgtttttttctcttcttctagttagccctagtgctttattcatgtgctcaaattttgttgctaacatcaaggatggatttctttttccctcatttcaagaaagctcactcctaccttttgacaatggaaaagttcacaagtccacaagctgcaaatgcactgctgccttttggagcaaagataaatttataaaacatttttaaagctaattaaatcacacaaccaagatccatttagacaagaagagaaacgcaaagagtaacgcttagtatttctgtgtttgtgcagttcatgcgttccaaaaggaaaagaaaaaaggctgttaatttgatgataaccaaagttcctgttaatctgaccagtgattcgtacacacaaaaggaaaacgtccggtctctctcacgctctcatctcatgacgctacacacatcaatgagcattaagcatggggaaaaggagaggtatcaaaccgggggggtgagggccccaggagtaggaggaggagatggagagaggcagaagaggacaagttagaggccctcgtgcaactctgatttgattgataagccccatgtactaccttgacggcacatcccaaaagccaaaaacaaaaaaccaacacgtacgcacacgacggaatagtaaatggaagaaaaaagaaaagagagggagagaaaaaagtatagcaactggcactgacatggccgcgcacacaggaccggcggaaaagacgcatgaaaagcgcaggatttcctgggaatctctcgtttctgtcctttagccccaaggtttggaccaaaacagctccaacaacaaccgactcatcaatcttaccaaacacttgagactactggcttgtagtaggatttaaccatttaattaggtttgtaaaatttctttggaattcatttctatgctctagttttaaagaattttaaatatgagctccaatctcaagttaatttttcctataagaattccaaagcaatatctctctttctcttactctgtgcaagtaatacatacctcaaaaatcttatatttttcccatgagccatctaaaaacatgtgtttgagcaatcttgtgattctattttccaccagtaggattgatcgtgccacaacattccaatcatgttttttttctattatggtttttttttaaatattacgttccaaaatagccttatagaactcctttaaatccatataaattttagagtatttccttcattaataattaaatcctttcaagactcttttcaaacctaggaattgcatcagaattccatcattttaaagagtggtgtgcggtttttttattcacatcaaaattccatctgtgtgatttcagtgaaaaaaaacatgttctgatatatgtgtggtagtatataaagggttaatttgatacattcaagtagaacattgcaaatttgccaatttgaaaaaaatgtcattaccattcacggtatcgactgggtgctactgaaattttgtaaaattagaactatatcaatattgtcacgttttctatattcttccttattttctttcttcttattaccatcgaggggtcggctacgactacgagaagtctggtcgacaagctcccccaatccatgttaatataaaggaggtggtcggcgagcatccatcgctgccttgaactaccgtgcctggaaggcctcagagcggtcgaggatgcgggtgcaagaagcgttgacaaagaggaggtcggggatgatggggtcgaagccaggatggcgagtaggcgtaggttgaccctgaggaaccggcacgtcggcttcctccttgcagtcgacccctcgactgtgtcacccgcaagtttgtgggctagagctcgtggtagggtcaaatgactatggcatgactagcctcaacgccgccgacaacaatagctggtagccgcgaagactacgacacggcgaggaagagggagctcgcggtgatgggaaaggccccgacctatatctagcgaagccccgtcctcttcggtatcaggagtaggcagggcagttgggaggagctcggggcatgtggcgacaacgcgacgtgcttgagcgagtggtggcagtgcaagagtgggtgggggccatcgggaggagctcgtcatcgacccctccaagccgagtgcaaagctaacgatgcccttatccacagacaccaccaccgcaccgttcgagcgttgccacgtcctcggatccaacgctaggctgacactatggacctcgttggccggcctcctcggagctcactaacgatgagaagaagaaaaggaaagaaaagaaggaagatggaaaacatgatgatgatggcacgatttcaattttgcaaaatttcaatgacattcagtcgatatcgcgaaaatagtaatgatattttttaaaaacaaattggtacacttgtaatggtatggatccaattaatcctattataaatgtacattatacttgtttatgtattccaaacagctcagcttgttaataattatcctcagtgctagtatattagtatatacaaataagacatcgatctccatctccctgatctaaggctgtgaaagatgaggtatagaggataggatggattgatgggcaacggatgcatgtgaggtcgcatgtggcgctaatgagagggcacatggtggagctagcagcagagcaagagagggacattccccactcgtgtgggtggttggttggcggcttaaattactctcactttttgcatgacagagttgggtgagtgagtgaatgacactccactatactactccactccagtaccaccagtcgacgatgcatgtgtgcatggattgatggatatgtagagatagatgctctgtccagtgttgtgcatgcgtgcgtgcgtctgtgtacctactcgttggaagtactcgcggcccccttctttttattttctgcatgtttgtttgtggcttttcatggatcatatggatctccaaaccgggcgggcgccccatatatctctgctgcttctccgaaggttccttgatcgataataaaaacagctgcttaactaattgcaggaccattttgttggtgtcccgttttgcaaaagagaaaaaaaaaaccgctgttgaatttcccttttcccaaatccacttccgagacaaacaaaatgaacaagaggccggggacaagtgagttaagaggaatgaatattgtacacctatccaatcttggaggtcgagaaagcagagacgagaggtaaaccgggaaatggtaacaggcgttgaacactgttccatcggatcgatcgatgggcacatgaatgatagagtatagtagtactagtcgtgtgcgcccatgggaagcagacatacatacggcctaactagcgcacagtacgtacgcactgtatgtgtgtaggcggagcccccccaactcccaaggaaggcggccgatcagatcgatgagcagctagcatagcaaaatgcaggacgatccatgcaattgatgcgtgcctagctgtgagtcgatcgccggccataaatacacgcacgcgtgcacgtacattacattacacccatccatccacgatggatcgatccatggccgtctccatcgatatatactccctccgtcttcttaaatgtttaacgtcgttgatttttttaaatatttttagccgttcattttatttaaaaaaaattaagtaattattaattattttcctatcatttgattaattgttaaatatatatagttttatatatttcataaaattttttaaataaatcgaacagttaaatatatttaaaaaaattaatagcgtcaaatatttaaggtacggacggagtatatatctgtcgtatactcgaatcagtggttggaatgataaatgaagagaggcgaaggtttggggcgggcgcgtatatcatgcatctatgggcaattggcatcggcgcctctagtaggagtacgtacactcctggagtagtacgagtagctagcagcaataaatgcacacggcaaagatgatatacaacgtactgtaggcatcggtgtatgcatggaccgacctcccatccgtgcgtgcggtagccccctcgctcctcccctgcaactgcaagctgccaacgcgggcacacagccaccgcacgcccatctatcgccatcccctctcctctcctatcctgcgacctgcgcgcgcgtgcggacgtacgtacgtacgcgcggccgctcgcgatcgatctctcctctccgcgcgcgcgtcaattcattgctcccaaccaaccaagcgcagggagcaacactgcgctgctgactccaccgcccggcggccgcacgcgtgcctgcagcctagataggctaccgtagtagcgctagcgcgggcgtgggcgcggcgcaaaaaagccgcagagcccgcccgcccgccccgaagacggcagacggcgcaggaggcagtaattgcgatcgtgcgggcgtgcgggggcactacccacacaccgcctactgccgtcctctttctttaccattaacgtccagcccatgcaggctgtgtttagtttacacttagaagtttggttaaaactagtatgatatgataggaaagttatgcgtgtatgaaatgtttgatgtgatagaaagttagaagtttagaaaaaaaactttggaactaaacagggccgcagtcccctgtctcagttcctgttttcttactatcctctccaatgcatttatttattatctagaaaatcagtaatttatccttcgttctaatataagagcaggtgcaatactggacggtataaggtccacgtaggattttttgatgagctagaggagagacagcagcagcagcccaactgcatgctcgtcccgaggcagcggggcccactagcgcgtccgcatcgccaactcgccatccgctccgcccgcgttccccgttgtcgccgtcgcgctacaccgaacgccgcctcgtccaccatcgccggcgtctccgtcgctctcgtctgccgtcgttgagctccaccgggccgccgcctcgtccaccatgaccggcgtctccattgcccttgtctgccgtcgtcgccaccctcatccaccatggccgccgtctccgtcgcctacgtcggccttggcagcggccctcgcccaccgcgaccgcctcggttgcggacctcgtccacggcagccactaccgccgccactgtggttctcgtccagcccgaccgcctgcgtcgtcctcacccgcatacgccgagccgtggccaccatcctcgcctcgtcgcccgtatccctttcgccattgtcgccagcgtccatctcatcgtcctcgcccacatccgccgcgccgcgaccgttgtcctcatcctcgtccatcccgccgtccccgcccacatccgtcgtgccccaccgtcctcgtcctcatccatcccgccgtcctcgcacgcgcctgtcccaccacccttgtccacgtctgcagcggccgccgtccccttccaccacagccgtcgtgtgctggcctcgctggacccgatgaacacggtggccaccgcggctgtgccggcgagcgccccacgccacgcgaggcccttgttgaggctgaggaccatcttgctgaccgtgatgtactggtgttcgtccttggacttgagcacgtgaaggatcccgtgcatctcctcctccagcaagaaagagagtagagggatgatgggcccataaaaattaaaaaaatatttgtgttgcagtaagtatacgatatctctattgtatcaattggctataatgattactccagatgaggtgtccctctattgcagccgatagttggctctgttattgacctcgctctaagcttaaatttttcacgcatcccaagtataccaataaaaaacataatactttattcttctttttatattttgccaatgcatttatctcctactttctcaaattcggatgcaatggttactcaaaaatgaacttaaaaaagagagatgagtcaaaaacgaacttattctgaaacagatgtagaatcgaaacaaaagaggctccttgggcaaaccctaaccaccgctacaaccccatcattcctctatcctcacagtcgtccaagcgagccactggagatctgtacatccattaggaaggtggtggcggggccaaatcactagctagatccaagccagcgagaacaaccttatggtgattttttggttgtggatggcaacatccttatcacaacatgcagtacactggtggagaaagcgtttctagtcccggtttgtaaccccccttagtctcggttttcaaaccgggactaaagatcgagctgaccttttttttttgcatggccctgttgctgcatatatatatatatatatatatatatgaccaaaatatatatttacattaaagaaaatgtgtacatgcatatagaaaaatagacatgtattaattacaatccattatgatgtcctagctagctacgatttcgacgtagtagtagttgttatctcagaagctaaggacctatgaattgtatttccgtcatagtagaattcacccttgtgatcaaggatttgttcgttgatgaatcccatgagttgttcttgaaccgccacgataaattccttgtgtgtgatcaggttatccctcatgcgaataagctatatgaatgtatgaaattaattagtaattaaacaacaaatcgatacgtacgcaatgaaattttgaatttatttgcacgtacatcgagctctcttgtggtgatgatttggtctgcaaggcagtggcaatactcgcacatgtagtagccgcacaagttagttccctgcttttgctttgcgcactataaataaatgacaaacggcgagagatctaattaatatatacttgtatgtatttgaattggagatgaatataaatgtagagcatgtgtactcataggaaatttgaacttccgcctaagtctttctctccatttgccgcggaccaaatgacggaccaaatcttcaccggtcaccaacggctcgatctcttggtttggttgctctctaagctgagggactggtttggactttccaaaagatgctttcttaagtgttcgctcatagtccgatagctttatggcctctttggcaggtgcagacatacccctgaagaagttcctggtactcgggtctataggaatcttcttttctggacttcgaggcttcaattgtctcctgacttctgatgccacaaaagcgtcaagatcctcttgcgtgcaatcgtaccccgggtccttattttttgcagcgtcaactttcgccttctttgttgcccttgtgggggcaggcggtggagcttggggggcccttgacttggaaggtgccagacgaggagcttgcgaaggagtcggtgtaggagcctgaggaggagtcggtgaaggagcctgaggaggagtcggtgcaggagcctgaggtggagacggtgctggagcatgaggaggagacggtgcaggagcctgaggaggagatggcagagccggaggagatggtgcacgagacgccgcttgtcgcccagggaggatgatgtaccgcttgcgccatagtataatggcgtggcttgtgtctcgtagatgcgtctcaccgtctcctctatggtaatccaactcgaggtcctcgtacgtgccttccaccaactcaacttcgaccttggagtatcctgctggaatcggcctgcagtggtaagtacctgaagggtccgttggtatggccatgcccgacgccaccttcacgtggtgagacgttatttattagtaatcaacatatataagcagcaacttgcggaatggacaaatctaaaatctataaactacaaacttacctttattgataaattcttgaaggaaatatgcagcttacatggtgtccgctgagtgatgtcatcaacagggcaggtggtttcgtcctgggtttgcatggcgtccatgctctgtgatcctacctgccccgttgaggcgcagctgctacgattgcctgaagggctcaccattgcaggaggaatggtcagctggggatcatgggaccgatgtgcggctatgcgttcatcaaccttccttgccacctcctcttgcatgctgagctcgagctcgataccctgtactcaagatctgcaatcttcgcatcggtatctctcttgctcctcatccgactcctgtacgtgtggatgtcctccttgaatccaatcttccaaggaatcacccctttccctcgtattcgtcctggatgctctggagtctgcagggcgagtgacagctcgtccttctctctctcaggtcggaacgtgccctgagaagaggcttccactacgtccgttagtcgacgcgcagccttgcatatctgatcgctgaagaccagggagccatcaattgggttgagcattccaccgtgagcatagtaccagaacttcgatcgatccggccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttatatgcaatgaactcgtcccagtgatcccttagctttgggaatgtgtcgaagttcggtgtctgccccttcaggatatatttctggtacagatctcccttgaagctctgaaactgttctgccattttctttagagtccaccttttcactttgtcctctgtacccgcgggaagggtgaatgtctcgagcattgcggtccacaacatctctttcttcgaatctgggacaatgctctcatgatctccgcgtgcccttgttttgccagtacaccgtactgacaggcatgttatcccgcacaacccaaccgatgtgtcgtacgtagttcttggctgcttccgccggggcactaggtcggccgtcttcgtccacttccgttatgatgtgccaaccctctagcttcttcgcggcacctcgttgcccgcgtgccctcttctatccagcggagggttgacttccactagcctcctcctcctggttcccctccacatccctctccacgttcccctcctggttcccctccgcatccctctccacgttcccttcctcgttcaagtattggtttggatcctcgttcccctcttcttcgttccagtactggctgctttcctccgcgattgtatcgtacagtatctattcctcatcacgatcagccatctgttcatacgagaaatagttgctaagtctataggtcatttttgctttaacaatcttatatgctaacaatcatatatgctaagtcaaatatgctaagtctaactgtcgtatattataaccctacacaatcttatatgctaagtcttattacaaatctaataatcttatattaaaactctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcgtatattaggaccctagacaataattatataccaagtctaattacaaatctgataatcttatattaaaactcaaataatcttgtattagaactatgctaactcaaacaatcttatatgctaagtcttattacaaatctaataatcttatactatgctaagtctaagtgtcgtatattaggaccctagataatcatatatgctaagtcgtttaagtgtcgtacattacaaacctagataatcatatatgctaagtctaagtttcgtatattaaatctaatagttttaattgcattaaaaaaaatctaacaatcatatatttacatcacttgcctgtgcgaattccttcgagggctagctaccactccggcttgagggacgacgacgacaacgtcttttctgcaacatacaaaaagatgtattaggataaacgcaaagtaacatatattgtatttcacattcgcgttctcgttaagttcacgtttcgttcacgatcgttcacattcacattctcgttaagttcacgtttcgttcacctacgtgcgttcacgttaacgtatgttaagttcatgtttgcgttcttgttaacttcacttttcgttcacgcacgttcattcatttacgtacgttcatatacaacgttaagttcatgttcgttcacgttcacgttaggttcacattcgttcacgttcacgtacgtttcgttcgttcacgttcgttcgttcgttcgttcacgttcacatacgtttcgttcgttcacgatcgttcttcgttcgttcacgtggcggcagcggagcggcggcgtggcggcgcggcatcggcgtggcgcggcctggcgtcgtggcgcggcttcgtcggcactgccggcgcgacgtcgtcgccggtggcggccgcatcgaggtcggggttggcatcgtcggtgcggcggagtcgtgttcggccgcgacgacgccggcggcagcgtcggcaacgaggcggctgatggcggtttggggagagagagagagagagggaggcggcggcggctctcaccccagagatgcggcggcggcggaggcggcgacgatgacgcgcgcgagacgacggcgagatacaacggcgacggcggcgcggggatgccctaggcagtggcggcgaaggagaagccgagagagatcgatccgggaaaaaacttctaagtgttggtggagaagacgagggcgcgcatcgggaatatatatacccctagatctttagtcccggttgatgagaacaaccgggagtaaagatatctttactcccggttgatgagaacaaccgggagtatctttacaccctgttgttctcatcaaacgggaataaagatattttccagctatttccaaattctttttaaacccggttagtgttaagaaccgggactactgataagcgcactgaatattaatttccattacatatgtgtttctaaaatagaaaataatgcattaaaattatttgaagtcgaaaaatcaatgacaattacttcgaaacattattgttgtctgtagtaaattaagtggataaaacgtaataagcaaatatatgatttaaaattaataaaaattctaataatcatatatacttagcatatgaatgatattaaattgttaaaaattgtaattaacatatgtatatacatacgacatgcatgatttaaaattaataaaaattataataatcatatataattagcatatgaatgatattaaattgttaaaaattgtaattaacatatgtatatgcatacgacatgcatgatttaaaattaataaaaattataataatcatatataattagcatatgaatgatattaagttaattgttaaaaactctaattaacatatgtaaatgccacatgcatgatttaaaacttttaaaaaatttaattatcgcatataactagcatatgcatgatttcaaattgttaaaaactctaagtatcatatgtaaatgccacatgcatgatttaaaacttttaaaaattataattatcgcatataactaacatatgcatgatttaaaattgttaaaaactctaagtaacatatgtaaatgccacatgcatgatttaaaacttttaaaaattctaattatcgcatataactagcaattacatgatttaaaattgttaaaacctctaataatcatacgtaattaacatatgccatacaacaattgatttatatggataaccaatacatccaaaatagtttacatcgtgtacacaataattacggcaatacatcggcggtgacggttgactgcacgtactttctcctcactattgttccctccttgtgatcgctacgtgagtaaggggtgtcttcatttgataggaggatgctagggtcaatcgtcactgtgaaagggggttgcccatccaactgatcgtaatcctcgttagtcttgtcctcaactccgacgatttttcttttgcctgggagaaccacgggacgcttcggctcatcaggtcctctgcccttctttcctttgctagatatgtccttcacgtaaaagacttgcgttacatcattggcaaggacaaaaggttcgtccgagtatccaaccttattaaggtcaaccgttgtcatcccactatcatcaatcattacgcctccaccagtcaacctaacccattggcaccagaacagaggaaccttgagaggaccatagtcaagttcccatatgtcctcgatggcaccgtaatacgtggcagttgttccatcgtatcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttatccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcatgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaaatcaaaactgacgagacattgcaccacttcattctgaagggcttctaatctatccggatcgatgaccttctgcgaaattgcgttcatgaatgcacatagcttttttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccggacggtacctttatgctctccaagcattcaaacatactttccttctatgccttgctaagagtgtagctagctggactcaagtaatggcttcctttctcctttggttccgggtgaaggtcgccgcgttgttccatatgcttcagatcattacgtgcttccaatgtatctttcgactttccgtatacacctaggaagccaagaaggtttacgcaaaggttcttagtgaggtgcatcacgtcgactgggctgcaggaatt

SEQ ID NO: 13154 - DNA, 472 bp, Oryza sativa
gcagcactcgtaggttaaactcctcctgtttgtcctcgtcccacatgggaacaccttcctttttccacaacaatttaagatcttcgacaagtggtcttaggtacacatcgatgtcgttaccaagttgcttggggccttgaataataatcggcatcattatgtacttcctcttcatgcatagacagggggggaggttgtagatacacatcgtaacgggccaagtgctatggccactgctcatctctccaaaaggattcatgtcatctgtacttaaaccaaaccgtatgtttcgtgcatcctttccaaagtctttaaattttctgtcgatgttttgccactgcgaaccatcggcggggtgtctcagcatcccgtcatgttgacgctcttcagcatgccatcgcatcattctagcattccccttgttcctgaacaaacaccttagccgtggtattatagggaaataccacatcac

SEQ ID NO: 13155 - DNA, 393 bp, Oryza sativa
ctgcaaggttggccatccccagacgaccccagtcctcccagccggcgtccatgatttgctcccactggtctgaagccgtgtgcagtgttgtgctcgtgtgtgtgctcctcgatccgtcgtcccatccccatgcaccaccacaccaccgtgccgtgcgtcgcagcgcaggagtagtacagtacagtagagtacagaagaaatttcagcagaaggaggctgcacgcctgcacgcccatacgcacgcacgcggcggctgggtgggtgggtgtgtgtggtgtgcgtggacggggatgcgtccaagcgagcgtgcgcgcggcgcagggcggcacacatggccatgccagacgcgccacctgtaggcagctattctacgcacgcacggtggtggtggtg

SEQ ID NO: 13156 - DNA, 3516 bp, Oryza sativa
tggtgacatttctagtctaatgttgggaatgaaaagattttattttgttctcaaattttaatcatgcaatggtttaagttgatcatcacctaaattaaaacggaaatttttggctctcgaaatttggagaagttaacctctaactattttgacaagaaattttaagtcctaaaatttcgggtatgttacagtctatcccccttaaaataaatctcgtccccgagatttgggtagggttggcttaagttatgactatctccagaggattgacattgacagcagataataatttcttttaagttgtatgacagacttgctaccataaaacatttggaaacttttatttcgcgggtgagtggcaagttctactcagttgtgggtttatggaagcttagatagttagttaaattgacactagagaagttagttccaacaagataaatgttggttcatattaacaggagcttataaccagatttctaacttagatgaacttatgtttacagattttccaaagttctggacagcaagcacagaggtttctaaattaaggacaaacgagttcttagttactattacatccatccaacaagttcttacataaatggagtacatggcagccatattacatatattacataccacgattttcttccaaaatgggccaccacatacctagactattccttaagcttgtccttaagtcatactaccgtggcagtagaggttagataggactattgattaatctctcatcctcagcttgaagactcgaccataccattgaacatactctggcggtccatacggtccagtggttccaagtggaggataagcagtcctaacatcgacgcgcgaaggtgggcttctttcaatatacattccaacaggtggtggtatatcttctgctggtgcaagcatggcatcctcaccaaacatgaactccggtgtataatgtccctggcgataccttggcataatgattctttctaaactggctaccctggtgcggacgcgttgcagctcagcaaaggttgagcgataaagcatatctagtgagcgcacaaagtttgcaagttggaggtatggggtatgtagtcctacacctatttcagctaaccctgggtaggtagtgtgttgagctccctcagttaaggatggaacgtagcagtaaaattcttctatctcaggtagctcatagcgaaggcggatgatagcaacataagcacagttttgcaaagcggacttaatatcccacccataaccagtatattgaaggtctttctctagtggagttctaccccgaatgcttacacgaaccatgactgcggtttgggatgttccaatgggtttcttgaggatatgatactcaggtggataggtgaatcgggcgtactgaagcataagccatagcacatgctgagttgagttccaggtgaacccacggcaatagcagtacggtgtgtacatggtaggcatctataagaataaaatttagaacacggattagccaaaaacctctaaaattaacacttacaaattaaaggttttccttactgttattattaaggtcgacacacatttttttaacaacctatggttatatagacctctaatcattaattctggtcatattaacggtacagggcttactagaatgggatttctattttaggtctaagaagaattatgcaaggttaaaaattttatctttggttttgatacaaatatggcttactatcccccttaaaataaaataatttttttttgcactaggtttttttttttttaacaaatttcagaaggtaggagctaatctgacatgagtgctaggtgctggaattcatcactttactgtcttaatcaaatttttaggtctagctctaaagatacaaaaattttgacaaaaatcagagagatagatgggttagattaggagctaccctgaaggaatcatgactttatcatttgtagtttaggctacacaaatttgtgaaactgacaacctacagatttcaggacagaactatacagaattatatgaatttttatgccatgatgcaatgactcaaaaattcaaccaaaattcgtggagcctacaggttatgtatgaaaactactgtaaaaagatgcatatttaatcaattatggtttgggctacatgaaaaaaaatgaatgcagctactacaaatttccacaatatgattatgctaactatctagattgtttcactatgatgcacgggtctaaaaattatgccaaaattcatgatgcttactgggttagtctacatgatgcatgtaaaaaattctcaggtttatcacctacggtttagtctagacaaaaataacaagcagactgactcaagattccagaaaaaaaaaagaacaaccggcacaaaatgaaactttaatcaagttttaggttgtataaattttatcaccttttagtcgtattatgttagggtggtccagaggctagatgaattttgggtggtccatctaagcaaacaatctagagggttaagcacagcaaattctattctatacccaactacacattttaggccataccggtgaaattttgaaatatcgggagaggaaagtacaaaatcccaccaaattcatttttggttcagagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggatgctt

SEQ ID NO: 13157 - DNA, 389 bp, Oryza sativa
caacaaaagacgaagggaaccaactggaatgcataaccggttacctttataaacaaatccacctttgataacaaatttgttccaagtacgtccctctttgcaattaaacatcacttcattaaaatcaggatcaagcgcatattgttccttaattgattcaagtctaaaaatccgacaatcaagttgggacaagaaagtatagcgcctagacaaagcatttgcaatcacattatctttccctttcttgtgtttgataacataaggaaaagattcaataaattcaacccatttagcatgtctacgattcaaattattttgagagcgaaaatatttaagcgattcgtgatcggagtgaatacaaaattctttaggccacaaataatgacgcc

SEQ ID NO: 13158 - DNA, 1618 bp, Oryza sativa
gtttctacctgaagcaaccgccgtggacacttttcacaaggagggagaaagatgctctttggatgcttcaccatgccacatgtcaagaggagagcaaaaatgctcctaggatgcttggagcatctccacactcccaaggcacctctccacctataaatacccctcctctcattcattccctcacacacctcaagaagaagatcaagagctctctcaagtattgtttagtagttctacagatagtggagtaggaaatagaattgtcttcatagtcctcgagttttcaggagatttcgggtatggctttaatagctttcctctcttcttttgtgagacttattaaattaatagaatattcttctttatacaagttcggtattttattccattcatattacttgagtgctgactttactttatactcgtgtaacaagctttccagataggtgtattgatgtgggtttagtgtccgattattcggttgctctaggtcggttgcaaggatgtagagtagtattttactaatgtaagcgcggtgcttaaattattaggtaccactaattggggttatatactgcggatgagaggtgggccgctgatggttacagctaagtacgggtattcctccgcgccagtatataatcctaagttaattacttggggagggtactcctccgtatttagccctggttgtatggtcatgacgggctagggtggcttctcgaaacaccaagaggacactgggtacggggtattggttgcatgactgtataatagcaagtatagactaaagatgtatgtatactagaagtacaggaatgatacttttcttattctttcaccacttagcttagactatattttagagtgagtatttcttagttctttcttctgtgtgtcaccctaccctttgaactgagttaacccctgcatagactttgatgtatataagtaacatataaactattaccatagtactctcttatcatatcttcccttgggataaaataaatacgataccttggaatactcccgggtgaaatgctacaatggtatatccgtgcgcttgcggatcacatctgtaaccataatataccatgagtatttctagtgctattgctggaaattatatttccagtagtgccactaagaaataccaaacaagcatttctggcgccgttgccggggaagataaatgattaagagttcactacttgctaataattttatatttacctctatataagtcactgtcctttgtaggcaaaccttgtttgttttctcttttatgtaaaacagggtagtacaggactggttatgatctgccaaccaaattcatatctagagtcactggtgaagtgaagccgacctcgtgtcgttcatcctcaaggttactctatcggcaaccagaccagtcaatttcgcgccacaagaattgcatgatacggctgagaagaccctttgcaagtttgctgctccctctgttggataacatgctacatggaacccacgtcagatgggagatggtgctttgatctgaaaatctgcttagtcaagatggcgcaggcttgcacattctgtggcaagcctaaggaggatgccagtggttatttacagc

SEQ ID NO: 13159 - DNA, 1738 bp, Oryza sativa
caaatacaggttggagcaaggaacgactccaaacccgtcaaacgcggtatgcacaccgtcaacgagacggaaatgctcgccgcccaattggatctccttatgaagagaatggacaacaatgagaaggacgccaagaagggtaccgttaaggccttcgacttttcaaatggcatgtgaggtctgtggcaatgacgatcactctgggacggatcgtccgaaaacctgtaaggacgtcatgctcatgaacaacaacaacggatatcgtccacaaggagaccaagtatggagcattgctccatggtctagttcaagaacggaccgaacccacaaggaggtcagagtgaaaccccgaaggacggatagtctcaacactttcatgatgaacttcctgtagcgggaagaaacgaggagccgtcaataccttaagccggcatccaagaagccaggaatataggccggtcaacctgcgttcccagttatgaagaggccgttgccgcacctaagcaaagaagtgtggcagattaaggaaaaaacacctgctcctttacctccggaattgggtgccttatcgagctaaatgcatcggaggtactgtcgtgctcgtcagacttgaaatgatgtcgcccttgccaacaggtaaattggtagttatttcatatttattttccattgcatcaaagcatgtttgaatttttcaaacgcagcaaaataaaataaaatttttggcaaaattttgcatggccaccaccacactagtcgttggaacccaatggctaaatgtggggccggttgggtccaccaggggttcggccgaacccctgcatggcactggctggctgcaaatttctttagggtagcggctagtggggcccacatgccattactagccattatccatgcactatataagcagctcggctgggagagggaagtcacaccactctaactcattctcactccctctcaaaaccttcctctcaaaattcattcaaagttttgcaagcttgcctcaaattcacacaatttgctgcatttagtttagacactttacatatacgagtttgctttagttcggtgcaatgttaatcggtgggtatttgtttaacccccgtccgagtagtcttgtattcttgctctttgttgtagctatgaagaaacgacttccgggcatattcaagagacaatcaagctcacggacaagccgacacgataagccgagtacaccttcttctgcggatgcatccatggagaaggcgtacgttccaccgaggctgtacgacaactccgatctcgaccttgtgggcgaccgggaaatgcaagcctatcatatgctgaaagaccgaacgtgtgctcagacctaagcatacaactcgacctttttgaaaggataagtatggatgctgagtttcatactgtttgacgtgctgttggatggaataaatttgcatgtgtagatgagccgggttcctgtttgcttaacatgcagtttttatgtaccttgctagaggtaggtgatggggtactttctggttattccgcaaggaatatcacctttctcggaaagaccttagcttgcatctaggctttgacaaaacatgcaaagttaatttcaggaacgcatttcttggtttttaacaagcgtatgttttggcaaagtatttcgggtctcatcctgtaaaaagcctagaactagtgacatccataatcctaccctggggctattgcataggttgcttgg

SEQ ID NO: 13160 - DNA, 1837 bp, Oryza sativa
ttttatactatagacgtgctctctttgagaaatttgaacatataaaacaaggtgacaaaactgttagggagtactttcatgattttaaaatttgtatcacttatagtggtttacaagaatctaatgagaacacaatgactagatttttcagagggcttaattccaatattcagttgggcttgttaatgtgacatataatcatataggccaattgttcatgcttgcttgcaatattgagcgcaaaattttggagaacccaatggagcaacaagctatgcttgtgcctcctatcactgatgttttgcaggaagttcagaaaagtctccaaaatgagaagaacgatatgtttgagatgtcacttccatcactcgcgaatgaggagaaggctgatgaagctacattatttgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcaaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaataggttgatctgcaccggcaagatcagcacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtg

SEQ ID NO: 13161 - DNA, 1477 bp, Oryza sativa
tcgtgtgcgaatatgggcattaatggtcaaaagttcccgccgggaatcgggaagtgagtttttgccacgaacgcacccaatacactccaaaatgtccaaaaatggcgtttttgaactttttgattccggtcaaaaacatcgcaccctcgtgtgccaatgttggcattaattgacaaaagttcgccgcgcaaatcacgaagtgagtttttgccacgaacgcacccaatacactccaatatgtccaaaaatcatgttttggcgttttttgaacattttgattctggtcaaaaacatcgcacccccgtgtgccaatattggcattaattgacaaaagttcgccgcgcgaatcacgaagtgagtttttgccacgaacgcacccaatacactccaatatgtccaaaaatcatgttttggcgttttttgaactttttgattccggtcaaaaacatcgcaccctcgtgtgccaatattggcattaattgacaaaagttcgccgcgcgaatcacgaagtgagtttttgccacgaacgcacccaatacactccaatatgtccaaaaatcatgttttggtgctttttgaacattttcattccggtcaaaaacatcgcacccgtgtgggccaaaatatgccaatattgacattatttgacaaaagttagccacgcgaatcacgaaatgtgtttttgccacgaaccacccgatacactccaatatgtccaaaaatcatgttttggctttttttgaactttttgattccagtaaaaaacatcgcaccctcgtgtgccaatattggcattaattgacaaaagttcaccgtgcgaatcacgaagtgagtttttgccacgaacgcacgcaatacactccaatatgtccaaaaaacatgttttggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccttatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttttgtgatccagaagatccacatcaaagtgccgttgttggatgctatgca

SEQ ID NO: 13162 - DNA, 548 bp, Oryza sativa
cttatatttaacctttgagagagtatttaccaagaacccatatagcagagatataaaacagagcaactattcatcatttcaataaagagaactagcttgtcttacctagcatgactcaaacctatcctatctttttggtattttctatttttcaaatttttatgttgttttcaagttttataagatgcaattagaaagcaaatatgcaattagaaagagaaatatgcaatgtgatacaagttaccttagtagggggagcgatgtctccccccaagtttggctttcgctcagggtccttgataaggattgaatccctgaaaacggaagtatgcttgaaggtcatcgtgctgttgctgcatcatgttgttgatgttggcgaactgagcatcagcagattgttgccattcttgcgtctgagctatgtgttccgtgaggttgtactggatctcccccgtctgcatatcaagggtgtccattctcctagtgatttcacccaagtcccaacgagaggaactcgagccccattcacttggagatggaggcacacc

SEQ ID NO: 13163 - DNA, 1048 bp, Oryza sativa
cttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagtaagagaagctttggagaagaagtcttaggtgaagtcctggcttataccccagttgagcacctgtgaagatggagacgtaggcccgctagtccgctgctgtttatttttgtttgtcaggcctgaagtgcctttttaataatgtaaatattatcgatataataaagatgtgtcttttatatcatgtttgtgtggtgtaccccggcttttcctgggacggggattaatacactagcgttctggaaaggtattttccgggcgcgacaatatgattgtgatgcatgaatgtaatttatttccaaattatatgtacataatcaaacccactaatttcgatgtaattgctttatttccgtccatactaattaatactttctatgtcttgggtgtatatatatacctgcagcgatggcattctattttttacacactccagtttcatatctctatgccgttacaccgctggacgtcgaccgtatactcgagtcgctaccggcctatcgtataccgagccgttaccgcaaactgagttaagtctactggtcgtgccacagctgtacactagccataaatcgttcgttcgcacgaagtatagtccaaaggctagttcgttcggtcgtcccgagttgctcattattaatagagtcattttaagccaccgattttgttcgccggttcggttgaacgtttgagtggtctcgtatcacggtgggttga

SEQ ID NO: 13164 - DNA, 790 bp, Oryza sativa
atagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcttcagccctcatgctcggtagttagcctttgaatgctttcacttaagctatttatagccccaagcaccgagttgaaatagtcctgaagaggcatgccaaagtatgcataaggaggagtgaagtactcattgataccttgaggaggaggaggtgctgagcttgagattgccccaaggtggaaagaaggtgcctcatcctaggagtatggggagtgccaagctgaagaccaggcttatattgcttatgcttctttagattgtttccaacactcccaagctgagcttgaatctacctcataatgtagggcgcatggtaaattcattgactaaacgtgcccttggatattgcaatctcttgcattatgaagttccccacatcaaactgacgaccctgcatgatggcatttatcacatgccaagccacccccttaatatcatcattattcccacatcgagggagaatggtggctctcacaattctgttcaccacactaagaatagtcatcaaccctgcaacttttccatgggtggtgtcgccttccatcttcatagacctgtgaaagataatcaatggagagcgggttgtgagtatgctccttatgcagatcatcacca

SEQ ID NO: 13165 - DNA, 555 bp, Oryza sativa
caatgtacatgtatatactttgcacgttaattcaaggttgataacgcaacacaccttcggttaataaaggaccgatcacctttaagccagtaatttagcaagttcatctactcttaaggtaccctgtggaacaacatctgatagaaattctcgtgcgtgatcatttctctgcattcttgatcctcccatgacaatttctttctttttgacatgatcagatactttatgttcttcaagatgcttatttatccttacattcttggctggctcagtcttctgggtaccatgggacttccttggtgtatgccggagtaccaggtatcgtggagccgtctttgtaaaagcaacagacttttgatacacataattggcatcagcaaactcattttcattcagcacgagtgccatgccactgtcaatggcttgtttgaaaaggagtaaaattccttccatgtaggaagggactatggaatcactgttaacaccatcgctgccgtttaaatgtttgcagtttctcctcatagtttccaattcatgaatctcatcactgctgcc

SEQ ID NO: 13166 - DNA, 729 bp, Oryza sativa
gaccgcacatgtcaaacctaagggaccacggcagaccgggtacacagagacggtccacgggtcgacggaagcggaccccgtgtgtcaaccgagacgggtggccgacaaacggactccactagacaccatgcgggctgcacacgtggaaaccacgcggctaccgagcgggcacacaaacacggtcaccacacgcacacacgaacgactaccgacaccggtacacgggtaccggggtagacagccgcacaacgggcacggggcgacaccgaaaggacgaggacggaagcagtgaaggagagatccttaccaccacacgacgaggcgtgggtacgacgacgaagaacgggcgcggcggagacgactcagggacgacggaggcgaacggcgagggaacgacttcggcggcgatccttggacgaaggcgagacacggccgacacaaggcttgacgacgcggagccaaggacgaagacgatgacggggctgcagcagcacactagacgaaacgcgggcgacgaacgcgatcggcttgacggagggacgaatgccacgacgatgaggacgacgaccgggaccggcgatgaggcgacgagggcagccgacagtagctgcacggagacgaagacggcgtggaacacgccgctgcgatgccgacgatggtggtgcagcggggtgatgagccggcgaagaggagcggccgaccaagggacgtcggcgacgaggaggatgg

SEQ ID NO: 13167 - DNA, 740 bp, Oryza sativa
tgaacgcacccaatacactccaatatgtccagaaatcatgttttagcgctttttgaacattttcattccggtcaaaaacatcgcccctatttgggccaaaatgtgccaatattggcattaattgataaaagttcgccgtgtaaatcatgaattcagtttttgccattaacgcacccaatacactccaatatgtccaaaaatcatgttttggcgttttttgagcttttttattccggtgaaaaacatcgcacccccgtgtgccaatgttgccattaattgacaaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaa

SEQ ID NO: 13168 - DNA, 1215 bp, Oryza sativa
  unsure (1)..(1215): unsure at all n locations
cttttcccccttccctttccctctctcggccgccgctccgccgtgcctatggccgccgccagcgaccataggggcgcgggcgctgcctcctgccgaccgcgccgagtggccgccttcgggcacgccgagtggccgccgcgtggggcccggccgtcagccgcccacgtccttaggtgcggctgaagcgtggggcccacggcgccgaccggtgctagcccgggtgcgcccggtccaccgtggaccgtgaggctgccgcgtgggccccaccccccgtggacccggtccgcgcgccctctcccctcggctgacgcaataaaccccttcttaaattaaaatttaaatgaagaaatccgcaaatattcacttaaagagcatataaacttcaaatggccataacttggccatttgaactcggaattgaaccgttcaagtctctaatttttccttaagaagtcaagaacccatttttatgttttgttcctgctttttccattccgttggtcgtgtagacgctgcagcttcagaagatccgcttttcgtggaggttgaagccgacgtttgggaaagcgagcaaggcaagtcacatcatccttgagcatattgaatcccagtttataaaattattttgatttaaattattgtattatcgctttatttaaattcccgcgttatcactgttttatttagccatgcctatttacctttgttacgaccttattattattgctattgttattattaccttgttcaccctaggataaacaaaaccccaactagtgggtactctattcatggttccactagtatgaatttaggtagatgcttcgctgattaattatgcaacattaggtggttttataactttagactttgggaatactcttatcacctggacactatggaatggttggattattgtggaattggattcacacctccccctctattcaaaaccctcaaaatggttntaggctgggctcggggtgcatggttttgacagtagcacctcggccatatatggaccggtcttcgggcctctgttgcaaagcactaccgtacttccacatgtctagtaggtaaggcttagtttgtggcttagtctggttataaacaaaagtacacggatggagatggacgaagtcaggggtcgatggacatctctagggcaaatgaaggctacacgagctgcggcccggtagtcgagatgtcatggca

SEQ ID NO: 13169 - DNA, 328 bp, Oryza sativa
ctaagttatattttacaaacctagggtgatagtggcttaagtatattttttaaaaagtaaatcacactcctaagtaaagtttaccattcctagagtgatatgatctcaagtatgtcttctaggaatgtaaattgcacaactgtaaatgcgacaaataaatgagacaaggagacaaagattttttaccgaggttcggaaattcgccgatttcctactccctgttgaggcgagcccaactccaccgctcaactagtattaggtttactaactttttgcagagaatgattatgaagtagaggagaatcgacatcaactcggacgataaatc

SEQ ID NO: 13170 - DNA, 491 bp, Oryza sativa
gtgacttccctttcccatccgagcttaatatatagggcatggataacggctagtaatggcatatgggccccactagccgctaccctacagatatttgcagctagccagtgccatgcggggttccgccgaacccctggtggacccaaccggccccacatttagccattgggttccaacgactagtgtggtggtggccgtgcaaaattttgccaacttgttgttgttgcatcatagtgttgaagtttgcgagctgtgcaccaacagagtgctaccattcacgtgactgtaccacatgatcctccaaggtgtgttgctcgttcactgcctgcagttcaagtgtatccgtcccccggatgagttctcctagacccccctcgagaggagactgagcaatgcatccaagaagatggaagttgaccacttggactgaaagagcgtgagtatccccagtgcaactcctatggctcatgccaccggctgtcgctggcact

SEQ ID NO: 13171 - DNA, 710 bp, Oryza sativa
  unsure (1)..(710): unsure at all n locations
ctatcctttctcaagtgcaaccaaattaaatcacccggttcaagcttaacctcttgcctacctttactaccaacaattctatacttttcagtcatcttttcaatgttgagcttggttgactcatgcattttcagaataaattcagcgcatgccttacatcattatgaaccctctcactagtaggtaaaggcaaaatatcaattggagcacgagtgttgaaaccatacactacctgaaaaggacttaccttggtagtagaatgtgttgcccgattgtatgcaaactccacatgaggcaaacattcttcccacatcttcaaatttttcttcaaaatagccctcaacatggtacccaaagtgcggttgactacttccgtttgtccatctgtttgtgggtgacatgttgtaaaaaacaatagcattgtacccaacttgttccatagcgtgcgcccaaaataacttaagaatnttgcatcacgatctgaaacaatagtagaaggcatacctgtaacgtcccgcctcccccaggccgggcccgcttacatctgatagctntcataggtcatagactgccatcacagaccaacacatatcttttctgcacacttggtcctcactcgtgtgcacccgggaagaatttcccagtcggtcacccatccaaattgctccaggccaagcacacacatatcttttctgcacactttgtcctca

SEQ ID NO: 13172 - DNA, 20002 bp, Oryza sativa
  unsure (1)..(20002): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttaattaagttaattgtctcaagaaaataagttatggcctcggtcagaattatggtttcggccagcattaagatagatgaggattggggaagaatgagctagggttagggttctcaccctccccgtcggcgactttttcggcgtggagcgaatcagagccgtccattagatcggacggttcagaccgaccccgcgttaggccatcttcgccgatgggccgcctccgccgatgggccgcacggcctctgggccgcaaaaaaagatgctgagccgcgccgctcaagcttgcgagctcacgcgtagacgggccggcccgattttgggccggcattggaagaagttggccgaaatcaatttaattcactaagcacctatttaattaatttcaaaattacacaattcaatttggcattattttagccatttaaaattgctggaaaattatgatcaattatttggtcgttcagaaagaaattaatgatatgatattatatttgaccaacgttaatatggtttcatgtcaatattattaagattattatttctttaagccatttaatttaattctagttgaatggaaatttaactagaaagtatttatgatttcatgtcaacatcattatgatggtcatttccttaataacttaattatttatactcgaatggaaccaacgagaaatttgactagaaagtattaagatttgaagttatatttaacccacattattataattgcatgacaattataattttttattccttagttattttctaccaaatggtgatataattaaggaattaattttaagattattcataattatttatgaccaatggtgctttgactatgaaattctaagtttattttgcatatgattgattaagccatggtaaactaattatatgcaatcaccaattcttattatttaagatcacttgcaatactgagtaaattatttcaagataaatggaaccaacgggaagtttatctagaaagaaagatgatttcattaagattgttatttccttaattattttctgcccaatggtgatgtaattaagggaagaaatctaagtattgtcaatcactattttaaatattctctgtaattttggccttaatggtgatatgacttagaattttatttatgccattagtgcattaattccttttatcacttctaccttacggtgatgttatcgaggatctaatctgtcagtaagcttaattcctttaccatttctgcccaacggtgatatggctaagaattttaattttaattctatggcatcactaagggcatcattcctatatcatttctaccttacgtgatttgatttaggattttaaattattaacttcatcatttttgcccaatggtgatgtgatttaagacattaatgtttattccctaaatcatttctgcccaacggtgacttgattttgaattacaagtaatttcatttattgattccttcattttgtctctgcccaatggtgatacaaagcgaaataaagattaagttattattgtgcaagttaatgtactattgcacgtaatttgcccaagcaaccacaataatagtgccacttaatatttcagcaataaataatgttgtttatcagttaaagtctatggaattattattattattcctcattgacttaactgagcctaaggcctatttgagtatgacttagcattaaaaaaggattccttgtgtctcccgcagctaatgtcactaatttttcctaaactctagaggcatctttagcctgggagaaggccaatataatgttatgtttcgcatgtcactcataaatattaagattatcatccctgttagtgttaggggagaattttgagcatgacattgcgaaactgtatctagcaaatgttgagatgaactttagaagtttgtcaagactaatgcttagtacaaatttagtgcctatgcacatttgccgccataattggcgtgcaaacttagtgggatggacatcgcacatttcatatgcgccacttgtccatttcatatgattcttctcccattagactacggtcattttcggagttgtaatactaagacaaaatggaccataattgacttggttcatcactcttcaaatcaataagaaatattgaagactaagagacaaactaagtaagatcttgttaatcttgtcatttgatggcaaagatgaagcttcactaagggggagtgttgcaacttccaaatttaatgataataaagctcatattcctcgcaaggggaaatcaaattgcctctatgtcctatgtatgctactcttgaaattttcttgtgtaagttctttgcaaaaaatagggacatgcttaatgtcctgaattaagaaagtagttaataagaagattaatggcattattttgggttgaactattatgagacgttgtcaaaattatggccttaatattcggccacatttcaaggggagaatggacgtctcattgagatcgagacacttcacccttagaaatttctgacatctattattacttagatgataaatcaccaagtaaaattaagtgattcaagtttatgaaaaataagatattatgcttccattaaataaataatacaatctgtgggagctcatcaagagctctaataagagaagattattctaccttatttatgactcatagctccattatgtggacgctagaattttgtatctcttaatttgtgacttgcacaattaaatatatataacataactttagggttttgttatggaaagacaagtcacgcatagggtgcagacctaagaaatccatttgtggacttaatcaaacattgatgatgttttaaattctgttccgtcattagtgaactaagcttaaataagaatgaggagaataattattctataatgatgaaagcaagacgtcattgaaattgtgtcattatctcttatgtcacatacctaggggagtttggaacgtctcatgagatatagatattctttcccttagattttaatggcgttgtttagctttaagtgaaaatttcacgaagttaagatattagccaacaaatgattttttatggctatgtttacccataagcgacctccgatttcctttaagaaatttaagacactaatgctaaaatcaaatgaagttatgagatcggattatggtggtaaacactaaataaagcttgttcaccttataagacattaaaaataagcgttcatccaaatagttttcgaatcatgtaagaataaattgagatggatgaacaaaataagacattaaagtgttcatataaatggttttcgaaccatataagaataattgagattgatgaacaaaataaagaatttagtagaagtttctgaatgagtcaaaatattgggccatttaagtgggttaataaaattaagcctgactctgatggaaatttcaaacaattcaagtgaggtggacaggtgcatgaaaattaaaggtgggaatttcattcaccggtactccattctaatgacattttattgtcaagcaatgcatattgctcttagaaactaaggaatttttttccatgaattattttggtccgaaggagtactgggtttatatcagtaagtcatacactgacataaagaaataatttgagagaattcaattaaagttagtcaagctgacattaagttacaaagataatcatttatgattcagctgacagaagcttgagattagctcaaatctggatgcatacagatttggcatacttttttttactgggaatcttggcagtatttaattaaatccagactaaaccactggtattaataatgttttccattatttgcaagacaatcttaagtaacatgctcttttttcctaaagtccattgatctcagaagtttagagatatttggacacttattttatgagatgtgtggatatttatgaagattattcagattaagctatgttcacacataggggagcaataaccatgtaaaagctccaaaaataatctcttactgcatagtcgacgatgaagttagattttaaagcgtgttatgattaatcatatttcccaaaactaagagtagtgaatagcgctcataaaccactcaaaagatgttaaccacccaaaatatactgttataagttgtgcactaattaaacacagttttctattctagtagcaacatgttgtgtgttttctgcctaacacattgatatggttgtgaaagacatgtcccatgatcgaattattaagctaagcatttgctaatggatccatattctaaaggctcataaattaagattaattaagattatgttttggccagtacatatgtaaattagagccttactaagatcctggatgagggggacttaatttttcaatcaacactcactaagttaagcttgagtttatttgagtattatagtgagctataggtcttgttgtctcagtgacgcataatgttgttgaagacacattgccttgggagctattttatttaatagactcataagtaagtctcgaaatcaaggggagaatgttagctgattttgtcgacttgagtcgataaggattaggagaagaactaaaccaccggtttccttatcctaacaagaaacaaactaagagataaattcttttttttgtgtgatcggcacagaaaacagaatcctaaactaattgagataacccccgagccccaccagtgtcgcttatgtaaagaaagagaaggagggaggctaggtgacaatatgatttctctctaacctcaaaccctaaaattaatggcctgatcgtttagacactggaaggggttcatcaggttttctctgtgcttcctttccatcaacagagaagaagaaaaaacagaagaattggcaaagcttatggcttcagttcatccggtcagtaatcatctcaattccacacttagaatttgtgaccatgtgttaagctaagcaaattagatcctgagaattaaatctaacaagatgatgacacctcccacctcctggttgagttagcactcccatctaatagggtgtaggattggctgctccctggttgctaatctagcttacgcatatttcaataaagctggtggtagtgaagttagaggtgcaacgttgacgtgggaggaagggggaggggggcaacatgtggcaacaataacactaagtccaatggggttgtgttttggtattggttaggatgttgaccttgttcacttgtgcttcttagggatgctagatttgtccaatccccgggaggggggggggtgtagatggtctaatgtcaatggcattgtgtagggagtatgctttgctttgagcttattaattagtcatgtggctgttgctcagagtatttaggttgtttttttccctgttgttgtttcggttttcactaattaaattagcattgtttagttcggcctcattctatctttaaaactagtatatgcccgtgctaacgctacgatctttaatattttttaataaatgactaaaattttgtgttagtaaaaataatcagtttaatgggagctttaattcaaattatgccatatatttaaggcaaattacaaagtaggtacttcacattgttcgtctgaaataccaccaaaatacacactatttctctccaatagcaatttactttggtaggtgttccctgcacctgtaagtcatataataacttgtcaccatgagctgaatcagaggaacgtaaaatatcccttatcctaaagttggcatcaatatagaatataatgctatacctcactttatacatggcaatgtctccaatcatggccagctgcaataaaattagatattaaaccctagccaatgcatattagccattcttcctaaaaaatatatggcaaggtgtcctaccatggcctcttcatttctctacaacagacatttttctaggtataaaataaagcaccttctaacattattggtaccattctgaaaacaatggaactaatgaaaaatcatgctccaattgagaaattaaggcagaaacttgatctttaatcatctcatcacagcacacggaggaaagtacttcacgaaaaaaaaagagaaactttcgcctccgcttctgcctcagacccttaggctgtgttcctagcccaggtttcccaactcatcttcctcactttccacacgtacgcttttcaaacggctaaacggtgtgtttttttgtaaaaagtttctatatgaaagttgtttaaaaaatcatattaatacatttttgaaaaaaaaattagctaatacttaattaatcacttgttaatggaccgttttatttttcgtgcacactgttccagttgggaacaggctccagcgaacagacgaacatagccttagtcttgcggcgatcaatctcgtggacccgatgccatgccccattgttggcggttgttaaatgacaatcccataccgccaacatcttcataaagtctagataataaaacatccaacatagtaataggtgcttaatcttacatattccacaagtgttggtgtatatttgtatgcagatgataaaccctgaagttgggaggaaaatcagactaaagtgaggagaattatgtatccatacaagtagggttgtgaacttcatcgaaacatcagtaaatcaaccgaaaactccgagaaatgaatagaggaaggtcccgagagtccaccgaccgaaggccaggccaggagggcccagcccaggtttgaccgaaccctctggttcggccgaaccccccgatcaccgttcatcctggggtttggcgtggatgctccagatgttctcccaatgacggttgcggtgcagttcggacatttccccttctcacaaccgtcataactgccctataaaaggacctcacttcattcactctcacacacacttccaagcttgagctgaattataagaggctctattgtactatattgtacactagaataggaagagagtagagtagaagaagtcggaagaattccggagttgtcggtaatcttctcctatttcttttattctatttattactctgaattcaatataatattcttcttgaataatttagatttatcttgtgagaattatctcttggttagttcctaaatagcatacgggattattgttcactataatcaactaaaatatagtgattgctttgatgagttataaacactaaagtagatattaattgcttagacgtggtatttaagtaattgttatccagtaattgctgcgtatcccacggtacgtttgaggtaggtgtagaggtggtgacagcccttgagatcacttaagtcctccctttccgggtacgtactagagcgacatctgggaacagcgggttgccagtgcctgaagtattgcattaggattaaagttaagctttccctagatactgtctctcactagtaaatcctctctatcctggcctatcatttactttgtgtccttggatgaaccggaggaagatctgaccatacacgttcatttggattcgatacccttggaatactccgtaggggaagtgctacctcggtatatccgtgcggttgcagattttatctgtaaccgtattaaataccaacaagcattcctagtgccgttgccggggaacggttgctgatcatttccgaacccagttcatccttgtatcctttttacttttttagtctaccttcacccctgctatcctagagaagtattcctgtcaaactcttctcgaccatggagcaacctcgttttgagatgtctgctcctcggggcgaattctatgagccacctccttcatcgaagcccatttatacaactggctatgaaattcgtcctgaactaattagtacggttagggaaaatcctttttctggctttgatctagaaaatccctaccatcatctgcgagactttgaacaagtttgatcatgccttaagattcgtggcatgagacaagaaactgtgcggtggaaattgttcccgttctctcttcaagagagagcaaagcaatggtacacctctaccgttggatgtgtaaacggtagctaggaaaagttgtgagacagattctgtcttgccttctttccagttactcgtattactgcctttcgagtagaaattcttagtttcaagcagatcaaaaatgaatcaatcggtgcaacttggtccagattcactaatttagtacaatccggaccaaccctgtccttacccgagtatgtgcttctgcaatatttccatacgggtttggataaggaatctgcattctatctggacataaccgttggagggtcgttcatgcacaaaacgccgtcagaaggaagaacaattttggatcgcatcctagaaaatacttccttcatgacgcagcccaatgaaccccagccgaaggcatccctgtccaagatagtggaacctctaacgatcgagccactcactgaaccatccacttctgctagctcgattgatgaaaaggttcctgagcagccgtttgtcgagaatgaagaaattcaggttccggattgtgccacaattatgttcagggacggttttgacaaagactacggcaataccctgaactattttagcaaaaggaaaccacccgttcctttgtcacctcccaatcctatggaactcgggttcctacgagaaactgtccgggagttaacatccataatgagcgatgaatggctaagggaggtagagctttcatccgaagtaattcggataaatgcgctccccgaatcattccttgccatctggaagggaacgatgtcggtattctctatagtccaactgtcggggccaacctcgtctctgagtcttttgcattcgcttatttaagcgataaggcagtgaccccgataaacaaattcttcaaacatccgaacggaaatatcatttaaggatttgagattgtacaagatgtacttgtctactttgaagaaagggaggcaatcttggatttccacgtctttgaaatccaagattttgacatcctaatcaggctacccattgagcaacttcttatcaacacacctcatttaggtagcctcaaaataacactgggagagaatgaattctcaattccattttcacgggcaaggatcaccttgaccgaccctctcccagaaattgagttagtggaagaggttaccgcagttcctcctcatgagtctcccgaggcccttctggaagatgaggtccccgatttcatcaaggaagaagcagatcccggtgagactctcgacctgccaatcatggaaccgccacctcaacctccgcttgagcttaaacctctacctctaggcctacgatatgctttcctacacaatgacagagaggcccctgttataataagtgacaagctctctaaagacgagactcaacgtcttcctaccgtattggaaaagcatcgttctgtacttggctactcacttcaagatcttagggggattaatctcgcgctttgcacccatcgtattcctattgaccccaagagtactccctccagggaacctcaacgacggctcaataatgaaatcaagaggttgtaaagaaagaggtcttgaaactcctgcatgccgggatcaatttatcccgtaccatatagtgagtgggttagcctagtccagttgtgccgaagaagggaggaatgacagtcgttgcaaatgctcaaaacgaacttattccgcaacgaaccgtaaccggatggaggatgtgcatcgattacagaaaacttaacaaggctacaaaaaaggatcatttcccgctacccttcattgatgaaatgttggaacagctggcaaatcattcgtttttctgtttccttgatgggtattacgggtatcattaaattcctatccatctggaggaccagagtaagactacgttcacatgtccgtatggcacctatgcataccgtaggatgtccttcggactgtgtaatgctcctacatctttccaaagatgtatgatgtctattttctcagacatgatcgaagacatcatggaagtcttcatggatgacttctcggtctatggaaagactttcggtcattgtctgcagaatttagacaaattcttacaacgatgccaagaaaagtacctggtgcttaattgggaaaagtgacacttcatggtctgtaaagggatagttcttgggcatcgagtgtccgaacgaggaatcgaagttgatcgtactaaaatcgatgttatagatcagcttcctcctcctgtgaacatcaaaggaatctgcagtttcttaggacatgccggcttttatagaaggttcatcaaggacttttctacaatagccaggccgctgactaatttgctagccaaggatgcgccctttgagttcaatgacgcgtgcctaagatcttttaaaattctcaaaaaggcactagtctctgctccaatcattcaacctcctgattggactctgcccttcgaaattatgtgtgatgcaagtgactttgctgttggtgcggtcttaggccaaaccaaggataaaaagcatcatgcaatctgttacgctagcaaaactctaaccggagctcagttgaattatgcaactactgaaaaagagctgctcacggttgtttttgctatcgataagtttagatcttacttagtgggagccaaggtgataatttatactgatcatgccgctttgaaatacctgctcactaagaaagatgctaaaccacgcctcttaagatggattttgttgctccaagaatttgacatagaaattaaagataaaaagggagtagaaaattatgtagcagatcatttgtccagattgcacatcactaacatgcaggaacaaccgataaatgatctcttgagagatgacatgctgatgacggttcgcgactccaacacgtgatatgctaacatagtaaactacatggtatccaagtgcataccaccaggggaaaatcaacgaaaactgaagtatgaaagtcaccgtcatatatgggatgagccctacctatatcgggtatgctccgatggcttactacgaagatgtgtgccaactgatgaaggacttaagattatagaacgatgccacgcctcaccctatggaggccattacggtgcattccgcacccaggccaaaatctggcaaagtggtttcttctggccgacaatgtacgaagactcaaaagaattcatcagaagatgcacaagctgccagaggcaaggaggaatcactgctcgcgatgcaatgccccttacatacaatttgcaagttgagatattcgatgtttggggtatagacttcatgggacctttccctaagtctcgtaactgcgagtacattctggtggcagtcgactatgtctccaagtgggttgaggctatgccgtgcagcgccgcggatgcgaggcacgccaagaagatgttcacagaaaccatcttcccaagatttggtacccgcagaatggtcataagcgaccgaggttttcacttcattgacaaaaccttcagagacctcctacgagaaatggaagccaaacacaacgtggccactccttaccatccacagaccagtggtcaagcagaaacatcgaacaaacaaatcaagaatattctgcaaaagacggtcaacaaaatgggaacagaatggaaggatagattgcaggacgcactgtgggcataccggacagcatacaagacacccattggaatgtccccatatcagatagtctatgggaagtcatgtcgactacccgtagaacttgagcatagagcatattgggccatcaggaattcgaacatggattttgagggagcaggagaatggagaaaaatgcagattgcagaacttgaggaaatggaaaaaatggcttaccccaacgcaaagaatataaagaaaggactaagcgctggcatgacatgtcataggctctccagaccttgcattatatttgagagatgaagggaataattcaagtcatcaaacaagccttatgaaacattccacgcctcgagagaggaatattggagacattgctgggcccttagcctgccagtcaacttcagcctgagatgtgcccgtcaaaccactcgaaggcggcgatcagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaaacacaagcacaccgactaggggtataccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaggagttgatgcttcaattaacaaagacaagttttaagtttcattattagcttcttcataattccgtcataaacaatctcttattgccatacttaataataagtcataatgtatcaccacatacacaactcaacacatttatcaatttcaaaccaatgtcacatgattacatttttaaaacatagtctatactcatgacacatcaccaaagcactcatgaccgtgagcacggctaatcaattagtttaaagaactctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtgtaaaatcacattttacacattttagttcgcaaatactcatcatattcattttattccagcaaaggttcaagtatcaaaccacattttaattatagatggaatgagcatttgcatatttctaagcatggctaagcaagtagttgcacatagagcatatataaacccatttgagcacaaagagtgtactctaaccatttctaggggttcaaacagcaagaggatcaattattcaaggtggaatatgtagcaaataggtcataactaccttaacccaatttcaaataccgatatagtctaagttcacatgcaactttgtaaacaaatattttcattcctcaaatcatgggattcaatgtgttcaaaggatgggaggagaaaactttccttgatcagagaattgttagcacctaatccacttcttcaccgattacgcaattatctagataaaggacacgatatgcaattaaacaccgaaagagttgaaaatccaaaatgctctaaaatgcatgatttatgcacagtgggttggtactgatctaaaataaatttaggtgaaagaatttttattttatctttatcttattccattagggagttatgaatttttagaagttttatcggtttatagtagtatagtcttaggtagtgttatggaatacttttgtaaagtgatttttactagattagacttcacaggggtgtggagatgtgttttctaagactaacacatttggtttcacaatttttggatttataatgaattctttatgcattttacaagttacaacgtgttttaggcatatagtgttttatatatgtatgactcctgagttataggttcagaacatgctacttcatgtttaagttgaataaaaggaataatttggttaactaaaacatttttatctcacatgtttatggtctttactactatggttcatattttataaagtagagacgctttaatctaaactagcaatatattatattaacctagaaattgttatatgagccaagttcttctaagtttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagttttacaaattaatggctgctctatgttagtaaatccttatatgaatatttagagacttttactacacagcaagtatataatattatttcataacttggaaatacatgtgttagtgatcctacataacttaagtttattcaaattgaagctaaattgggttctacatgaatttctaaagtttagcttatctaaaactagtcattttaaagataatagttttagaggcttttgatgcaaagtaagtcattacttttattttacctaatcagagagtgtctgatgatgaatctgaagtttttgagtttgtttcaaaatgagttgaaatgaattttctttgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaacttgtgcatttttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagtgtgtttctataattgtaaacggatccctgcacttaatctaattcacggaagtcatccctctgctctagacatagcagagctagccatggctgagctcgatctggagctcgccggcggcaaacggtggctcgcttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgcgcatggaagtcgattacgaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggcgttttgaagaggaggttgaggcaatgacaatggcgcagcagctttctctgaggtgaatgagaatggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggcagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaggtgggtccaggtcgtggcaaactaggctagggtgagagggttgggtaagattctgggtaaacttgatttttagattaattttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaagaaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattaactataggtttgtttagtgaaataattcttttagattatgctcatgggagctattatggaatacaagtccaaaactccaaatgcacaaagaactcgagggttaagtttgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgtgacaaaatggtatcagagccgactctcgcggtttcacgggcgcgtgtatcgcagttgcgcaggcatggtgcgcatggctggtgtagacctggagtggttacacagcatggcacatgcgctgtcattggacacatgggcgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagtgtgcttggcctggagcaatttgggatgggtgaccgaccgggaagaatttcccgggtgcacacgagtgaggacaaaatgtgcagaaaagacatgtgttggtctgtgagggcagtctatgacctatgaaagctatcagatgtaagtgggcccggcttgggggaaggcgggacgttacataacaaaaggataaaaatcaagaaattcaagccaggagacaaagtactgatgttcaactccagggttaaactcttcggccacggaaaactgcgcagcaaatgggaaggaccattcgacgtcatcgacacctcttcgcacggggcaatcacactccgcgatgacttcggtaacatatttaaggtaaacggtcaacgcttaaagactttccttgagccaaatgaaactttagatgaagaagtggatgttgttaaattagttgattatgaaccatgatgatctcatctattgcatgcttaaaacccggtaagttgtcatttttgtgcttagtttaggacttattaggcctaggaaaaaaatggagctcaatcggacccaccaaggtgctggttcggccgagccagggaggcgcccgatcagccccatttttgaacttcgctctcccccgctcgttcctagtttgtttagatgcgcatttggaggtagaacgctcggatctcgctagaacacttcttcttcctctttctctccacctttgcatactctcctctccaatccaacccaattcctcgaattcccactcatacccaccaatggctggcaaatccttgattacattcatcggctcttcatccaattccacgtacgacctcaccggagaggcgacaccggcaaatcaattgatcccggtggaagaatacacgatggaaggggtaaacgctgtatgggctcaaccccttgcagctgtgccaggctcccctgcaattttggagccgatcgacgagctccctggttcggccgaacccttctcagccccgttcggcagcgtgatccctctcccctcgccatgtcacaaggacaaaaatctggggggattcacctacgcgacggccgacaacgggagaactcggcttgttgaaggcacgacggcttttccaagatgacgggaaggccgcgccacctctcgccgagcgctatgtgggcaccctgttcaccaaggaaggagatgagatgctccacaagtataccacacccaccgctactccgtctactccgaaggaggagcgattccgcatccaaggagtgagaactcccggcagtgggtatggtaagagtttactacggcctttgatggcatcggaaaaggagggggcagcagaatcccgtagccctccacctatgaaggtgaagcgtcatttgaagccccctccaattgtgagggctcccagccaattccaagaagaggaggtgaaatcgccggagccctcgatccataagctcgccgcacaagtgaagaaactccgcaaggagaacatagagcttaaggatcgcaacgcggagctaggggtagagcttgctgacattagaaataatttcgatacccttagtcgcggtttgtgcgctaaaatcaagcgtgcattcatagagataggaaaggaaaataagtattatgctaactagatgcttcctttcccatgagtaaaatagtagtaggtgcttggtttttatttttccaatcatataagcacttgctatgaataatgtggctcattggtgttaaccccaatgtttgccaaagtttgtttt

SEQ ID NO: 13173 - DNA, 22345 bp, Oryza sativa
cgaaccaagtctggccccaatccctctcaactttcacaggtaagcaggtgagcacgtcttgtatctgtatatctccactatagtatagtactagagctgaaaatttagaaaacaattggttcaagcataagtaagagataaaatttccaattaatgaaattcttcatgtgattgatctagtatattcatattcccagctgaacttgtgcttgtgaacaatcatccatgtttagggaactttatatatctaagtgattgctttttgtgagatgattaagatgaaaggaattcttgcaactattcttatgactcttgggaatttgttttcaaaataaaattgttttaaaagctcacctccaattgactctaccttatacctaccaaggccatgtgcaagtacattaatgatcaaaccttatcatgcatatgactgtttgacattatattaagctttgtcaaatttatgtgacttgtgttagatatctttcatactctcatgatcaaggggtcattatcattaccactttccatttccacatataaaattaagctaagcttctacactagaagttggctttccacaaaaatatccattcaaataaactcctacattgaactatgctttcttctcctagaaaagttcttggcaaaaagaaaatgagaaaaggaaggaaaggcatggctagaaaaaaaaagaaagaaaagaaagaagatggaaataaagcttgctctcaaaatattgagcaaagaaaatatagccatgccccttccataatcatgccaagagaaccaattagagcgaaagtataggaaaaagggagaatcatttctttattccatcattccacaaaatattttactttttcattttccgccataaataaagacccttgttctaggagtatgattgattatcttcttgagtcaatatttttggctttgcactatatatgatgcaggtatgtcacagtttatccctaccaagctccacatatcagccttctaatagggatgaattatggcacattttgccttggtaaggatccaaaaagaaaatatacatccttgagggacaagagaggaagtcaataggaggagaagagctgatttgcgaaaatttataaaaatcccatgagtgtaacagggaagcaaggactggaatcaagatcgttctatttctcaattactcaagatggtaagttagccactgataaagttcacaggtgcaggtatggttgtaaaataatttatatgcttgatacatatcttgaagaaattcattttacactaacctttactcagtgacgagcaaagggctaagtgtgggggggttttgttggcggttgttcaatgccaatcccatactgccaacatctacataaagtctagataataaaacatccaacatagtaataggtgcttaatctcacatattccacaatattccacaagtgttggtgtatatttttatgcaaatgaaaaccctgaagttgggaggaaaatcatactaaagtgaggagaattatgtatccatacaaggaggggttgtgaacttcatcgaaacatcagtaaatcaacccaaaattccgagaaatggatagaggaaggtccatggactccaccgaccgaaggccaagccaggagggcccagcccaggttcggtcgaaccctctggttcggccgaaccccccctgatcaccgttgatcctgggtttggcgtggacgctccagaagttctcccaatgatggttgcggggcagttcggacattttcccttctcacaaccgtcataactgccctataaaaggacctcgcttcattcactctcacacagacttccaagattgagctgaattataagaggctctattgtactatattgtatactagaataggaagagagtagagaagaagtagtcggaagaatttcggagttgtcggtaatcttctcctatttcttttattctatttattactctgaattcaatataatattgtaacgtacccaaattctagaccttaaaaatttcctatcaaaatagttggaagctaacttttccatttttgagagctaaaaatttccatttttaacctaggtgtggtcaatctaacttgaacctaagtaaaatttgggaacaaattaaaactttttcatttataacctaggacataaatgcaaacacgagtaaaagcatgcatacttgcataaaacatgttttgacttgagtccttcatgtgcatttgaatctttgatttgcatttcataataggtctcatgaatcttaactaagatctagataaacaagtaaaccattagggcctagtgctagctagaggaagttaaaatagaaaccatacaccttaaaatatatcaacatggctaatgtcaagcctcacaaaactaatttcaacatccatctaaagacatgtcatgaacatgaaagtgaacaaataaattatatcatatagggtatattctatcttaatcatctctataagcattctcttcatttaatactaaagtaaacttatgcataaataggtaaggagcttatgacatgtgtaaggtaaactgtaattctaacatatcaatatcacctcaggttaatgagagtccaaatataacttttataaacatttacatgcatttaggaaagggaaacacatataagacataagtcttgcgaattatctaaaataattcgtgtaagataaaatcgtgggaaaattcatgtaggctctacttaacatataaaactcactgtaattttggtataatttaataactaaatttcatacctcgaataaatcagtcaaaccagtcaaataatagactaattatagttcttaatcggttaaaaccatacctaactaaaatgtgcatttaactgcatgaaagtgtataggggaaataatttattcaaatactaggtcatttatcatgaataaatataattttatcagaatttatcttctctgtttaggtctcctaaaaattcaaactaatttccaaagggcccattttctcctaattactgtgagtaatctatccaaaattttttaagtgcaaccaaagaaaatggaatctaggtatcttcaactatcatcacaaaaattcacactaatttatcctggccacaaaataaactatcgagttacaaaggaagggtaagtgaattaatcctgaaaatttgtccaaaatcacttacacccaattatctacccatccctcacacccccacctagattacaccgacctggacccacctggcagccttcttggcttacccttcccctgtgcaacttctctagccgaccagaactgagagaaagaccgagccgacagccctcgggcgcgttcgacgcgtggcctcgacgtggcagcgccgaaccgaagcttcacctcacccagctgcgtcgccactcttcacccaccatcccagtgccgatccatccgagggaggaagctccaactttccctctccacctctctttcatcgtcggccgccgaaaaggggcacgccgccgatcgccaacgagtcgtctccatccctatctgattcacgttctattatcttctctccatgccgagaaaatccttttttgactccatcttgtttcgtccactgcagcgacgggaacgcgacctcgtctacggagctctggagcgcgctccaagcgccgccgcagccgacatcgtcgccgttccgaccgctgtagaccgatccaagccgagccgtcacgccaacgccttctccttgaagtcctcctcaaaacccctcaataatcccaggcaacggcgcagcaagtgcggagatcggccaccgtcttcttcacctccggttgccatcgccattgtcgtttccgcctcctccggtgagccattgttggattactcgcgcacaaaccatccctgtgacctcacaaccctcgtgcacgccttcctttagcagctcgtcgtcccgttcgagccgtcgccgttcacccgcagaaggacgccgtcgccgggaggatgcgcgagccgttgctgtcaccaagaccccggaaaacatcaacctaacccgcggtgagtaccctagagcctggaagaccacatgcatgcatccctttgagtacatccagtctatagcacgacatgcaccaccacccgaaaacttcctctgctcggactcgccgctggcgctactccgatgtctgctgtctgagaaatgtataggaatggaatcgcaatatcatgcccttcattttctattttggtcgcaaccccaacggagtcaccgtttgtcgccgacaccggcgagcagagatgccgcccatggctgctctgctgcttatcgaatggaaaaggagacagggacctcgcttggagaatttaaacaactataaggttcattatgtaatgttttcactcaatgacatatgggcctaggactgcgggtttatttactgaaactctaggggtctttttgcatattggcctgggactgacaatgcacacctaggaacaaaatctgaaattataaaagaacagtaactaaaacttgtaaaatccatataaaattaaatatagctcattttaagatgattcaaatttctgtgaactcaccaaattgggaactttgatgttatggaacaaaacttgcactcacagtacaaatttagcctctcaaatttatccaaattaaatcacacataaagcatgcacaaaattataaaatgcatacaaaattcatttcaactcatttcagagcaaacttagtttctacagatccaccaacattttctctaaaaacaaagtaaaataaaacatctacacattctgcatcaaatgcctctaaaactattatctttaaaaataactagttttatataagctgaactttagaagttcatataaaattcatcttagatcctttttgagtaaacccaagttctgtagaatcaccaaaacatatacttccaaattataaaataaaattatatacttactgtatgataaaagcctctaaatacttatgtaagtaataaccaacatagagcaaccttaaattgtaaaatttgtagaaaattcatctttagtctaaatgaagtgaaccaaatatctatagaaccagcaaacagtgggcttcaacatattaaaataaaatatggaaccttctgtacaggttatagctctaaactttaaatttataggataggtactaatcacatagtattgattgagcaatatgtatatatataaatgtatatagaaatacactctagctataatgaaacccaaataaaacttgttagaccagtgaatgcatagttccatccccttccaccaaaacttatcaaacttaactcatataacaatttctaggttggtgtgttaagtaactaacatagaacatccctaattataaaatgtgtagtaaaataatataaactctaaaattatgaactaagattagattagttaactaaaatactcattttatacatcactagctagatgaggcaagttctggacctaaacctctaaagccatgaacctatataacactatacacccgtaacacgttataacttgtaaaatgcataaagaattcatattaactccaaaaattgtgaaaccaaatgtgttagtcttagaaaacacatatgttcactcagcaaacataaacttaataaaaatcaccttacaacagcatttcacaatagtacctaaataaatcctatactataccgatgaaacttgtaaaattcataactcccaaataaaaaaagatgaaatagaaattcttccacctaaattcattttagaccagtacctattcactgtgcacaaatcatccattttagagcattttagattttacgcatattttggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcctgcatgtcgattgtatactaacaaattaaaatggtgttaaacttgttagacaaattcctattatttgcattatcaccttaaccccacatatatccatatccatcattcctaaccttaggaacaatatgactataccactttttatatgagttttggtgacactaggttactataaagcttagccatgcttagaatggtcttccttgtcattatgggctcattacaaacatgaaaattgatttataattaatctgggcagaactttaatacttgtgattttgataaataaaatggtggaaaacatggattttaggtttaggcctcaagtggtgcacatatggtgattagttgtgtaccgatagggggagagtgtgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggaacttatgtatcgcgtgccatgctcttgcatgattattatttcacatcatgtgggtaaagtgtacaaactctgcagagttaaaactaatcgattagccgtgctcgcggtcatgagcggcgtgtggatatctattgagtgtagagttgtgtttattcttctaaatgctgaaatttaccttcaaattgtgatgagatttgagaatgatctccttgctgccatggaaggcaatgaggtgcatatttatacatgattaatgcctaccttgatgcccaatatgtcaagtactagtttgctgaaatttatttgaaagtaaacctgatttagaaatgttttatgcaaataaaacttgctttatgctaaaaagaaccatattatgccttccttggttatatgccttgcaaaagcctaagatatctacttacttaaaggactacagttagctttacgggaaatcaacactttgttgaaggtggaatgtgaatacagggacagagactatccatattaccagtagggtgttaggcttgtcttggtgcttgccagtacattatttctaataatgtactgactcttgctattgaattaatcttttgtttgcaggttttagtcttagtctttgagtgatgcgggtaatcgactgcttcttctaggacttgaacttaatggggtaaacccctagtcggtgtgcttgtggattgggtagacaagcttccgttgttctatatatttatttggccggttggccaatgtaactaaagtagatgtagtttataatcgctttcatcttatttgtgtttgctatgtataatcatgctcgagatgaaagtgtgaatctagtgcacatcctgggaactagattcacatgagtatgagttaagaatatttgagatgttgtagatctttagccatttttgtcaaagtctcctgaatgtgtaacacatctggccgccgccttcaagtggtttgacgggcacatcttaggctgaagttgactggcaggctaaaggcctagcaatgtctccaatattcttctctcgaggcattggatgtttcattatatttgtttgatgacttgaattattcacttcatccctcaaatataatggaaggtccggaaagactacgacaaatattcttcttgagtaatttagatttatcttgtgagaattatctcttggttagttcctaaatagcatacgggattattgttcattataatcaactaaaatatagttattgttttggtgagttataaacactaaagtagatattaattgcttagacgtggtgtttaggtatttgttatccagtaattgctgcgtatccacagtacgtttgaggtaggtgtagaggtggtgacagctcttgagatcacttaagtcctccctgtccggctacgtagtagagcgacattgggaacaacgggttgcctgtgtctgaagtattgcgttaggattaaagttaagctttccctagacactgtttctcactagtaaatcctctctatcctggcctatcatttgcttggtgtccttggataaactggaggaagatctaaccacaatgttcctttggattcgatatccttggaatactccgtaagggaagtgctacctcggtatatccgtgcacttgcggattttatctgtacccgtattaaaaaccagcacccatatccttcaaatccaactcacaaaaaatcatggctttgattgaagaagaccagttaaagattgaatctttaatccattcctctcacgcataaaggaaaggactatagcaaaaaaaaaacaagaagaagaagacgaaattctcactgttgctcgtgcttgcgttggcgagttgacggtgcccgcgttagtgccaggcggcttccgagttaggcatcggtcactcgaagagtactcgttggacacgcatgcgttcgagctacgagaatggtgtcgtgagcttgaactcgtggcccgcttcatcacgttgaagaaacgtcttgctctcttcttcatcacgcacacaccagcaaagaacacacaagatgatgttgcgccctaaaatcattctaaaattttatcgtctaaattatttctataaattgtaaaatgccaaaaatagccttcaacaattaaatgtcatcaagtttcaactcaaattcatgtgtgagaattttctttaagttcctcatgctaaaaaacacttaaccattttttagaattttaagagcattataaataattttagtgtaacaatatcatttctcacgttttcaaaaataaagaaaaactaaaataaagtcctgctctggctccggcccttctctccttcctggcccaaccgagccacgagcccatcagcgaccctcctctccgctctttgggctgccccctcgcgccggcctatcgcgcccaccaggctgcccgagctgcatgtgcgctgcacgcgtgcgccccccgtggggtccgcctatcggaggcgtcccctacctccagcccgaccgttcctctctctcccattgaaccctagcgccgccggtcaccttgatcgacctcctcaagttcaattcatcgcaaaaaccggtttcttgtgtagtgggcatcaattcccccaacaaatcccattcaataccgcactaaatcatcctcaattttaatccgtaatcatcatgttcaatagggagctccaccgtcactgccgtcgtttcctgtcctgtagcggtcgaccgcgagtctggagtaggtggtggcggcctccttctcctgtacacgcagctgcgtcggcagtaacggcagacgggagcttttttttttttcccgggaaaacggaacatatgggcctcggctaggggacattggtgacctcgaacttcgccttacgcctccgcggaagcattggaagggcaaaagtgggagagggtgccagagaacggaggtcaattggagcgacctgggatggccatggcgagcaccgatctgggcgtgcgaaagaaaagggccggcgactggttttactggctagcgtgattttcggccggtggccccacgtgcgcgatctcgtactgggtgatcccgcgtgcgtgcgttcgctgtcgtcggatatgatgtattggatgattttcgatcgttggatgtgtcacacgatgaataaataaaacaacttgtatagggtagaagattagccggttttcttttttaatattaagctgtaaatttgtcataatatttaaaaataagcaacaatccgtgccgatacagagatcattttagtacagatggcatccggagccagaggagtcgacggagtctcgggactagagttcctgatctggttggagatgaggaaaggatggactgcagcttcagatctggatgtggagcaaatccataggggctgcagctacagatcgacacatgaacattggagcaaaccctagtcaatggagagatacaagatgaaggggattcgagaggagaaacctacatataggtggatttgaatgatttagagtggggaggaggaagaagctagaggggatgagaagaggaaaagacttgggatgggagtgaagaaagggttatagtattatggagagtggtgactgtgaagtggttcttttccctttttttttttatccacatgaaaatttgccaatggtcattcatgttggtgaaattacttgtgccaacaaagtacccaaatttttggcgatatatgtccaaccatctggtgccaaagtgaaaatagctacccgcccaactcccaccgcgcgcgaacccattattttcactgattgcctcgttcacatcagaataatcaaattattgtgacaagttgtcaagttgtgtatccacgttaagaaaattatatttctttgatgttggtataggctcgtatggaatattagaatttccacgatagtagcctttgtacacgtacatcagtaaaattatcggccgtcaggcccagttcagttttctgtagtgtgtagcttttttagatagtggaatagaatatcccagtctttgctcaacgagctacaatcaattattacaggtagcacataaaataaaaagtttctcacataaaaaagaagacacctaccaaccaagataaggagtacgcaattattgaattctgtttgtgaatctccatccaaaattggtaaacagttgcataaccattgcctcaaaattacgacatgcaacttttaaacgctcgccctcttcattacacttttgtagcagtgcccaagacctaagccagtgcgttgccctgaaaattacctgcatatatgaaacagatggtgatttgtcaaaaatcatatcattcctactcaatcatagagcccaacatatagcagaagctcctatgagaataagtttcctattttacttgtccacccccagaagccaatcatcaaaaatatgagatatgctattaggagggtaaagactaaaagagaactgtacagctctccaaataaactttgcaaaatggcattccataaaaagatgctgaatagttccattcttcacatagaaacaaaatctcaaactcccattccagtttctccttgccaaattatctttagttaacactacccctttaagcaagtaccacataaagatcttaatcttcagaggcaagcatgttaagcttccaaagaatcttatttctcttaatataacattgtttattaaagccagatacattgaccggacaaaaaattggccattcagatgatagttccatctaaaacaatcactttattgattcaactgaatatgtacaatagaagcacacaattcatgccactttgttagattctgaccaactaaagcctttctaaaagaaacatttagcggaacagatctcataacattagcaactgaagaacttttccttcgaacaatagcatagagagatggatacctatctttaaacgccaagttacctagccatttatcttcccagaatctgacttattccccattattcagaatccaggaacccatgtttaaaaaagtattcttaactttcataagacctgaccaaaaatgagaatcaccttgtttcctatcaacttgggtaatatactgattataaagatactttcttttcaataagtcttgccaaagccctcgctcatttattaatttaaacaaccatttactaaaaaggcatttattttgtatttctaaattatggacacctaaaccaccttgatctttgggttgacaaataatatcccatcttgtaagtctgtactttttcttatgatcatccccttgccaaaagaatcttgatctataataatcaattttttgaagaacccattttggaatctcaaaaaaagatatcataaacatagctaaactagaaagaacataattaatcaaaaccagtctacccccaacagacatatgttttccctttcaactactaagtttcttctcaattctttgttcaataactttccaatctttgttactaagctttctaaaatgcattggaataccaagatatatgacaggaaaagtacctaatttacaaccaaagatagtagaatattgttcataaaagtcctttgcttagccaaaacaaaataattcacttttatgaaaatttattttcaagctagaaaacttttcaaacacagataaaatcaatttcagattcttggcttgttgtaaatcgtgctccaaaaaaatgatagtatcatcagtatattgcaaaatagataaaccatcatccaccaaatgtggaattaccccattaatggtaccaacatctttagccctcttaattagtagagctagcatatcagccactatgttaaagataatagaagacaaaggatccccttgcctgaggcctttgtaagtttgaaaattattcccaatttgatcatttactttaataccaacatgaccaccctgaacaaaagaagctatcaattgacaccatttaggagagaagcccttcattctcaacatttgttgaacaaaagaccatttaaccttatcataggctttctcaaaatcaatcttaaatattaccccgcttttatttttacgacacatttcatgaatagtttcatgaagaataacaacctcttccataatatttctcccaggaataaaagcagtttgagtaggactaattactttttgagtaacgccaattattctatttgtagcaaccttggtaaaaattttaaaactaatgttaagtaagcatataggcctatactgttgaattttcatggcctccacacacttaggaaaaagaataatagtaccaaagttaagagagaataaaggcaaagtaccattatgacaatctttaaaaagatctaacaagtcggctttaataacattccaaaacacttggtaaaactcagctggaaatccatcaggacccggagccttgttgtgttccatttggaaaattgcctctttaatctcattctcggtaaattcttgagttaaagcctcattctctaattgagatacttgagggatatcatcaattttactctcataaacctgaagatcaaaatcatctggaggaccaaataaacctttataataagtggtaatatgcaattttaaattcgcatcaccccttattaattgatcaccatcctgtaattgaaaaattcttgtttttctatgcttaccatttgcaaccaaatgaaagtacttagtattagaatctccctccaagatatctttagtcttagccctttgataccacctaatttcctcttctctcagaagcgtagataatctatttgtataatacactctaatatcaatttcctcctgagtcaaaagaatggtttccgtttttttatctagcaaatccaacttatctaataactcttttttctctttttaatagatgccgcttgtatgtttagcccatcccctcaaatgttgtcttaaacgatgaattttagcctctcaacgctccatgggagtattaccttcatcaacattagaccaaatctcttttaccatatcaacaaaaccatcccgtaatagccaacctggttcaaacttaaaactatgttgagcattacccggagacgaagaatttgtatttaaaagtaaaggagtatgatcagaaatatctctattgagagcaaaaaccgaggataaaggaaatttatgttttcactccgttgacattaaaactctatcaagtttctcatagattggatttgctagattatttgcccaagtaaaattcctacctaacataactagctctctaagactcaacccgtcaataacagcattaaaaagaaagggcaatctatcatcataattagcattgtttttctcatcagggctacgaaaaatattaaagtcaccaccaataagaattggtaatgtttcatgactacacagattaactaattcagcaagaaattggtccttaaactcattttgagccagaccataaaataaaattaaagcccattaaaattatcagctttgttgcacaaatgaaacttgatgtaaaaatccccctcatcaattaaaccaatatcagcatttagaaggttaatacctaagactaaacccctccctctaggaggtttgcaatgccataaaaactctttaccagcacaaagatttttaagtgcagtaggagtaaaatctttcttaacggtctcagataacgcaataaaatgttacatttcttttaatggaaatagagtgctaaggccctttgatcaaaaaaaaaagataacgcaataaaatacctgctgtatgtgatttctctagctattccgtgtcgtacgtcgtctggtgatcgatgtgatgatgatacgatggacggatttcgatttagtgcaaattaaaccgtccagacaagcttaatcaatatacatggagtatataggtatcaaatcgatccatatgccagcgacagcgagcgatatactggcagttttaattactactcatagccagtactgttattactgtacatgtataaatacggccgggatacagctaacctggccataaatatatatattgctgcccgtattcctgtgagatcgatatatattgctgaaaagaaaagaaataaagaatgagtcgtcatcaccagcaaatatgtatgcgtgcgtttaacttttgaattcatgtcgtttgcgcaacagaaagaaaatagtccagcaagacgatgagttgtaaaattttgtttgtatccatctacaggtgatggttggcgtcgttccgaaatcaacacgaaagagaagaaaaaggaaagaaaaaggttggcgtcattttgtagtatatacgtgtaggtgtatttgcttaactacgacgccagcatcggcctttatttcttttgagcatgtagttcgatgggaagtgttagctagctaggcatgtagacacctggcatggcatgcacagcctccgaggccagaatagttgtgctgatgatatacacacaatagatggcacgcatccacgctcgatcggttgatcgatctgccttttgagttttgtacacatccatcttttcctagcatgtatagcgaaaaagggcaagtagtaaacatgtgtacacgcgttctgaacttgaagctattagctatatatctatcttcctcacaactctccttttaattagttcttccatttccacaactactccatatttccttttttctcatttcttcgatttgtgcgtcgaactgcagctgctggtatccagccgccgcttctccgtagctactttcaggccggccgaccgagcggacaggtaaaccggtgtggttgtggcggaccaggccgtctatcatctccgtaggttgttctatttgatccatctatgcatctgtattgtattgtattttcacgcatgtatgtcttataatatcctcttatccggtcattggtcaaacagactcgcaccagctgctttcgctctcccttattaaatcttcaccggcgggtcggatcgcttttcccctttcttttggtttcagatctacacccttgtaaaaaaaattgatcccttggtaaaaaaaaattaaatcatagggacatatttagataagcactgtgtccagattaatctatgggattggtttttttttgaacggagagagttatttgattagcttggtattttctctcttcgcctcccctaaaaaagatctttcttctccttttttttctatctaaaaagaatatatcttgacaatttctgctgtttttgttttgtttgtgttcaaacgatatgtatgtttgatttttattttgttaacttttgatatactaatgatctgttccgtaggcagatttattggtcgaacaaaacttccaaatctgtttatcgaacaaatcatgaatataccaagtgttagaaaaaaaaaaccatcaaacacaagtaactcagattgaagttataaaaggcaagagcactatatcaagtggtaaattaaacacggtatcatccggttgcataaatatcatcattaaatctgtacttggcaggggcgtgcgagcgagacatggagaacgcagctggtggaagaagggcacaacaaacgcaagtgactgaggagaggcagaagaagatgaagcacaaggcggctcaggagattgctgatggcagcagcactagtgacacagtacatggtgctgctgatggtgtctgcttcccgtgtggtacaagtacagctacagcccacctcttgcaacccaagcactcacagccacagcacgaggtaaatatgcatgaccctgcttttaaaatcaattaatccttgtactccatatatatgccccagttaattatatttatatatatatatatacatattacaaaacagagggagtactactttaattagcatgctagttaatttcttcaagagacaatatataatatactacctccttcccaacatcaaattttaaaaaagggacgaggcatgactgaaaaaataaaacaaaaaagtagtcaaatatatactgcgatgacacgaatgttgtcaagctaaggtagggagcgtccaagcaaaaacaaaaaagatgtaatatagcaaatttaagtaaataataaaagcaaaggtgtggtttttttggggggagggggttgcggcggtacccaaccgtgtaaggaatatattaaggtaagaatataccaagtataagttaaatttggttccctcaagtataggtctgatctatttcattcgccttaactgtaaatccgggttgatgcctccaactactaaaagctagcaacacaactccctcagctgtttttgacagtggtttcgctgacatggcgtccacgtggtagcctagtcatcaaagaaatttaaaaatatacttgggccccaatgtcagtgactacctcacttattcttcctccaccgcacccttctctcctctctctctccctctctctccctctctctctctctccacgagcagcaccagtgaggtcgcgacaacaggtgctgcgtgagggccatgtgggtctgggcatctggccatgctctgccacagggcatagctcccgtggagcgccagtcaaggtcaagctcagtggccatggctatggcttaggagaagtacccgtcatccttgtgcaaccgacaacaggagtctgggccgaactcatggaggagcgagaactcggcgtcgagcaagaacccatcccgccgcgcaacgccatacagctgcacacttcgttggtgttctccacctccttgggtcgcacgtacgtcaaagcagttgcactagtgccactcatgtcgactacgttggggacaccgacgaaaagcgtggccatattgctcatcccctgcacccatgcgacggggttgaagtaccagtcgccaaagaagttgtttttgtcgttcatcatcgcaacactaactagactcgctaacgtggttgtcttggatcaccatggcatgacacagttcttgcctaacctgtccaccatggccccaaatgactcgatcatcgagaggtcgaggaaccccgagttgttcgccttgacgccagtgatagtttcagcatggttgtggaccaggagcgacatccaaacgttgagtgacaacagtgtcgggttggtcgccagcacgatcaagggtaggtatgtccacatgaggaaccccaaggcaagcaccttcttggtgatggtgtccaccggttgcatcccaagcccctctgtcaccaccagcttcaagtgtgatgactagttgacgcaagccaacttcacttgccgccccgcctcatcgacgatccaccgcgatgacgttaatgatgcgatggacattgttgtctctctggctgtagtaaaagaagagactagggagtgaggagtgagtggcaaaagaactttgatgctgctcatggtcgtggagagagagaggggagtggggagtggagaaagaagataagatagtgacttacatatgggccccatatctattgtttaatttgtctgatgactgggctgccatgtcgacgtaggggtgggcaaaaacctcaaaatcgatcaccaaaccaaaacatcggtttttttagagttcggctggtgatgtggtttttgttttgttctagttctggtgttcggtggtttcttcggtcttcatctgctgtgaactgagctctccaacgaaactgaagttgtcggatgcaggagtggttcaagcgaattggcctcctcctcatttcacacgattttcgaatgtgagtatagtgtttcattcttgtgagcttgggcggtggagcccatagcattcctcggctatgctccatgcatttgcatgctgtggtaccatgccttgcttcaagtgatgtgcgttgagaggatgtttgatcgatgggtgggtttagttggtaaaaaccgtatccaaaaaaacaaaccaattttgtttggtcttttttactcggtttttgttttattcgtactttctttggttgtcattctacggaaaccgatctttcataaaaccaatatgaaaccgacccgattaaactggaaaaaacaaacacccagcccatagtggatgccacattagcgaaaactgcctcaaaacagtcgagggagttgttttgccttttagtagttggaggagtcgatatacccagctttgcagttgatggatacaaattatatcttacctacatttgagagggtcaaattggacttttcctatgatgataccctagttgggttttaatttaggcccccttcaattggctactcaaattaaacaagagataactagctacaagagggttagctagctaggggtgcagttagtttagtctaccgtcaaactgtatgaaggatgcaaaaacgatgggtcaggaagaaactagatgtgtctgcaacaacagatgccatatatgtatgatttatctgcccatacgacatacgttggtggtgaggatcgatacatagctctaggtatccatccaagaaatatatacttgaggaggccaatgtgaaaaaaaaaaactttcgaaagcagggattattttgctatttggttaatactaaaatagtaaaagttaaaaggcccttattatgattattgtaaagctggagggggccatgaccccctctttatctctacaaagcttcggctttgttagtcacccccattcatttatccaaaaaagactcatagaagtacaaatgtacctacggaaacaggttacccatacttggtacgacttagtacacgtaacacaccttccaacaatggccacgctagccaaattacgggaaaaccaaatgggagcacataagtcgaaggacaacagcttgttttgacattgttgcaattaagtcaattggtgatggtagatgcaaagctcatatctcgactggcactagtgccatgagctctatatgtaaaccaactattctctctcctatctctgctactagcacggaaggtcaatacaagatatagcaggcgtataatggacgggcctaacataagttggtagtttgtcaaaagacgccgcaatgacacatgggctaacaagagagatattaaaacgtgtgggtgttcaagcacactcctagtgagtcacgtgccttgagtaagccatcaccacatcctgtgacgacgctcaagcatgatgcctcggagttaagcgtgcaagtcaaccatgtaattaacatgacatgtaatcgattagtgctaaatatggaactaaataagtaaatatatgttagtgcaatttgttaattcctataccgttgtaagattttgggtgaaactttggaagcacgtgtgtccaatcacactcatgttgatatatcggatgcaatatagcaaatgtgtatgacactgacgaccatcacaatgtttcttaagtgaggttccttcaaattatccaaattaattttatgggttgtttttgtctggaaaattgtttgtaacacaggcaacactcaatattggccacactgaccaatttaatgtttgagtaaagaagaagggaatgagcaaatttatagaacaaatgcttcttccccttcacattcaactcatttgtatcgttggatgcaaaagctctcatcttgaccattggcaaagtcatgagttatttttatcaaccatgtattccctcttcctcctaccactagagaggtcagagtatcaaactgctagatatagaaagcatactcaactactgccatgcatagacatgcttggtgcaagttgacagttcgagcatgtcacaattgcacatggtctaacaagagcagattacaatatacaggcgttcgattacatctccggcgagtcatgcaatttgagtatgccatcacaatgtttcgtcgtgatgctcaacaaatgatgccttggagttaccatgatcttgtgttagaacaaatctatgccaaaaatagaaaagtaaataactaaataagaatggatgtattgtgataagaataccatcacaaaatttcaggtgaaatgtaaaaaccagtagcgtaaagtcacattcatgttgatctatcagatgcaatacaagatgtgtatgctatcgaatgacattaatcccaatatccgttaagtggggttccttcaaatgatccaaattctatgagctgtaggaaaactcttgtaacttatgtaactcgtccttgccaacattagtttgtttgcctgcatgccacactcgatattgtccacaatgaccaatttattattcgggtaaaccagatgagagtgagcactcaaagaaaaagtgactcttccctccttcgtattcaactcatttgtgtgtcatcggacacaaagctgatctcatcttggccacccgcagaatcaaaagctctctttgtcgaccatgtatcccctctccctcctcctattaccaccatgagaggtcagagtatcaaactactgtatctagcaagcatacctaactgtagacatagccatgcttagtgcaaaccaattgttaagcagagcacatcacaacaacacatgggctaacaagagcaatattacaacatgcaagcattcaagccaacctccgttgagtcatgtgggctgagtatgccatcgtaacaatctaccacaatgctcaagcataatgtctcggagttaagcaaaatcaaccatatcattgccacgatcttgtttagcactgatcagtgtgaaatatgaaatgaattaaaatagtaaatatgggtgggtgcatcatgataagagtatatacttgattactgtacaattccacgttttcagataaaatgttagaagcacatgcctatccaagtcacacttatgtcgctatatccgatgcaatatggtggatgtatatgccacgaggaccataaatcccaatatttattaagtgagtttattttgaccatccaaattctatgagtgtattttgtaggaaacaatttgtaactcatccttctaacataagtttgtttccatacacgccgcacttgatataggggccaccaaccgattgaatatgcggataaactagatgagaatgagcatactcaaagaataagtgcatcttcctcttcacatgcaactcatttatgtcattggacgaagctctaatcttgaccaccagcgaagtcaagagctctctttgttgaccgtattcccccaccctcttcctattaccattgtgaaagagcgaagtgtcaaactaatagatatatagtacacatgtactaaactaaggccatatatatgccacaagtcatcagttaggaaaagcacgtcgtattaatacataggctaacaagagcattgttatggcatataggcattagagcacacctataaggagttaatgttggctgattgatccatcacaatgtgctctaatgttgtgttaccacaataccatagaaataggcaaattgaccatattatcacaacaatcataggtgattgtagaccaatgctaaatatgcattaaatgatagtgcaaatgatcatgcaataattctcattgattgaggaaataatacataaagcta

SEQ ID NO: 13174 - DNA, 1840 bp, Oryza sativa
aaaagggaattaatatatggggggtcccctttcatttgatagattgaatcaccactaggatgccctaactattataggtttaaatgcaattagagtatgctagagttctttgaaacaaatttctatcattatgttgacataccaacatcccaaactgtaagatcaatatgactctattaacactagtaaatgataggaagttggaggtttgtcccatcacctcatgtctatttttccctttttattcaaagaacttattggatttgtgccttatggcaaaagctggagatgcaaatcatatccattatcttaaaaaataaacttaagaatttacaaaggaacgtttgttactttgatttagtattggatatggtccaagtgagtggttagcaaaaatatcatagaggggcaacccatggatcggatgtccacctaatatttcatgtatcttagcgaagaactactattgcctattgaaactagcatgtgtgttgttcgtggttccttctccagtagtttggttgatgtacatattattgctaatatttataaaagatatccatgtattaattgtctaccttctttcagggttataattcaagttatcagaaggtgcttgcaaatgctgacatggacagagatagcaatagctcgacaatgcaaacacaagtccctactaatactagggagggaccaactttcacacaactactactcggagacgaagattttgacctaccaccatatgttcccgaagccgaagagaacaatcaattctatcaacaaacaatgaatgagaacctaaacatgaaccaattgggcaacaatgggatagaaactgctgagttggaacctcaggagcatataatgacgtttgcatcaagttttggtgtaggttcacagcttttaggttctcaagcaatagaagtagttgatgttgtaggaggtttaacttcacagtggggaacacaactgcatgggggtcatcttgcacgtgtaatttcatatatccgtgcatttcatgacccagagcagcagatcctttccaacctcgtcacgcatcaatctattgagacaatgttgaaccactatgcccaaactgcagagatgtcatattccatgagatatccagaaaatgcagttactcgtggacctcaaaatgtttctgggtttcctcaaaccaatggacagatcaacacactgaacaacatgaattctgagttccatttcttgcttgaacaagcaaagaatccagagaacaattccatgcgactcatcaacatcaggggccatctatgtgctttcaggtgcacacataactcatgcaacttttagtgttttatttatagtgtggttgtttaaattagcttctcggtaagaatatgaattttgtggtgccatgtgttgtttgaatcatatcttgcttagatgagattcgttggcgttactacgaagaaactattatgatattgaacctcatgccatatcgagcatcttatcccatcttaaagttggtttatttggtagcagcatttcctaatttcactttttgtattttgtatatgcagcattgatccgtttggaagccgtttcatacaacataagcttgagagagcaacaccggcagagttagctatggtgtatgaagaaattgttcctcatgcccacatgttggctattgatgtttttgccaactacgcggtccagaagattttcccaaatggaaattgacatttattttcaaacaaaaatatttgttattgattattacatcatgaatatacattttaaactttttacaaaaaataatgaaaatgtggaacttatctgagcttttttt

SEQ ID NO: 13175 - DNA, 3060 bp, Oryza sativa
actagctttccgttttatttcttggtatatataatacatttaaaggtgtttcatggattcttctttaattaattaatatgtgtaatgtataattttgacgtgaggctttaaattaatgtttaattaaactatactttatatattttcttcatagaaaattgatccagtgtgtgctttaattaatcaggctttcgaagtaagtgatatggatcagaggatagagatggccaacgaggttggcagaaatttgatgcagtgtgtatatgatcaaaacggcaatcacgttgtgcagaaatgtttgcagtgtgtaccacctaaatatataaaactaatccatgcaagcttctactggaaggccatggttttatccacgcatccctacggatgtcgtgtcatccaggttgatagatatatatgcttttcgtttaagtagaatttaaacaatgctaaaataagtcatatcgcaccatttctacgccatgaaatagaatgtagaatttaatatatttaaaagatgaggatgtcgcccatattaaagaatttaactttgtccctgttacatataaatttccttattgtcacttcaactcattatcaatgtttaacatttgagtacctattaatagatgaaactgcatatgtaccaacaaaataagcctaatacatcattaatacactaaaatatccaatagacctaattgtttgtgtctcacttattttcaaatccatatatataaatattctaaaagtaccacttgtaccaattaataggatagcatcgttaaagtatacataaatgcccctttaaagggtgaagccaattatagtggcaagacatactttctctgttgccttgaaacatgcggtctcgtatcgatatatgagtgcccacctagactagcctggagcacaattttaatgtctaattcactatcacaccctcgtgaagtattgatcggtaagtagtaaattgagcactattggtgatggtggcctccaatgaagtcacctcaactcagtcatatgtatgcagcatagcaaactctattgtctatgcttggttctctttaggtcgagaaggaaaaagagaagatgaaggtgatcaaaatagtgttttttctaaggttttgagtagatttgcggtatagagtagacaccatttgtttatagtgttaatcattgctactcaactatttatggtatagatgagcaaggttaatcatttggcagtacttaaaaaatatagctcaagagacataccatcaaggtgatctccatagcaccaattattatttatattttgaaaaatatgtatagtttagtgctcggttttgttttcaacacttgttgataatcacatgagacacctttactaatttgaagtatgtatttactttttaaaactttttttatagtaactaatttgtgggagtatacttatagtcacgtcgatggggtgtatcacatacatccatcaattatatctgacatgttggaattccttaataaataaaataaaacatgagtagtttaatgcacattttgattgtttatttgttgccaaaactatttggcaaagaaaaaacatacatatatgataataaatctcatgatggataaagggtgcaaggttatttgctgaaaatattttgatgattttttttacatctatgtaccatgtatgctacttattagtagttttgagaaattctaaaaaccactttcaaaatataaatattaaataaatcaaaattaagtcatatctagttaaaaaaacacaactaaattttattgttcttctttatagatatatatttaaattagcgttgtatatttttaaggggattttttacaccctaaaatatgatgtgaaatttttcggaaattatcttaacattaattattatttgtcaacccatgtgtcgtgatgtatttatgaacactatataatttttataatacatcaatacttcatttaattaaaggaatacaacaaatatcataaattggatatatattataaaaatattttaaaatgtgaatgtttatagaccgttgatttgatattttatatttatattatagatatatcttaactacatatgtctgtggaataatatattttatctttgtatggtgaaaaaaaattctattttacatcaatttttttcaatggtattacgtacgtatgttttttgctctatcgtttatgctagaaaattttatttgactttttagatgatactacgtatgtattttttgcttttatatttttttacatgtggctttatcttttcaaccgtatgtatgtgggtatgtttttttctttcggcgagccatacctttttgttccaaatcatacactctatgtgcttatgttcttttttgttttttttaaaccaaccgttcatattttctcatgtatagatgaggaaagtattacaaatatacctaggtctaaaattatgggtacgccaatttaaatgaaaattaccgtaaggttagacggtgacatgtggtggtttagttatgtttgtaggaatgccatgttatgacttagaggcgtttgtaggaagtttaatttacttttggtatataataggtgttggttcccttctatagatattaagaatatattaaatttaaccgtttgtagtcccggttggtaaccccctttagccccggttgtccaaccgggactacaaatccgggactaaaaatagctatctttagtcccgggtgaaataaccgggactaaagatcaatctttagtcccggttcatgttaccaaccaggactaaagatcgatcagccacgtggccggccaaaccatctttagtcccagtttgtgttaccaaccgggaataaagatcggtgcaccattatatatatatatatatatatatacatatgttacaatacatatatatgcataatatataggcatatatatatgtgtgtgtatgtataaatcatatattacacacacatatgtataatttaaagcacttaacattttatgtgcatatatatatgttaccaaaatatatattaacacaa

SEQ ID NO: 13176 - DNA, 4177 bp, Oryza sativa
aatatacatatacatgcatatatagtacaattcatttgctcggtagctatagctacgacttcgacgtcggcgttatgtcagaagaggaaggaccgacgttatgaattgtctatccgtcgtagtagaattcaccgtcgggattaaggacttcttcgttgatgaatcccatcagttgttcttgaacagccgtgataaaatccttgtgtgggagattatccctcatgtgaatacgctatcgttcgaaaaataatgacgtatcaatatatgaaattaataaacaacttaacaaatcgagcaatgaaattttgaatgatttatgtatacgtacatcgagctctcgtgttgtgcatatttggtttgataggcaatgggcatactcgcatacgtagtagccgcataagttagtttcctggtcctgctttgcacactacatgagaaacgatgagagatttaatatactatttatattaactgtaattagagattcaattcaatataattttggatcatgcatgtactcactggaaaatgaaacctccgtccaagtttttctttccaagtcccgcggaccaattgacggaaccgatcccaagccctacatatgtagttgcaagctatgattaattaattattacctgagatcaacataatagcaatagattccccgcgactttggaatagatggcattatattacctgtctatcagtttgaagaccttgtcaaaaatcttcttctctttattcattgagtcgtacacagtgactctgcatgcgtccaagtcgaagaataacaggacccagtggaatctggaatatgcgtgagatgagatatatatgattgaaaatgtacatgctatatgtatgggaacgaaatttgttcgagcgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgcagaccctccgccatcgggccctttgaatctccattctacaacaatgaaaagaaagtattattgcttacatatatgccaggagctaattattgaacgaaacaaatcgaactcaaagatactcacaaaatccatgcgctcagaagagagacgtcgatggcgtccaactggtacagatcgaagagatccttgaaatggatccagagaacatcttctccttgcaagaagttggagtttctgatcctcgctccgaacatctctctacccttggcgctcatttccatgtaccgttcatggaatttgtatatctgtgtcggtagggactgcagctgttcaggtttgacaagcggtttaccgagttcaaacttgtatgccacttccgccttcgggattggtgcgcctccaaccaactgatccacagttagaccggtgtctgaaatgaattccgttatgccaaaatctttgccggtcaccaacggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcagaactccgaggcttgagttgcctcttcacctctcctgccacataagcatcaagctcctcttgactgcaatcgtacggtggctacttgtttttggtggcgtcaactttcgccttcttcgttgcccttgtgcgggcaggcggtggagcttggcgagaccttgtcttgggaggtgcaggcggacatggtggaggcggaggaggcagaggagccggaggagccggaggagatggtgcagcaggaggtggcggaggagccggaggagatggtgcaggaggacgtggcggaggaaccggaggagatggttcaggaggagatggcggagccggaggagatggtgcacgagacgctgcttgtcgcccaggaaggatgatgtaccgcttgcgccatactatgatggcgtggcttgtgtctcgtagatgcgtctcaccatctcctcctgggtagtccaactcgaggtcctcatacgcagcttccaccagctcaacttcgacccttgagtatcctgctggaatcggcctacagtggtaagtcccgaaagggtccgttgagatggccattcccaacgccaccttcaagtgatgagaggttatctattggtaatcaacctaaggagcaacttgcgggatgtactagtcaaaaatcatcaaactacgagcataccttgattgataagttcttgaagggaatatgcagctcacatggtgtccgctgcgtgatctcatcaatggggcaggtggtttcgtcctgggtttgcatggcgtccatgctctgtgatccgacctgccccgttgaggcgcagctgctacgattgcctgatgggctgaccattgcaggatgaatgtacggctggggatcttgggaccgatgtgcggccatacgttcatccaccttccttgccacctcctcttgcatgctgaactcgtagctcgatatcctgtactcaagatctgcaatcttcgcctcggtatctctcttgctcctcatccgactcctgtacgtgtggatgtcctccttaaatccaatattctagggaatcacgcctttccctcgtgttcgtcctggatgctcgggagtctgtagggcgagtgacagctcatccttctctctgtcgggtcggaatgtgccctgagaagaggctaccactgcgttcgttagtcgactagcagcctcgcgtatctgatcactgaagacaagggagccatcaactgggttaagcattccaccgtgagcatagtaccaaaacttcgatcgatcaggccatttagcggtggtcggtttgataccactctcaatcaaacttgcctccatctcctcccacttcgacattgtgacgctatatccgcctgaccccaagtggtgatggtacttcttcttggcggcattgtttttgtttctggccatcatcgcttgcccttgttgccctgtcttgtaagcaacgaactcgtcccaatgatcccttagctttgggaatacatcgaagttcggtgttagtcccttcaagatgtatttcttgtagagatctcccttgaagctctggaactgttctgccattttcttcagagtccactgtttcactatgttctccgtacccgcgggtagcgtgaacgtctcgagcattgtggtccacagcatttctttctctgagtccgggacaaagctgtcattatccccgcgtgcccttgttctgcgccagtacaccatgctgaccggcacgttgtccctcacaacccaaccactgtggcgtacaaaatttttggctgcttctgctggggcactaggtcggccgtcttcgtccacctcagttatgatgtgccgaccctctatcttcttcgcggcacctcgttgtccgcgtgccctcttctgtccagcggagggatgacttccactagcctcctcctcatcgttcccctcctcattcccctccgaatccctctccacgttcccctcctcgttcaagtactggtttggatcctcgttcccctctctttcgttccagcactggctgcttccctctgcgattgtatcgtatagtatctgttcctcatcgcgatcagccatctatgcatacaaaaaaaatttgttaggtatataggatgtatttgcgtaccgtaatattaaaactctgctaatcttatattaaatctctaatattcttatattaaatggctactaatctcatattaaaattgtaataatcatatatatatatgctaagtctaacaatcttatattaaatctctaacaatcttatatttaatctctaataattttatattaaaattgtaataatcatatatgctaagtctaacaatcttatattaaatcgctactaatctcatattaaaattgtaataatcatatatgtatgataagtataacaatcttatattaaatcgctactaatctcatattaaatcgcggctaatcttatattaaaattgtgaataatcatatatatatatatatatatatatatatatatatatatat

SEQ ID NO: 13177 - DNA, 2883 bp, Oryza sativa
ccggtcgttggccgtggagagagtgatatcgagatcgagagatagagagagaggcagcggcggctctcacccaagagatgcggcggcggcgtctgcggcgaaggcggcgaggaccaccaagcaacggcgagagacgacggtggtgtcgacgccgggttgccctaggcacggtggcggcgaaggagatcgagccgagatcgaaaaacgtctaagtgttggtggagaagacgagcgcgcaccggcaatatatatacccccggatctttactcccggttcgtgacaacaaccgggactaaagaaaagatctttactcccggttgttcgtacgaaccgggagtaaaaatatcacgtaaaaatatgatatttttactcccggttgttctcaccaactgggactaaagatcttttcctgctatttccaaattctttttaaacccagttagggttaggaaccaggactaaagataatagcagctgtgtcttgaatttcattgcatatgtgtttctaaaatagtaaataatgcattacaattatttaaagtcgaacaattaatgataaaaccttcgaaaaattattgttgtatgtactagaatacgtggataatatataataagcacatgaatgatttaaaatttttaaaaattctaaaaatcatatataattagcatatgcacgatattaaattgttaaaaattctaattaacatatgtaaatagcacatgcatgatttaaaattaatacaaaatctaataatcatatataactagcatatcatgatattaaattgttgaaaattataattaacatatgtaaataccacgtgcatgatttaaaacctttaaacattctaataatcatatataactagcatatggatgatttcaatttgattaaaattctaataatcatacatatttaacatgtgccatacaacaattgatttgtatggatattcagtacatccaacatagtttacatcgtgtacagaacaattacggcaatacatcggcggttacggttgaccgcacgtactttctcctcactattgttccttccttgtgatcactacgtgagtaaggggtgtcttcatttgatagaaggatgctagggtcaatcgtcaccgtgaaagagggttgcccatcaaactgatcgtaatcctcgtcagtcttgtcctctactccgacgatttttctttttcctgggagaaccacgtggcgcttcggctcgtcaagccctttggccttttttcctttgctagacatgtccttgacgtaaaaaacttgggttacatcattggcaaggacaaaaggttcgtccgagtatccaaccttgttaaggtcaaccgttgtcatcccactgtcatcaatcgttacgcctccactagtcaacctaacccattggcaccggaacagagggaccttgagaggtccatagtcaagttctcatatgtcctcgatggcaccgtaatacgtgccatttgtaccatcgtgtcccatggcatcgatacgaacagcactgttctggttcgtgctcttcatgtcttgggccctcgtgtagaatgtgtacccattgatttcatatccctggaatgtcacgactgagccagatggtcccctcgccaggaaggccagttgttggttaatcgtctcgttacccatgagatgttgtcgcagccacttggagaaaatatcaatgtgatgccttgtaatccatgcatcggacttaccgatgattctagcgcgaactagagccaagtgctcctcgatgtagggagccaccaatgaagattgttgcagaaccgtgaaatgggctttacggaataaattattgtctaccatcattattgctttccttccgagagtcccctttccccgtagtctccctttatggcgtgattcaggtatcccgattgggcgatgcttgcctctggacgagcgcggttacgaacatacttcttcagaacgcccatgtacttcttgaaaggaaacatgttgtgtaggtacacaggaccgagaataccgatctctttgacaaggtgacaaagcagatgcgtcattatattgaaaaatgaagatggaaatatcaactcaaagctgacaagacattgcaccacatcattctgcagggcttctaatctatcaggatcgatgaccttctgcgaaattgcgttcatgaaagcacatagctttgttattgttgcccagacattgtctgggaggataccccttattacaactggtagcagctgtgtcatcagcacgtgacagtcatgagactttagatttgtgaacttcttctccttcgtgcttattattcgctttatattcgtgaagcatccagacggtaccttgatgctctccaagtattcaaacatactttccttctctgccttgctaagagtgtagctggctggactcaagtaatggcttcctttctcctttggttccgggtgaaggtcaccgcgttgttccatatgcttcagatcattacgtgcttccagtgtatctttcgacttttcatatacacctaggaagccaagaaaggtttacgcaaagattcttagtgaggtgcatcacgtcgattgcgtggcggacgtccaagaattcccaatagggtaactcccaaaatatagagttctttttccacatcgccgcgtgaccatcttcgctctctataaactggctgctaagcccatttccaaacactactttaagatctttaaccataggaaacacttgtttcccgccgcgatgtttaagcttcgtacggtgatccgccttatgttcaaagtgcttgcctttcttccgaacctggtggtttgttgcaaggaatcgacgatgacccatgtacacaaccttcctgcagtgcttaagatacatac

SEQ ID NO: 13178 - DNA, 5119 bp, Oryza sativa
atgtttcatgcgtcctttccaaagtctttaaattttctgtcgatgtttcgccactgcgaaccatcggcggggtgtctcagcatcccgtcctgttgacgctcttcagcgtgccatcgcatcattctagcattccccttgttcctgaacaaaccccttaaccctggtattatagggaaaaacccctcacccttaccagaattctcttcttcgttagctgcccctaacttctcttggatcatctcgtctaatcttggatcatagtgctttgcaaaacggggcatgcttctagattatcgtactcctcaccgcgacataggatacaatcattcggagatgcgtgaatcttctgaacttccagtcttagagggcagactatcttcttagcctcgtacgttgtctccgccaatttgtttccctccagaagaatgttcttgatgagtttcaataaatcgccaaataccttgtcactaacaccattttttgccttccattgcaagaactccagagtggtatccaactttttgtgcccctgctcgtaacctgggtacaacgacgttctgtggtcctctaacatcttgtccaatttatgggcctccttttcactttcgcaatcctccttggcgtcctacaacatctgactaagatcatccgcaacgttgttaccatcagcatccctttcctcctcgcccgtttgatttccttcaaatccagcgtactgagcaaagtccggaatattgtcgtcttccacttcatcttcttccatttcaacaccttgctctccatgggatgtccaacaattatagcttggcatgaaccccgactcaaaaaggtggaaatgaatagtcctggatgcagaatactcctcccgattcttacacttattgcatggacaacaaataaaacccttttgcctgttagcttcggccactctcaaaaaataatgcatgccgtcaaagagttaataaactctttggaccgccggtcagcgtacatccattgccgatccatctacatgacatgaaaaaaaatcgtacacacataattattcgtacaataatgacagtcatacaataattataaaataattacaaactctttcaacagtcacacaataatgacatatcattattcatacaaaaattatgaaatattacaccgaataattatatatttactatttataaagttttaaactaatattaatgtgttgtacttattttaatttttcattttactttattttctattattcaagattaactttcactatattttccttctcaactattttataaaaccttctttagcaaataaactaaatttctatatattctttcttctccacacaaattttctctctcatcaactaacaacaaaattttggagacaaaaaagtgtgcaaaacatagatccaaatgtaatatgaaaaaaaaaacattggaggatgaagttgctaaccttttaggcacctccgatttgtatataatccccagaataaattcactagaaattttggcatgacctcccctcttttttgaagaaattttgaagcttgctcgggctggaggaggaagaagacatatatataggggtgggactttagtcccagttggtgttatgaaccggggctaaagatcgccgggatgtttacaccaaccgggactaaagtatctttagaccaaccgggactaaagatcccgagggggcctgacaggccctgacagcatttgaaccgggactaaagatcatctttcgtcccaaccgggactaaagatcaaatatgcccgttaccctttttaaccgggactaaagatcatctttagtcctggtttttgttgcaaccgggactattgtggaattagcccgaccgacgaaagatggtttctccaccagtgaaccacagtagacaaagtctctcctaattaaaataatattaagtaatatgtcctataacttaatgtgaaatactagagaaagaaatcaattaagaagcatatttgattgtgttttaattactacatggatgaaatattgatatgtgtgtgtgtgtgtgtgtgtcgtatagtaacacatagatgcatgcctgtatatatatatgcagtatgttgtggagcatggaggggagtcagtgcgagcgatgatggtgatgaggttgaaggggttaatggttatgatgagctgtcaaaagtacggatcgaatgtgatagagaaatgcctgacatttggtagcatccatgaccgtctcgtcatcgcagctgacatcgccggtgccggcgaggaccaaatcctggtcagtactacattttgtcatcgatcacacacacaaagacacacaaatacacacacacaaacacatgtacacacaaagagacacacacataaacacatgtacacacacagacacacacatatgtgcttgtgtgtttatgttgatgctaatgttgatgggcatacatatatgcagatgatgatgatggacgagcatggaaattacgtgatacaaaagatgttggagacgatagcggatgagtgggtggtggacttgatagtcacagttgtcaaccgcaacttcttcaggctcatccacaacatccatggcaggcacgtcctcgcccgcctccaaatcatgctcgccgctcgcggttcgtatataccttaattactctcttagtttcattttttttacctagcttacattgttcagttcaattcaattcattatctactaattgatccattagcttgttctagacaattatatatgtataatttcccataaacaagtactagtactaaattgattcattcaattcattgattgattcatgtgtccaatcgttgctgcacgcagagaggaggcggctgctggctcttctcaccccgccgctctactacatgggttaattttagttgacaaagagagtataagctagttgttgggtgaattaatgttgctttccttcgttgtaccatacatgcttgttgtaactacatttcatcagtccggtggtgttgtacaatacaatcagttcattagaactgtagcgaacaagccttttaattttaagcaaattttgctactggacaccgtaacttcgtggtttagctatatcctataggacaaggcacgaagtgacttttgggggaaaacactcccaaaagttggatatttgctggtggacaccgcactcattaaaataataatttccggttgaagaggagagagaaatcatgtgaaatgtcaaaaatgcccttgggcccacatgtcactctcctatctatcttctccctcccatgtcgctccgccctagccctcccgcagccgtgggacctcgcctgccgccatcgtcgctgacaagtgagatgagagagcgaagaggaggagatatagagagaagagagataggggacctgacatgtgggcccaagggcattttcgatctcgttgttgtgttttgccggcaagtatttactcttatatgttttacgtaaatgtatgaaacaaacttccattcctttcaagttgcataatataggttacaattccgggaagcggaaagaacaaggcaaccagttggtcatttgatccaactagggttcacaggacgcaaaatattgtacagcttcatgagaattacccagaactaaaggataagatatatgaggaaaaggaagcatatatcaagaaattgcacaaggaaaagaaggtcgaggaagcgacatacttgggatgagcaatgctctcacacaaagataaaaatgtcttgatggtcccttacgcttttatgtaagcagcaactcttccatttgattattatattcgtagtaatacatcattactagcaaatgtcaactccaattcatctatcttgtttgcagcggctactatattttattcctaatatgtccaaaggaccaattgatcgtagtgcttgacccaacacagtgtgataagcaaagctacatggagttcctcattattctaaatttgtataataaaattccccctcaatacctatttgctattctgaaatttttaaataactcgaacaaatgttttatcggcacattgcacatgggttttacatcacacataatgggctaataaaggatccacaggacaaaactaaacatcaagacaaactagctggtaattatgttcacagtgttttaagcaaatacaataccccctcaatacatatgccatgaacacaaattctttgaatgaatacttgtttataatgaccggtgtgataattatgttcacagtgttttaagcaatcccgagcactaacctatgtggatattatgtgtgtgagattcttaggtcaacgggaagtacacaacaaactgcaaaaatgtaagttcggagattgttctctacagagtatttcatccgcaattcatttcctaacatttattgtcaattttgtccattgatccctcaaatccctcatgtagcaaatcggtttgacaatacatcaattatgaacgtatgcactgacatgtgccacttcatttgccgtcactgctgcaatgccctagaaaaattctatgacaatgagagccaaactggtattagaagagaaaattcaagcccataagagaggagaaatttgcatatgtgccactcaaaaaacatagtttcgctagaatgccactctaaatatgggattcgatcaaatgctcaactcgcgggcattcgttgcaatgccacttttgggctttgttgcatttcgaaattaattttcctcaatttcatattttctcggacgcttttgcccttgggactggttgaattggacgctgagccccgacgaacagcgtgcgcgagcaccagcgacaccggcaccgccccgatcccccaccgtactgcctcctctcccactagctgcgcgcagcctctctccgccagccgttccacttccgctccgacacttcagccatggccagctgccgccagccaccacgtatgcctcgcggcttcccggtccgatggcgagggcgacgacggcgtccggggccagtgggaggtgtcggggcgggggctggtaggcgacgagccgccgctagtggcgcccgccatggcatgtggccttcctcctcctcctcctcctcc

SEQ ID NO: 13179 - DNA, 7263 bp, Oryza sativa
atatacggatccggtatatcgtccagtataaggagaggactcatttaagataaggaaatcaatgagttcttatggaaatattccttaagagcgggaattattagaatactactcgaaggggatagggattgtgtcataccatacagggtctgttgtctccaagttctacttagagaccaaggtgatttgcggtataaatacatacccccggggaggtacggggcatcgaatcttagcgcaagacacccgccaccacataagtaatccggaggacttgaagcctattcgccgatagatctcatcgagcccttctcgacaaggatctcgtcagtaatctcgtagttcggttgttctcttttataatatgtggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaagagactggcctgcaataatgccgtgagtcttcgcatgcggttgggccacctgcatgcaaaaatgttgattttcgcagacacatgtatgcaggtgagccatcaaaccgcatgtcaagatcgttttttgtcgcatagaaaaactaattttgtcatcaagaatttgcatgcatgtgccaaaaagtctttcagcttacaacattatatggtcatagattagtttcagttttgttgggcagcgagaggccgatccataacttctgcctttgtgaacgacagcaatgccaccaatcgagaaatgaacggctgaatggcttggacccaccgtagtgactaatcatgtcagccataaattaataacaccaggtgtttactctatagaaaagatcaacgaaaataatcaccggtggcaaagaaagataaaccaaaactgagcacatccttccccttttgctcccaagtcccaacgtcgaagaatgtatggattgacatcctatatctattcatcctgctatcttcgaacgagaaagtataacatgaaaatcactcgttgatgcagcctaagaatgatgcaacaaacttctttttgttcgatctcttaacataccgtgccttactgcctagagcccactacggtgctctctattgttagtaaaaagtaatctaaaccgtggatctaaggttcagatctatttatattaccactcatttagtggtagtagaaacatgaatgggaattattgtaaaaaaaataggtgcggaagggtataaacatcatttatcattgactaaacattttttcttctttgctaatatgagcgatatcagcgcaatggatatcgatttagttaggaaaaaacataaatgatagttactcctaatcatgatattagtaaattatttatttgctcctaataatattggtcgtataatactaacagtagacaacaccggagcaaaatatactattgtataatgttattcaaattctctcttataaggctatcttgaaaagctcttgctaatactatttgctaaacataaaagttatcattgaataagactataagatctgtagcttttaattttgtttattgtgcttttcagctggagattgttgtttgttttttttctcttaagagtaaatacttgattatccttttttgaagggccaaaatatactactctgtaatgttattcaaattctctcttataaggctatctagaaaaactcttgctaatattgtttgctaaacataaaggttttgtttgaataagactataagatcagtagcttttaattttgtttatggtgcttttgagctggagattgttgtttgttttttttctcataagagtaaatacttgattatatcaattaattggcagctaaatacttactacggtggttatgggatcaaatggttttagtaatgaaatgtgttccattatttattaatatctgttggtattctatctgggatgaaaaattgttgtagaaaaagtcaatgaagttttttaactggtaaaacatcttcagacattttggcaacttgttgcaaatttgccatatatatgactttggattcactcgttcactgtatcaggctatgtacgtattagagaaaaaaatagtagtacgatcgtttgatgattaaaaacccaagacgtggcagtcttgcaacatagtttcgtcaacaaacagacgtaatgtgttgcaaatttgtcatatatatgactttggaatcactctttcactgtatcaggttatgtacgtattagagaaaaaaatggtacaatattttgatgattaaaaaccaaagacgtggcagtcttgcaatatagtttcgtcaacaaacaaacgtaatgtggattgcagattgtaggggacacggtacccgagtagccgaggttaggcctttgggctatattacataaggtgggctaagaagtctaagcccatatggcacattgtaatccaatacttcctccgtttcataatgtaagactttcaagcattgttcatattcatatagatgtaaaagtcttacaatacaaaacagagggagtaaaagggatcaaagataagaatataaatcttatccgatataaataggtggtaggtacccggattatatggggtacgctacctaccgtagccggcctccttatgtctatataacggtaggccggaaacaattagggtgatcatacacgtgttacgtgctattcacacaccgtgttgcgcacactttgatacagatctaatctacaaacaactgaagtagggtgttatctcttccaaggtcttaatcagtataaaaatatatcaccatctctcctcgatcttgtgcaccctataaatttacttgccaatctagagaatcgacacagatgaaaacaaaggaatgaaatatcaaaaatacatcttcagtgctcgcataagttttatggcttttcttctaaaggtcttgagcccaaatactaccagtaccaagctagcaaatatatgtgaaagaaacttgaccataaatagtataacgagtgaattgcactttagaccaacttttgttgccgcggtttcactttggaccatccttaatccaaacttttcactttggattagctaaatttatgtttgttttactttagactactcaaaaccacttctttagcacattaactaaatttatgtttgttttactttagactactcaaaaccacttctttagcacattaactaaatttatgtttgttttactttagaattaacgattgaggacattggctccatcacgttggtaaaattctccacctatgagacggtcatatatttaccggagtataccggtcaaaattggatttggggtggttcaaagtgaaactatggcaataaaagatgccccaaagtgtaattcagtttgtaaaattgacatgaaacaaaacagaagttgcaaattgagttacgaattgcgctgcatgaatgcataggacaaaataaccatacttgtttgattaagaaaacataccagcaacaatagactttttaaatgtctctagcatgaagaaaccatgaagaaaacatcgtgcgtgtaaaatttatatgaccaagggccatcatcagtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggcccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcagatgagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatgttgaaaaggagaaaattacttcctcttgggtgatgttttgctctcgaattgttaaatttagatacaacacataattgaccagtaagttgatgtcctgctaaatgaaaggatcaatgctactgtgcaagaaatgcaagatgaattggttggttcacctctagatagtttcaaccaacgagaaaatgaagaattataataacagtttaaagagaaagatatttaggtgccaaacttccagagttaaacagattatttcacctgacaggactcctcctagcatgttgctggcaaaaaattgctcatgtagacttgtgcgagcatttcaccaagctttacttgtgattcagtggtaagatgcagatgatcttcatttaatgacagtccaaatgcgtccacagttacaacattgggcaggttgataccaagctgagctttcctcactttttcaatgttctttttattcccagatgcaagagcaacctgtttaatgcaaacaaatcttgatataaatgataccccatattacaaatgatatcgagtacaaataaagggtaaggttggttgacacataagatggcatcgtgtgtgtagaaagagtgaaaccagccatcttatattgctaactgaataaagaaaattcaaggttcaaaagaaagattacagagccatgcaaaataaaacatattagtttactagttaaaaccaatcagttatcttgtactgggggatgtaaaagagggcctgatgatgtattaaatcgaaactattaacttcaactttatacatcccttaaagcaacatctaggcacatgtataatcgtccaaccttttttttttctcttatgttttgaatgactgaatgttatcactgttacgaataaatgaggtatcctctccaaagtgtaataagtaataactgaacggtaacaaggccatataagtcacttcctaaattcacgcacaagactaagatgacttatatttagagtaacatatagtagtacagcaaaagcacgaaaacaattggttagtacattttagtacaactctagtataaatcaacaaaacacaaatgtaccgatgaactcaagaggggaacaggtaaagttcaactttaaagattttttagtattacagatggaaaaatgttgcaaccaactttactttataaagattcgtttgtgactaaagttattctaaagaaacaatatggtactcttgcagatggtagcaccttttgaaagtggtgacagaatatagcggtcggttacctcatacatgatacatagacattagggacattattgcaaggctgagaataatgctttccctgcatatttgctcaattataattaccatagccgcaaagatagtacacgaatacgataacttgagcaccggcaacaccaattgaatattgaatatgactaaaataaagtaattcaccatcaatatcctgaattcattctttgtgttatcggagttcgcctactaaactgtacaactatggggaaaccacttctactaaaaatattgggagtgttttgattattttccttttgcattgcctctcatttaggtcaacgcagtcaagaaacatgacacggccaagaaatccccaaatacatttcttgaacaaaattatcgttggctcatcgcgtccagttaattctctaaatttgagagtcaaatcaagtaggcaaccgagatatgatgaatatcatcacctggatgaatggcagttgaggcatcccaagatcctccctgacattggcgatgagcgtctccaggttcccggcgtacgcggccgtggcggcgtcggactcggcgtcgctctcccc

SEQ ID NO: 13180 - DNA, 4411 bp, Oryza sativa
ccgtcccagcgccggtggtggacgccgccgcggccggccatgttgctctggccggagagcacgaagatgcgcatggcggcggggcgtgaggcgtttgggtgtgagctgcagcctgcagtggggcaggtggatcgggggggagttgggacgtcgttttgctctcatggacgagcaattgcttgcactgttcaaaaactaagccgtcaagtactcaagcaatccttttttacaagttacattattcaatcaggcttaaataaactacaacaataattcgagataaatagaaaaacacataaggtaaacaaaatagaattgtcaaccttctgtcgacaaaaaatacatcctaaataggctagattttaaggtaaacaaaatagaattgttaaccttctgtcgacaaaaaatatatcctaaataggctagattttaagccatcagatatgcttcataattcacacggtgattctcctccaacttcgacgacctcctcttcttctttggcattgacaatatcatctcaaactccaatcgagaacctatggattagggttccattttgaggtgggggtaggagagggtaatggaaagaatagggagattatcgggcttacagggatagtcataggaggcaatggaaatggatgggtggcgaggtggcgacggtgtcaatgaagccactggatcaggatctgttgttgggcttggtgttgatggcgggggcaaagtgggcgatggattaggaggcagcggcggatggtgatggatctagcatgcgaggagctgtcgaagatgaggaagatgacaaggtagggcaaccttgtcatcattggtttgagaatgcgtaatgggttgtaagttcaagtgccttaatttgattttggtgattaatgacaaatctaactatatgagactaatcatttttatgagcctttctttgactagtctcatttggatatgaaagtaaaaatgatgagaggtatgtattaaacttcacatattctaacttggtctctcttgtggatccaaaatatagtgtgagcttgctatttaatctttattgattatgtgcatatgcgttccttcatatccatatgtatgcatatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttactttggtaatagatgataaaccgatgtttatgggattaacctctcttttgcataagttgcctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtcttatttacattgagaacatggagatcatgaaggtatatgttttatgttggtctacatcattactacatatgccttctctatatgtataggataaacccccattggttattctctaattatgcatacacttgcatctcttgtatatttatttgtatcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagttaaggatgacaaccgatttgttgagactaatgttctcctttgaggtgtgaaaaggaataggtcccactacgatgagactaatgaatgacaccatgggttagtggtcaccaagccaaggacatcgtcatgttggcaagaatgaagtcaagcttgtgatgagaataaagtcttgacaaaggatggacaaaacctcggcataaacatggttcaaccggatggtcacaagtgttgatctcagctcaagcttgaccccaagatggatggcgcaaggcaaaggtataatgtagctaagaatgttttcttagtcttttcccggtcttggtgtttggtgtagaccggatttgttagataggcgccgtactatcaagaggggtctatgaagcgagcttgtggatgatcttgtgccatattagttcatatgcatgtaggtgcattttgtggacttgtctaaccaagtgtgatgagttttctcaactcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgtcgttttactaacggtcggttgagctgacaagtgacctacggtctgaccgtgggccttaggccggtctgaccgggtctgttagccggtctgaccggcgtggtaaggccggtctgaccagccccactagtctgttgcactggtctggtttttggtggcgatacagagccgccagagccgcaaccggtcaaaccgagccgacggcggtctgaccgagccgtggacgatctgactggccactacactgcggtcagaccggccaggttgagtgggctcaatgatttccctgtaacggctagttttctagccattacaaagtagtccggtctgaccggcctcacaacggcggtctgaccggcagagcacaaagttggggatttcggttccaacggctcgttttggtggttgggggtatatatacccactccctagcagcaagggtaaggttttggcactccattgcattatcttgaacccttgcaagagctctcacacccttgtgcacttagtttatctagtgaagtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccgtcaccgtttgtgagtggtttggagttcaccaccttcggagtgaaggaagaactaccccgagtgatcgaggcttgggttgtcctctccgtgggccggctcccgccttgcccaccccttgacgaagggggcgtgaggtggcttcgtggttgagcggtggagttgggctcgcctcaacggggattaggaaaccggcgagtttccgaacctcgatgaaaaattccttgtctcttgtctcatttatttgttgtatttacatttgtgctatttatattcatagagacatatttgagcccatatcacttaggtttgcaaaacttaacttagttgcttagttaaccttgcacctcaccttgcctagcaacttaggttagttttgtttaagtgtcattaagttttaaaaccgcctattcaccccccctctagtcggcctccttaatcctacgtgggtttaggaggctgattgtggggtcttgctggcacggttgaggtcttttggccagttgagtggtggcgtgctgggctggtggcaatggaggagacagcgatgacgagaaacatgcagtaggtgatagtttaggcgtgtcctgctaaggaaaaaagtggaaggaattagggtttgagtatacgaagcaattgttcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcagatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggggcccctctctctcgcacgctcgggtgacctagggagtcacccagagaggcggcggcaataaccaccagatccgctccgctccagccggatctggcggggacaggaacggcgtaccggcggcgt

SEQ ID NO: 13181 - DNA, 17939 bp, Oryza sativa
aggtggtgtgaataatgcaggtactttttcggtatgcaggtggcatttcggagcttccgttgtggatgctttggttgacagggtctctggggtgaaaaccttgctccgctccggtgctagtaacagcgatgccctcgggcaccattcaccttcttgaaggcgttgcttttggagccctcatttcaactccactttaagggaattctctgggtgaaaaccttatattcgttaggatcggacgttgtcaccgttctgtcggcgttaccttcttgaaggcttcgttctagaagtttcttcccttgttgggctattgttctttgcgttcagtttgttaatgtcgggttttcgtcggttttcctgaaattaactgtgctgctgtaaggtttttgggtccgattttctttataaactggatcaactctcttcttctatagtgaaattgcaggagctccctgcctatcccctcgaaaaaaatcggatgaagatgaggatagaaggatgaactagtacaggggtacattaatttgctacagggtacattaatttgcttgccaacttgcagatgaatgacatgcacacacatacatacattagattatatcaatagcagtacacggtacagcagatgagtccactactattacacaagcaaatactggcaaatatgaaatgctaatacatgctattagcaatataatcacagaccgtatccatcacaaccttgctctcaagcgcatggtatgtgtgatgtgctggagtgacatctggtaccgggtggatatgagtatggtacagagggtttgtagcgatatcgtttgggtcgatagtatcaactataaagttgttcaatgccatggcggcatgaataatcttgttgtgcgcacgtggggtgcacgccggaatactgtccaatatttgccaccgagccttaatacatccgaaaagtccttcgaccaagccgcgcagagatgagtggtagtaattgaaattctcccccctgtctacgggtggtgccaccagttcaaattgtggctgctagctctacacgtcaggataaggagcgagaaatccctggctattcgcgtaccccttatcgataaaaaagtatttacctaaaaaaaaattactgtcagtacataagaattacgttaatatcataaaataataatgtaccataaataattacctggtggcagcctagggaactgatcaggatacttccttattggacttagcagaacccggtggtcgtgcactgaccccgaccatccagttacatcaaaaattacacggtcgctccagtctgacatgaccaacacaatttgggtagtttcacctacccggttatggtactaatttgctaggtgtgcagggacgacaacttgcacttttgttcatctatggctccaatagagttttcaatttttttttacctatcattatagcggacacatggatgggtagtactggaagttgggtccaccggccgaactatatcacctgccatacgggctatcgctcgaagcaatggtaaaaatatttggaaatagttgacccgatctttcgaacctattgtttgctctcctattagcttcaccccctgacatagttcacaggaaaatgcctaccgcttccgcttccagtgcgctaacctcataagacactaagttgtacttgaactgaaggatgtcactagcctaggtaaaatcacctaatcaggtcacatacagaacatgctcctgcaccgagcaatattttgtaatgtatgcatcacccactgttggccagtcagtaggggcacgcgacgtggtgcccttttgcggtcgtacaagtccagatgtaatgaatccttcgatgaaatcctcaatgtattcttcgatatcatcgtcggatatctcccccatcgaacatttagaatcatcgctgctcctagtgctcattgcttcagaactgcacagatatgattcatacagacacataagtaatccaaaatcaattgttgagctaacacatataacattgtgaactggacgtttcaataaatctaaaatgcaaatgtgaactagactcatgacataaaattgttacaacatgacaatcgcagcacaacgtttgggaataaacgaactacacaaatccaaatttaactagacgaaatacacatctctgcggcaatactcgcacgtgatcagaaggtagtagtgccgcgagaaactactggcagatattggtgaggtaaacctattggagctccactgcagagaagcaaggaatgggaagctagcagaagattagcgatagcgcggttcctcatctacgacgcttctcattgcacgcatgtcctctgcctatcgcttcctcatcatggaaaaggcgatcctttctcattgggtgtaccgcctcaccatagatagaggatacaatctaaaatagttgaatctttagttgttttatatttggattcttacattgtaatatacaacttgaattatatctggattcttacattgtaatatacaacttgaattttatgggattttgatcgtagagtttaatttttttcattcaaataagctggatacgttgttgaatataaaaacacctttttttcatgtgttgtaatccaaataagtaaataagaccaatcaaaaaaatttcattaatgctttctttgtatgaagtaatcttggggcaattgtttatttgatcctattttaaagtctaacttccaatttaaccctacttttttagtttgcttatatgacctcgttttttccaatcaaaaataaaaggttgacgaccctatttcgtgaagacatgataacggtgttaactaaggggcgaattgtcctggttgcccttgctcatatgacccaaatgtatcaaagttttttttgtttgttttgactttttaacataatttaacgagcataactttgatatattagagataactttgataaatttggattcaatttgacagatttggctcaatttgataaatttgactttaatttaaaaaaatgacataattatggcagatatacaaaatttggacaacttttctcctatttgtccatcccaaatccaagtgatattcatatccaacataaaatttctgtccaaaagcatgtccatcactatgtgacaacacatacaagtcccaacatcacaccaacgaccaccacagccatgctgggcttgggatgctggacgagctagcagcggtgatgacggccgcccgcagaaactttttgagaacaaacgcataattttgtagttggaaagctgggaaacgaactcagtctacgtttgttgctctatgttaccaacccctctctctcgtattccgcgtgcatgcttttcaaacctctaaacggttttgcaaaaagtttctatacaaaagttgcttaaaaaatcatattgatccaattttttttttaaaaatagctaatacttaattaatcaagcgctaatataccgctccgttttctgtgcgtcggcgctctatctcattatcctctcgttggcgcgcgcgctctctctctctccagcctctcatctccctctctctccagcctctcatctccctctctcgattcaaagggacagtggcgaagccaccgtaggggccagggagggccaacacccccctaacctctatgtgacctcccctcccctctcttatcccaaggatgattagcacttataatctagctattaattatatcattagttgcagatgagactaactatataggacaggacaactagctagctatatatatataggacttatgaaatgacttagctaaatgatttatcattttagaagtgattgcaagactccaattaatgaaacaaactgttcaatcatccatatattaaaaatattactgaattttaaattggcaaatcatgatatatgggttcttgttctctcttgtagctaatcgctgtaatatgtatgatatcgagttaccgatcatacatcaacgctacaaaatcactgttcactaaaccttaagtgagttgccatgtctcgtagatggcaccctccatctctaaatcttggcttcgccactgcaaagagaagccgtcatggcggtgatggcggcaaggggagctggcggcgatgaagtgtacgcggcacagtggcggtttcagtggtggtgaagcatgggacgcggcggcggctcgaggaggggcagcacgcggtgaagcatctaggcccccggtgttaattttagtaattaatgacaagcgctaattgtggactaaccgttgtctttgagctatatattttaagttaggtcgacgtcatgtgtgcgcatggatgactatcgatggattaaaatttgatggcgcgaagcgaagaaaagaagacggtaaaactagtgctttaatttagaattgatcgaggtgtagggcgatcaaatttgctagtttattttttagtttcgccgtactattaagaggggtaatgacctagcaaagagatgattttaattgccacattaggtcattgcattttcacttgtgctcacatcttcatagcgcgcacacacaatatttcactcggctcggcctgaccaggggcggtctgaccagccacatagtggcggtctgaccggcgtgccctggccggtctgaccagccgcaagaaggcggtctgaccggcgcataaggccggtctgaccggcggcacatgcgcggtcagaccggccccttggaggccgggatggtgctgcttggggtggccgatacagagccgatggagccgtagtcagtgagaccgagccgatggcggtctgaccgagccgtggccggtctgaccgcccactcaatgccggtctgaccggccaggccgatggggccctctgacagctcttcaatggctagttttctagccgttgcagagtagcacggtctgaccggccacatacctccggtcagaccgacagagcacaatgatttgggatttcgcccccaatggctagttttggtgggtgggagtataaatactcccccaccagcagcaaggggactctcttggcacccaattcaattgcatacatcctttgcacctctctcacacctacttgagttttgtgttcatccatctagtgtgttagaaggttgattagccaagagtcaagtgcattgctttcatttgtagagctagtgtggcacttgattgatcatctccacgccgggtcattgcttgttactattggaggttgccacctcctagacggcttgtggaggagttgcccggtgacctctccgagaagattgtggaggaggcccggcgccggtttgtgagtggtttggagttcaccaccttcggagtgaaggaagaactaccctagtgattgaggcttgggtagtcctctccgtgggccggctcccgccttacccaccccttgacgaagggggcgtgcggcggcttcgtggttgagcggtggagttgggctcgcctcaacagggagtaggaaactggcgagtttccaaacctcggggaaaaatctcttgtctccttgtctcatttgattgtcacatttatatttgtgcaatttacatttctagagacatacttgagatcatatcaccctaggattgctaaacattgacataggagtgtgatttactttcctagagatataattgaaccactatcaccctaggtttgcaaaacataacttagttgcttagttagagttgaccctcaccaaccttagcaccttaggttagttttgattagttgtgttttagttttaaatcgcctattcaccccccctctagtcgacatctcgatcctacaagtggtatcagagcttggtctctcttgattgggcttcaccgcctagagagaagatgtcgaacgaggtgaaccatgtagggaaggctctcatgtttaatggcacaaactattctatttggaaaattaaaatgtctactcacctcaaagctatgagcttccatatttggagtattgtggatgtaggctttgctatcaccggcacgcccttgacggagattgatcaccgcaacctccaactcaatacccaagccatgaatgctttgttcaactctttgagccaagaggagtttgatagagtgagaaaccttgagaccacatatgagatttggaacaagttggcggagatccatgagggcacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagggctctaccggagaagtatgagacccttatcaccatgctcatcaactccgacatgtcaaggatgacaccggcaagcctcttggggaagatcaacaccaatgacatgtacaagttgaagaagaaggagatggaggaagcctcaccttctaaaaagtgcattgccctccaagccgaagttgaagactagggcaagggcaaggtgaatgaagccaatgaggacttggaggaagagattgcccttcttgctagatagttcaatgatctcttgggaaggagaaaggagagaggaagaggctccaactccaataggagaagaaatagaagacccaacaagactctctccaacttgaggtgttttgagtgtggtgagaagggacactttgcttcaacactttgcttccaatgcccttccaaggatgatgatggagacaagtcatccaagaagaagagtggaggctacaagctcatgaagaagctcaagaaggaaggcaagaagattgaggctttcatcggggaatgggactcaaatgaggagagcttcgcatcatccgggtccgaggaagaaggtggtgatgatgcaagctccaagaagaagaagatggtcgttgttgccatcaaggaggctccatcactcttcggtccactttgtctcatggcaaaggactcatctaaggtaacatcttttaatgatagtgagagtgatgatgattgtgataatgtttcctatgatgagcttgtgagtatgtttgaggagctccatgcttataatgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagctctaactcttgtgtttctatttgtgatgcctcacttgttgttaaaaacaatgagcttaaggagcaagtggctaagctcaataagagcttggagaggtgcttcaagggtaagaacactcttgacaagattttgagtgagcaacggtgcatccttaacaaggagggacttggattcattccaaagaagggtaagaaaccttctcaccgtgccactcgttttgtcaagagtaatggtaagtattgctccaagtgtcgtgaggttgggcatttggtgaatgattgccccggtggtaagcctcctaagacatgcatgtttgattctcattatatgcttaggaaggctcatgatggtagcattgttgatagatatgtgggttcccctatactcggtggtaaaaagaatgccatttgggtgcccaaagctttggtctgtaacctccaatgacccaaacaagtttgggtacctaaaagagcttgatcttcttttgtaggtgaactactgcaccggtgggagccattaggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgctttcttcccgcaagaagttattgtttctaaccttcttgacaagtcttgtgtgttcaaaggttttagatatggaaatctttatttggttgatttcaattctagtgaagcaaatttgaaaacttgtttagttgcaaaaacttcattgggttggctttggcataggaggctagcccatgttggcatgaatcaattgagcaaactttcaaaacgtgatctagttgtggacttgaaagatgtgaagtttgagaaagataagctttgtagtgcttgtcaagccggcaaataagttgcatgttctcatcctactaagagtatcatgtccacatctagaccattggagctctttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaggataccaaaggatggcatagtagggtttcatttgcataaacagcatttaataaacatttcagaatttaataaaacagttaagtaataattaatcaatattaaaccaacgctatacaacataccctgttgcataggcccaaccattctgaacaaccatcccggctgcacagttctatctccaaaccaggaatataccattccaaaccaggagctaaacaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacgatgacgtcagcggcgacgtcacctccggcggcggctcggcggctcagcggctcgggcgcgcttgctcgccggcgaacgacggcgcgacgacgcggacggagggcaccaggacgtagagcgcggggcggcgaactcaccgatgaccaaaacgtcggcggaagatgaacggacggcggcggcgacgagaaagaagcggcggagaccttcggcttgacgacgacggcggtgctccggcggtctacagcgacggcgaaggggcggacgaggacggcggcgacttggcgaccacgatggcgacctccccgagcgatgacgacgaccggaacgacggcgaagcacggctggagcgacggcgacgactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccacgaacttccaaagcgatttagacgatgattccaaaagagaaaaggtagaggagatcccgaagattgtttcccctctattgatttcaccggatcgggaaagacgcggccaaatttggaaagcggcggcggcgacttggcgctagggtttcgggcggcggcggccggaggtagacgaagactgacaggtgggccccacctgtcagtgggcggacgcgcgcgcgcgagcggcggctgctgctggactgggccgactgggccggggagagagagagagattttgggccggctttcggcccaaagccaaaagagacttttaaaaaacctttttcaatttaaattattcatgaaatgcaattccatttattaaaaatacttccttagctcaaataaatcccagaataatctaggaatcatagaattaagcaaagtatttaatgaaattttatctagccccattttatattggaatttattaattaaaattagatcttctcttctaggcttttaaaataaattctaataattccaattaaacaacaatttatatattttggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacggataactcgatttctggttcttctctcatctatttccaaaatacggattggtttctcaacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcggtgccaattttcctttggtgtgaacacgatgaactcctcgaagaggcgtgacacgaaggtacacataatctccttcttcaaaactcaaatctctgcggcgattgtcggcataactcttatgacgagactgggccacacgcaatctttcttgaatgatctttaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccgaagtctaaagcacaagctctcaacatatcttccaaaatctgattcaccctttcggtttgtccgtctgcctgtggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgccaaccgacttccggaataagttgtctttactgggatgaaatgagccactttggtaagtctgtcgactatcacccaaatagagtcatggcctgatgacattctgggtagaccagtgatgaaatccataccgatttcctcccatttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacattttggtactaccagggtgaatggagtataaagtatcatgagcttctttcagaattgcatcttttaaatctttgttgtcggggacgcagattctctcacccaaccatacagttccttgctcatcctccaagaaaccgatagcttttcctcttctcatattcttcttgatttcttgaatatcagaatcattaatttgggcttctctaacttgatcaattagagtgggcttcgcttctaaggctgcaacaaaacctctactgacaattcccaaatttaatctttcaaattccttgcataattccaatggcaactgtcgtcattccgtagcattgcaatagcctttcctgctaagagtgtctgctacaacattagcctttcctgggtgataatgaattcccatgtcataatccttaattaattccaaccatctccgttgtctcatgttcagatccggctgagtaaagatatactttaaactcttgtgatcggtatatacctccgtacgagtaccgaaaagataatgacgccaaattttcaatgcatgaactactgcagctaactcaagatcatgagtagggtagttcttctcatgcggacgtaactgatgagatgcataggcaaccaccttcccatcttgcatcagaacgcaacctaacccaagtttggatgcatcgcaatacacttggaaacccttctttggatcaggtaaaatcaaaataggagctgatattaagcgattcttcaattcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaactgtctttggttgttttcaattagttacggattccacattgctaggatcgacggcaactcctcctgctgagatgacgtgaccaaggaacttcacttcagacaaccaaaattcacgcttactaaacttagcatacagttgatgttctcgtagcttctctagtgcaaggcgaagatgttcctcatgctcttctctggttcgggagtagataagaatgtcatcaataaagaccaccacgaacttgtctaggtattccataaacaccttattcatcaagttcatgaagaaagcgggggcattggtaagtccaaaagacataacagtacattcgaacaatccatacctagtggtaaaagccgtcttaggtatatcttcctctttaattctcaactggtgataccctgatcgaagatctatcttggagaaaacggtggcacctttaagctgatcaaacaaatcatcaattcggggcagcggatacttattcttgatagtcacatcatttagtgcacgatagtccacacacatcctctgggtatgatctttcttttccacaaaaataaccggagctccccatggagatgaactcggtctgatgtatcctttctgaagcaaattgtctacttgccttttgacttctgccaactcattggctgccattctataaggtctcttatggatcggagttgttcctggtaccaaatctattctgaactctatatcccttttgggcggcataccaggtaaatcgtctgggaacacatcaggttactcctggactataggaatctcttccaaagttatttggttcagtcttgaccttaaagactcagaagacaatgcatgaacagttacaactcgaccatcatcactggtgagaattacttttctgttagcacagtctatcacacctttatatctggctaaccagtccatccctaggatgacatcaaggtctttggattctaacaagataagattggccagaaatggtactccttgaatttctattctgacagaggggctacgttgcaaagagagtgcctgattacttggggtactaaccaacaaaggacgtctaatatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcaacatgattgacacgggcctttgatgctggtgcggtagagttgctctgggcagggacaaccttcacacgtcggggcttcggacacttatcagcgtaatgtcctgggtctccacagttgaaacacaccacgggattgctgccttgctccttcttggcaggttgttgctgtgtcgaagctgcaacagggcgtggagcttgattgcggatgttgttgccagcattgttgttgaagaactgacgctgcggacgaacaacggacgaagaacctccctgtggcatggactggggtcctaaagtaagacgcggcctctgattattcccctgttgtgtcttgaagtgagcaatccggcgtttcttctgctccatgcggttgtacttgtcctcctggcgaatagccttatccactaacttctggaaatcaggataatctccagtcatgagtggataagaaagctcatcattaagtccttccaagaacttctcctggcgctcttcatcagtgcgtacatcttctggagcatagcgagccagacgattgaactcgtgcagatactccgtaacagagcgagacccctgagtgagcgacctgaattccttcttcttgagagacaccactcccgatggtatatgcgtcttccggaaagcagcggtcaagccaagtgataggttcagcagtagtcctattcaggcggaagtgatcccaccattcagatgcagggccatgcaactggtgtgatgcaaatgagaccttctcctgatcggtgcactgaagcaaatccaacttcttctctatggcatgcagccaatcaccagcttcaacaggattagtggtactagagaaagtgggcggcctcacacgaagaaattctgctaacttgttctggggaggtgcatggttatttccctggttctgctggttctggagttgctgcatcatcatgttcataagatgtgcctgttgagccaggacttgggcaagtgtgggattctctccattgttgttgttattgttgttgttgttgttgaggccattcccgttgctgcgagtgagcaccatctggcatgggcaagagcacaagaagagaaaccggggaaaactacttaggactgagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgaggcacacacaaccaaacttaaaacaagcaaactaacacaacgatctaagacaacggtttgacaaggctttctaattcttccgggcatcggagttgattgaaggctcgttcggctcgtcttcatcatcttgaattgctccccactcgatcttggaatgggtgcgcttggattcttctacttcatcatcacttatgttgacgaccggagaatccgctagggctggggtaacttttttttccaccacacggacctttggcgccaattggtagcgatggacaaatagagctctcttccttgcggtaagacgaaccctggccttctgcggtggtgcttctcccttcaacgcggctagttccttctccaaacgatccactttgtcttctagcttgcaaatcttaccacgattccgatcttcacgatcttgagctgctaacacagtctccacacggctttcatccatagcccacagcatctcaaccaaatgccttgtggtagcatcattctcaattccttcagtcttaaggtagctgccacggtcacttccctgtggttgacggggatggtagcgatactcagtgtcggccaactgatcactgtagcgatcgcggagctctcctatggcgatccttgccacctcctgacatgtatggatgtagtttcttcctccagcttcgaacatcactgaggggatatcttcactattactgttcaaggtgactttgactccgcacttctcttcgtgacgatcatgaggaatctgggcataaaaaggagcagtcccaaatcctatggcaaaggacatcgtacgcaactcctggacaaatccttcaacaccaaacaagtactcaggcttgtagcgcggcatctaaagacaagtgaaaggagggaattaagacatttatccaattaatagcacaagtttctggattaatttgaataaagttagaaaatcaaagtaaaaggtaagtaaataaagtaaaccgagcttgcaagataagttgaaacagttggaaacgaggtcacaaattttgtacttttgaacaacaggttccaaaagaaataaaagaaagttataaaatcaacatgctaaatttatttcattgcagcaagattaaataaaacaatgttgtaaaacttttgctggtaaatgagctattagtacagtaatagatgtacagcactaataacactggaataaacttttgaatacgaaccattaaaaaaaatattatgaaatgcatgtgccattagtttggtttaattaaaagagaaggggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgccaggggagtatatgacatactcagcaagtcacgcagcaaatatgcaagtgcacaggataccaaaggatggcctagtagggtttcatttgcataaacagcatttaataaacatt

SEQ ID NO: 13182 - DNA, 1349 bp, Oryza sativa
  unsure (1)..(1349): unsure at all n locations
ggttttgggcggcggcggccggaggtagacgaagactgacaggttggccccaactgtcagcggcggaacgcgcgcgcgcgagcggcggctgctgctggactgggccgactgggccggggagagagagagattttgggccgactttcggcccaaagccaaaagagacttttaaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaataaattctaataattccaattaaacaacaatttatatattttggatttttagggtgtgacactcttgcatatggatttctttggcctaccaacctataagagcattggtggtaatagtcattgtcttgtgattgttgatgattattctcgctatacttgggtgttctttttgcatgacaagtctattgttgccgagcttttcaaaaagtttacaaaaagggcccaaaatgaatttaattgcactcttgtgaaaattagaagtaacaatagttccgagtttaagaataccaatatcgaggactattgtgatgatcttggtattaaacacgaactttccgctacctactcacctcaacaaaatagtgtactggagagaaaaaatcgtacattgattgagatggcaaggactatgcttgatgaatatggtgtttccgattccttttaggcggaagacataaacaccgcttgccatgcaaccaataggctttatttgcattatctcttgaaaaggacttcctatgagctaattgttgggaggaagcctaatgtcgtctattttcaagtttttggttgcaagtgttatatttaccgaaagggtgttagactaaccaaatttgaaagtcggtgcgatgaagggtttcttctaggttatgcctcaaatagcaaggcataccgggtctacaacaagaacaaaagtattgtggaagaaaccgacgatgttcaatttgatgagactaatggctcccaagaggggcacgagaatttggatgatgtaggtgatgaaggcttgatgagagctatgaagaacatgtctattggagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13183 - DNA, 4969 bp, Oryza sativa
tcaaatgtattaggaaaaatggaagatgcacaatgtgaaaaggatctgctggatttctggactcttgggtagcgtacacaccttgtgaataaatggacttggtttaccggcccaataccatagtactaggcccaacaagatgtcaaggttggatagagaaacaggtacagggcaagcaaactcaaaaatgaaattccactcgtactaacaaagatcgtctaaatttaaaagagctaaattgaagtaggcagtccatcattggatggagaaaaaggattaaccaatttaacgtaagagtgtaagacgctctttcatggaacgtcaaatactaacatgttatcagatttcagaaccaaaggtgtctttcgggggaaaaaaggggaattcggaatcaaaggtaacatagttaaatacaagaggggactaccctgtagttaagttaaccctcgcagaaaggggaaaaaaacagcactagcagctagtatcagccgtattaccagtgaggatatacagaggcagcttgaaaaaagcataggcatctgaagttctttccggcgcgaacgatgataatgatgggctgatggcttggaattacaatgctccgcatccacaaagtgatcgagtctaacaaaagcacgcatgctgtatatagccgtcggcagaaagcaagctatacacgcatagattgtgtgagatcgacgacctgcagaaacgcgacgaaatccagctgacaattaccgacatggatacactacttgtggccgaagcagacggttaattgtgaggctgcaggaagacgggtgcatgcatggacagcgtgtgtgcatcgtccacaagatgaaaagactgaagaagtggtcgaaggagatggtgagattgtagcacgaaaaggagcgtgttccccggcgcggcacatacgtcgtgcgagacagatccatcccccgttccaatccaattggcccacccctgtatacatctcctcgccgcggcctctccgacgagggcgacgtcttatctcgatcggtacatgcaccaagctagcttgccaagacttcgtgcaattgtgcatcgatttttagggtttgggtcaagacgttcgtgtttgtggagattatggataccctatatctacatgacagttataatttagtcggatatatggtaccaaatataaatagaatatctctatgaggacttggtagaatatctctatgaggacttgggttagattctaaacttgtatgtcaaggaaatatccgggatcttagtcggttacgattgtattttatctataatcccatattccgttaggatatggactgtactttgtaaagcggattccttcccctatataaggagggtccgtgtgcctctcggggcacgattcttttttccagtttatacaatcaataacacactcggcggaataatccccggacaggagtagggtattacttcttgaataagaaggcctgaacctgtataaaattcttcgtctccaaacccatccgctttcctaacttgatagccacccccttttactattgctgaaatcttgtttcgacagtgttagagatcgatggttgcatatgcgtgcgtttgcggagcaatatgtcaagaatgcgcgtaagccctcggacggagatcaaggcacatcaaagaagaaagatgatgaagacgatgccccgactggttttcaagatcatcgcaaagaactcaatcacatcttcagcggacccctggcttatgaatctaagagaaagcagaagtgtcacgccccgaattagtcccgaccggaactaacccgtgacgctccaaattaacctgttaatcgataccagtcccaggaaacagtgctggtatcacagggagacagaatatcacagcaacagaagtctcttcattatagagtagaagtacagtcatgttgggctgcggacagatcccgagctcacaactgcattacaaaaggaaagcggaagccaggacttggaccaaacaatcacaggcgcgacttgggaactaggctgaaaccctaaaactcatcgtagccggcttgctcctggaagaactccttatcagcaggatccgcttcatcttcttcagcaactggggggggggggaaatatttatatagagcaagggtgagtacgggagtactcagcaagccaggggaaataagtgtttaatgcaggcttcaaggaaaggctgttgttttttttttttgcaattgattttatttggaactcttttctaaaagcaactaagtgagtgcttctcaaacgacacggatgagacagtgcgtctcgtccggtcggagtatgtgcaatgtgtcagtctttagatcttgaaacaaggttggcacccggccaaaagctttttgaacggccacccgggccaactcttttcaaacggccacccgggccaacaacttttaaactgccacccgggcctagctgatcccatcagctgtaggttttccaaacatcgaacccagtttcacaacagcaatttcacaagcagtagtcaaacaaaactacgctaggaatcacctcacatccgcccatgaccgtgggcacggctgttcgaacagtttaatgacctctgcagagggggtacattttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgttccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccgagtcttttgtaaaactccagttttacccaagttgttactcagattttaagtttgaaggcgaccgtcgatactcgcacagagtgcacgagtatcaaggcgcaactgggtggttacaaggggacatggcatagcaattaacaatggaaggatcaaatgtgacaatttaggtaagtccgccaatctgcttcgcagacgggacaacagattaagtgtgatcctatcaatgcataatattttgcaagcaacatacttaaatttcaaatataggctcaagatgttcaaaggtggcttgccttgctcgagatctggagcttgatcctcgaaatcctcgcactgcgggtcttcgggctccgaaactacatgcgaaacggggcaactcaacaaacagcgaaaataaagccctattaatgacctctaagcgtgccactagatagatctcgagatttgatgaattttggaatttgaacggaatcaaacggagttacggttgggaagatattgaatttctaagattattggattttggtctaaaggaaaaaggattaaattaaatcctttttttttggaaaaagaaaaagaaagaagggagggagggaatatagacttttctcgggcggctagggcgcggcccaaaagatttggggcggctcggccgagcttaacaggccggccggcccaagacggcccaagcgcgcgcgcgcgtgggggggggggagaggagagagagaccggtggaccgggctcaccacgcgcggtcccgggtgggacccgcttgttagcggctcggctcaccgtgcggagggagcacgcggcgcacgcgcgcgggcggggaggaacgcggtgtacgcgcgcggtttgcggtggacgcggatgcgacgggcccacgcgcagcctcacggctcgcggtggaacgcgcgcacggggagggaccgaccggggtcggctcgacccggtctaggctgagctggcgccgacgtggcgcctacgtggctgccacgcaggccggcggaaggtagacgacgacccggccacgaatggacggcgggcggcggcggcgagcggcggagcgaaccacggtgatacgggcaaaagcgagcacaccgggcggttgttcgcgacagggggaggcgagccaacggctcggattcgccggaggttgctcgacggcggcggattacggcggcggcaaccggcggcgggagaagagggaaacggcgacgaggctacgaggggtcgattcccgtcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggagaggagacggagcgaggagggagaacagagagagacatcaccgggaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcggaggacggcggaggcgagacagagcacggggcggcggcaacggcgcggagacgaatggaagaggaggggtaaggggaggccgggggggtttaaaggggacggcaatgtcggtttgagaaccgacttggcggtcaaggcgcgagctggcgctccggctagcggccaaattggtgacaggggggatgacgccggcgggaggaaaagggaaaaaggagggggagaaagggggcttgcccctttgccggatcgggaaaaggaggagggagcgggggcgacgcgccagg

SEQ ID NO: 13184 - DNA, 8500 bp, Oryza sativa
cgcggtggtttgaacggcgcggctcgggcgacaggcgcgggctggcgggaccgggcggcatccacgcgggcgcgcgcgagcaactgcacgcggggagcggtagcgagggatggggagacggagagcgagggggcgctcggcgcggcggcacacgcgcacacgcgcgcgcggcgcgcgtgcgggatggagcggagcggagggagagaggcgctcggggcgactctcgcacgcgcgagcagcgtgcgggcgaggctgagcggggggggggggagcgcgccggggggagagagagagagggagagagagagagagggagagagagatgggccgagcggaattcggcccatcgaaccccgggggaggcaaactaaactttgcggagggattcgatttggaaggatttggattcggatttgaactcgacgatagatcggggattgagatcatgagatggcacgggcactagacaacaagcaaggaaacaaatttcgcaattagggtttttaagagttaattttcccgctaggcgccacgacggaacgggcgctacaagaagctaacagaacgggagatcaatgcggttcagcctaacacgccccaataccttcggtggtcagagatagcaattaagttcgaccgctcggatcatcccgaccgagtggtccacccggggcggtaccctctggtactagacccagtggttcgcaatgtcaagctccgacggactctcatcgatggtggcagtgcactcaacatccttttcgctaagaccctggacgatatgcagattcctcgcacggaattaaagccgagtaatgcactcttccatggtgttatcccaggattgtcagctacgccactcggctagatcactcttccagttaccttcggcactcaggagaattttcgcacagaaaacgtttgtttcgaagttgctgatttcgagacagcataccatgctatactcggacgaccggttctggccaaattcatggccgtcccacactacacctacatgatgatgaagatgcctggtcctcgaagggtcatatcactacggagcgacatcaagcaagccgtcacatgtgacaaagaaagttgcgagatgacccaaacccacgagatcactctcgctcgcgaagagatccgactggctgccaccacggcaagcgaaggagaggtgcctccgaccaagctgtcaaagaccgaagaaggcgacgacaagactaagaagatttcactagatccctccaatcctaccaaaactgctgtaataggcgccgagttagattgtaaataggaaagcgcgctcatcacctttcttcaaaataataaagatatttttgcatggaaaccatccgataagccgggtattcctagagaggtgattgagcactctttacatgttaaggaagacgccaaacccatcaagcaacgactccgccgttttgcacaggacaggaaggatgcgatcaaggaggaattaaccaagctgttggcagcgggcttcatcaaggaggtccttcatcccgactggctggctaacccagtcctggttcggaaaaagacggggcaatggcgcatgtgtgtcgattacaccgacctcaacaagtcttgccctaaagacccttttgggttacctcgcattgaccaggtggttgactcaacaaccggctacgagttactcagtttcttggactgctactcgggatatcatcagatccgactaagagaatccgactgcttgaagacctcctttattacgccctttgggacctactgctacatcaccatgctctttggattgaagaacgcaggagcaacttatcaacgcatgattcaaagatgtttttcaactcagataggtcgcaatgttgaagcttatgttgatgatgtagtcgtcaagaccaagcagaaggataacctgatcacggatttagaagaaacttttgcaagcatttgtgctttcaggatgaaactaaaccctgaaaagtgcatcttcggagtaccgtcagggaagttgctcggatttatgatatctcaaagaggcatacaagccaacccggagaaaatcaacgctatcctcaacatgaaaccgccaagctcccaaaaagatgttcaaaagctgactggttgcatggcggcgctcagccggttcgtctcacgactcggcgagcgggggatgccctttttcaagctgctgaagaagactgacaatttccagtggggacccgaagcacaaaaagcctttgaagacttcaagaaacttatcaccactccacctgttttggcctcgccacatccgcaagagccgctactgttatatgtgtcggcgacctcccaggttgtgagcacggtcctggttgtcgagcgtgaagaggaaggccatgttcaaaaagtccaacgaccaatttatttcgttagcgaggttttagccgactccaaaacaagatatcctcaagttcaaaagttattatatggtgtcttaattaccgtcaggaaattatctcactactttcaaagtcactcggccacggtggtcacatcgtttccactcggggatatacttcataaccgcgaagcaaatggacggattgcgaagtgggccttagaattgatgtctttggatatatcgttcaagccacaaacttcgatcaagtcataagctttagctgatttccttgccgagtggaccgagtgccaagaagatatgccagaggaaaatatggaatattggactatgcattttgatgggtcgaagaggcttacaggcactggagctggggtagttttaatctccccgactggagaaagattgagctacgtattgtggatacatttttctgcgtcccataacgtggcggaatacgaggcgctactccacggattaaggattgccatctctctaggcattcgccgattaatcgtccgtggagactctcagttggttgttaatcaagtcatgaaagagtggtcctgtttagatgataatatgactgcttatcgacaagaggtacgcaaattggaagataaattcgatggacttgagctcacccatgtcctctgacataacaatgaggcagccgacagactggccaattttggttcaaagcgggaggcagccccttctgatgtttacgaaccaaccatacccagaaaagaaataattgaagccatggatactcaaggcgtaagcatgatcgaaaccgactggagagaacctctcataaaatttttgaccaagcaagaactccctcaagacaaaaatgaagccgagcggatttccattcgtagcagactttacattattcataagactgagttgtacaagaaaagtccatcaggaatactgcagcgttgcgtgtctttggaagaagggagacaattgttgaaggatatacattctggtatttgtggtaatcatgctgctgcacggactattgtcggcaaagcttaccggtagggtttttttggcctacagctgtgtctgatggtgacaagattgtgcggacatgcgaaggttgtcaattttttgccagacaaattcatctgccagcccaagagttgcaaaccatcccgttgtcctagcagtttgcggtctgggggcttgacatggtcggcccatttaaaagggcagtcggcggttacacgcatctctttgtggctatcgacaaattctccaagtggattgaggctaaaccggtcatcacgatcacagcagataaagctagaaattttttcatcgacattgtgcatcggtttggggtacctaatcggatcatcactgataatggcactcaattcactggcggagcatttaaagacttttgtgaagactttggcattaaaatttgttatgcctccgtggcacaccccatgagtaatggacaagttgagcgcaccaatggcatggtacttcaagggataaaagcacaagttttcgaccgactacgtccctatgctggcaagtgggtcgatcagctgccatccgtactttggtctttacgcactactctcagtcgggctaccggacagtcgccgttctttttggtttatggtgcagaagctatgtttccatgtgaagtggaatttgaatcactacgatttcagaacttcaacgaggagcgctatgaagagggccgagttgacgacatcaatagactagaagaagcccgtgaagcagctttaatccagccgactcggtatttgcaagggttgcgccgttatcataatcggaatgttcgatcacgagtctttttagtcggcgacctggttctgaggaaaattcaaaccacacaggatcggcataaattatctcccttatgggaaggaccgttcataattgctgaagtcactcggccaggttcttatcgactcaagcgcgaagatgatactctcatcaacaattcttggaatattgaacaccttcgtcgattttatgcttaggcatttcgtttgtatctttcctctccgactgctaacttcaagtttttccttgaagttttcagtcggggggctactatgataataatggagtatgatttttatcaattcaatttgcttacttgatttatcattgccctgtttggtctttcggcttagtcaatgaggactgaaggtttttaatagcttttgcgggttttaggctcaataaggcttgacaaaggcttttaagaaatcagaagctaagtatggaactccaagcatagcataaattcatcagtattgtacaaattgagcctccatcatcattaatcatcaaaatcattgttatatcaatcaatatcagttttttcatcatcagaattatcagacccagtcggccgaaggtcgacatcttgaaatctctcaaccacgtcggcagcaatcttgtcagctgctttttgcgcatcattgatgaggtcaagagcaacttcttcgctcgtcccgtctgcaaagccatcaatggcatcaatgtccactcttggataaagggatttggtcatcgccaacgccagacttgctcccatacttccagcttctttgatattcttgaagtaagtatccggagtgactctcagcttgtcaaatatttcggcagcatcaagtgtactcggaccggcgttattgaagaacatggcttggatgagtggagtagcggcattagcgactttatccctggccccttcaagcctattgatcttgtcaactaagacatcaaactgtgcctgggacttgatcttgcggtctgcatcaacagattcacattaacgaatcagcatatagaagataatggcttttaaggtattgattattggtaccttcaacctcctttaaagctgagtccctctgtcttgccagttctgccttaccattttccagagtttgaatctgcttctccagttgagatatcttggcagtttgcactacattgactctagttaatcaagattacaaagataataacataagttagttgggcagagtttgtgtgtaccttttgatgagccgctcagttcaaaattggatttctggagctcagcaatccgatccctcagatcatgttcattcttcttggcaagctcttttgtttcgtgcagatgattcctggtggcttcgagggtcccgagatgagggactaacctctctaaggttgccgttttagcttcgttcctaagatgaatcctctgcaagacagtttaattagcacctggactaaatggcaaacgagacggttgagatcaggcgtcaaagagcctacatttacaatgcgggtggcttggctgagtgcctttttcagcaagcatacctcttcatcttctttttgcttatttattacgattccttgaggctgcatgttgtcatcccaccacttgaccagaatgggagggcgcgaatcctcagctgcttgtatccggaggatctcttcttcatcaccaatcattggtcctaatgtatccatggataacgatcaaacaatcaaataaagtcagttagatcaacgtggtttcagacaaagtgcttacccgtgataatttctggatgaggacgagtggactcagatgcctttgaaggagatccagaccttcggtcgtggctggcatcttgaccgcgaggactatctgcttgagctccaacttctggaatctcttggcttggcttggtgtccgactggttttcagtcgggggctcctgattaattccggctccagcttcggccgactcatttccggtcgggggttgatcaccagactctacattatcggttgctggctggttgtcactcagctgatcctcggcagttggctcggttccttttaagttcgtttccctgctggtcggctcagaatcttttccagaaggatctatatcagatggtttcctgcaagtttgattatcagtattatttcctcactgggtgtgcatcaatgcaagggagatcgttatatgagttgtacctagaagacttcctgatctttggcacaggacgactggatgttttttttccttggagtaacctgcttcagcagtttcttggttgcctctcggtctctgagctttctagcagtgtcgccttcgtcgtcacttagaaccagcttcctcttgcgagaatctggctggccgattggatcagaagcacttagttgagtttcagaccgaattcttggtcctccgcttccctgaccagattggcggcgaggtgattggtgctgggaaattggaggatttgacttcatcaatgcgaatttctgagcataaatgtcaagcaatttaacgagagatgaaatcatgtttttgaggaaggttggacgtttgaatacataccggtggaggaggattgaatgcattgaacggtaagactggcaacaagtgtgaatagctggcaacaatagcatttgagaagatcttatatatcctttctttcataaccttaaagttaagagagtctggatcttcacgatttggatcatgtttgccgtcaaactcaaaagctgtgcgggacctctctttgattggggctaaccgacacttgataaagtgccgggtgatctgttctccttgaaggccttgttcttttagctttatcatcctctccatcagttccactgcttgcgcagcttcatctcccgttggcaatgagttccaagtatcctgataaactggaggaagacaggagtattcggggagagcaggctcagggttttgacaataaaaccaattcacatgccagcctttgtttgaggttttgaagggcatagagaagtatttttggcttaaggttcccctgagttggaaaccagcccctccgacaacacatggtttgctcttgtttggctgaggcttaaggaagaagatacggcggaacaaggcaaaatgaggcctaatgcccagaaaagcttcgcagacgtgaataaaattggcaatatgcactatggagtttggattcagatgatgcaggctgattccgtagaaattcaaaattccccgaaaaaatcttgaggttggaagggagaaaccgccatagaagaaatgagcaaataccacgatttcatgcgtatcaggggtcgggaatgcttcgccgaatgccggtcgccacccgatgatctcctttgctagaagaacgccgtgcgccaacatctccttcagattatcttccgtcacatcagagggcgcccactgactctcgaagctttctcttttttccgccatgaatgtggactggatggtttgatttggtccgagatacggctggaaagggatggggaatcggagcggtggacgcggggagaaattccgtgaactttttgaggatggattggagcggattgataaaccctagtttggccggcgcagtttgtactgtagcaggaaatggggaaaatggcgagagtttcggtggggaagacgaagagacgtttttcacttcggtgatattagggtatcgggagtgctaacaggcctgggcctgcacagtacttcagcctaattttatttccgacgtggcccgttgtgatccttagagacttaggcactttttgctttggcaatttgtgctcacaatgatgtggcccaatgttgttgaagaattggatggctacctcaactcccccggcgtcagttctcgaccaaccgagatcctcgactacgacgacttcggctaccactacgaccacggcgaccccgacaacttcgatgacggctatgaggacaactacacgcccctcttcttcggcgtattcatggctgacaacgaaacggaggaatagcgtcgagcccgagaagcgaaccaagatcgcgaacggcaagaagctgaacgtcgccgactggaggaagagcgacagcaataggagcgagaacgactacagcgtgagcaacaagatcgcgaacggattgcaaaggaggctgaagatcgacggcaacgcgccttggaatctgggcggcgagcgagagagctcattgggcaacaagacgtcgatggaacaacggtctttcgcacccccccagcagaacgcggttgcag

SEQ ID NO: 13185 - DNA, 22702 bp, Oryza sativa
acatcttgaaccagacgaagaccatgatcgctgcctgcgttgcagccaactctgcaagcacccgcaccccgactgggtagcgaagtccttaatcttcgatctcaagactatcaccagccaagcctcagcattgccggcgccggatctagtcaaaggagcaagggacatgatgaacggtctgtttgttcgcctcccgaacgatatagggagcgtcgagttgaacgaccacactccccacatcgaaggcgccccatcgatcttcgcgacaccatcaaccagcgccgtgcagcaagaggccatcattcaccggatcgctacgacgacgatgtggacggagttgctgccttcacaagcgatctgcgtcgagtggattggccagccggctttaagccaactggaatcgagaaatatgacggcaccaccaaccccgagtcttggctcaccgtctatggtctcgcaatccgcgcagcaggaggagacaacaaagccatggcgaattatctacctatggccctaacggattccgcccggtcatggctccacgggctaccacgcggcacgatcggatcatgggcagagctacgcgaccacttcatcgccaacttccaaggcacttttgaacggcctggtacacacttcgatctctacaacatcattcagaagtctagagagtctcatcaagattacattcgacgcttctctgagcaatgcaacaagatctccgacatcacggacgacgtcatcattgccgcctttactaaaggcattcgccacgaggacctagtcggcaagtttggatgcaaacctcccaagacggtcaagcagatgtttgaaaaagccaatgagtatgccaaagccgaagatgctatcacggcgtccaagcagtcgggcaccacttggaagccaaagaaggatacgccgaccacaggagggagtggaagtaacaaccacaaggatcgcaagcgtaagcccgaagaacttgtggcgacaacctctccgtcttcccgacaacgttcccgcgtcaacaccttcgacaagataatgaactcccaatgtccgcatcatcccaactccaaccacgtggccaaagattgcttcgtctacaaacagtttgcggagcaatatgtcaagaacgcgcgtaagccctcagacggagatcaaggcacatcaaagaagaaagatgatgaagacgatgccccgactggtttttaagatcatcgcaaagaactcaatcacatcttcgacggacccctggcttatgaatctaagagaaagcagaagctaacagaacgggagatcaatgcggttcagcccaacacgccccaataccttcggtggtcagagatagcaattaagttcgaccgctcggatcatcccaaccgagtggtccacccagggcggtatcctctggtactagacccagtggtttgatgaaccctagtttggccggcgcagtttgtactgtagcaggaaatggggaaaatggcgagagtctcggcggggaagacgaagagacgtttttcacttcggtgatattagggtatcgggagtgctaacaggcctgggcctgcacagtacttcagcccaattttatttccaacgtgtcccgttgtgatccttagggacttagggactttttgctttggcaatttgtgctcacaatgatgtggcccaatgttgttaaaatcttttttaatgtggtttgataattctttagaattaacacgatgcaaacaaaaggtgcccgacagaaaggtgttataccgtttttgtaagcttcattaggctgcaaaagctgtttgggttgatttgagatgactggtttattaatagtcattcttttagcatgttatatgcttattttggttatggtaagggtcacagcctaggctattagactcattaattaccatgatttttttatcatgtttggtggatcattttaagagtttcttactcggattcctatcaaatatgtctatttttggaccttttgagtgtttatcactcggtccttcttgtattttttgtccttgatatattcaagttgagaagcagtcggctgggtatcttactaagtaccatgcgtgcttcgctataaaaccactcggttctttattatatgtttagtttttcaactaaacacatagtcgggggctacacctaattaggtgcatctactcgatgcaccatgttttattttcgcccttcgcagtctttgattttagcactcggcaagctggagcaagttgaattgaagcactcggattactgttttttgtttcgagaaggctattattgtcaactgcgaaggtctcgggggctactgtggagattatggataccccatatctacatgacagttataatttagtcgaatatatagtaccaaatatagatagaatatctctatgaggacttgggttagattctaaacttatatgtcaaggaaatatccgggatcctagtcggttacgattgtattttatctataatcccatattccgttaggatatggactgtactttgtaaagcggattccttcccctatataaggagggtccgtgtgcctctcggggcacgattcttttttccagtttatacaatcaataacacactcggcagaataatccccggataggagtagggtattacttcttgaataagaaggcctgaacctgtataaaattcttcgtctccaaacccatccgctttcctagcttgatagccaccccttttactattgccgaaatcttgtttcgacagtgttagagatcgatggttgcatatgcgtgcgcaccggcagagatcgagacaatgttaataagtttgtgcgtgcgtgcgtgccccacggtcgttgaactatgtggctcctcttaattctgcacgggagaacagcaattgcgttgcgatcttgcctggaataacgctgtacggtgatggatcgattcactgttagcgctgtgtgttcttcatatcgatgtcggtgccgacacggacatctcacatcgctcttgtacgtactactcctatgtacgtaccctgtgagagcttttgtaacgtgaggctggttccgatcgaacgcatggtcacgtactagtgtacatgacctgatggacatggatatattgtcccctgtctcattctcgtatagtatcaccaactctgttttgttaaggatatactatatccgttttaaaaaaatcaacatagaaagagatgtgtcttctcctataacaatgcatctagacacggttataggttgattgatgtgacttctcctataacgatatatctggacatggttttaggttgattttttttacggagagagtatagtactccctccgtcccaaaaaagacaaaccctggtttccatgtccaacatttgaccgtccgttttatttgaaaaaattataaaaataagtgacgcataaagtattaaacatgttttatcatctaacaacaatgaaaacactaattataaaaatatttcatataagacggacagtcaaacgttggcacggaaacctaagatttgacttttttttttggacggagggagtactatgcaagtgcagataaaatcgattaatcaatctatatatatactcggcgtgcgtgttagcttggcatagaaatacatcgtggcaggacaggtgtcgcaccagctggtgcaggccggcatctaggaggccaggatgggatcatgggagtagcacttttaaccgcgcaatcgtgcataaatttgaggcgagactgccgcgagaggtcaggccaatacgcgctaggtaataaaagtcgcggattcctcacccagttgcattagcgcctgcgtcgtctcttcacgtttggcgtcacggccgggtcccgccctgattgacgaagaatactccttggaattgtggtctcctgctattcgctctacgtacgttcccatcttgttggagcgcggccgactcgtcatgcgtagcccggtcgctgattactgcagccacgacgacgattcatgtatacgctgcttgaaaaattctgcttgtgctacctacctgctcgaccgctgaactttcgtccaataccctgatagtactagcaccttgctttgcaagttcagtaatcactagcttcctccgttatatttttttctacatagtgcaacgaatctagccacgcttaattagtcgtgttggtgtttttttttctgccaatacataattcacctaaatatttgcggtgttaacagagtcaccaaccatcttctacatcaagatgggttttgaagattaaaccgataagcggagcttgtttagagatcaaaccagcatctaggctgatttatatcgatttgaagataaccgccggtctcgtgggcgaatcggaaagtttacgggacaaaccaataaagatgtatcacactctcacagcgaaaacgaatgatttacgaagtaattgataaagatggactaaactagggaaaaatagaaggcatagctaaaaagtaaaggtaaaaaaaattcaattgattatgtagggattgaggtcgggggttaaaattgaactggtcatagctcttagaaaggggttggttatgcctccacagtttttcttcacgtcctattaggcttatagatcagtgttgggggaatggctccggatgaaatggctagccttcgaagggcttgcagggcttcgaggagccattctccccagggagatgacctagggtgaatactaccttggagctccgaacggagcccccgctccggagacaaccaaggatcccggagagctgtcacggcttcgaaagccacctcgagctccagagcccaacgaggcttcggaggctgcccatggggctccggagatggtcaagaactccggagcatctgtggcttccggagcctcgcgagggcttcgcatgccggcaaggtttctggagctagcagcgtggcccggagggaatcaaggctagtttgaggaccaggcgctagtgggttagaatgaatgcgcactacgcgccctaactacccctgacaccattgacgatgacgagacggcgcacgctattacccggagcaggcctttatccggttaatagtgcgcaccctcgggaataggtgccgctcccttatggggcgcctcactcctatcaccgggaattttactaatagcccaagggctggccggggccagccactctagattcactataggaccaagggcaataaagaaatttcttcttgtatacccttgtataaatatgtaaacattgctcacagttaagcacattaaatacagaggaatacacatgcacttgttgagttttgtcccaacaatcagttaggactcaagaatccttaagcccaaataagaaaacccaagaaccaacaaatcaaacttagagtaatcagactgggcccacaccatcggtccgaccggctatatgagagcgatcagactggccacatatggtaaattagggttttttttttcaaatctgatcatgtttctctatttttttttgaatgactatgtttttctatttttcatctgaagtgttaaatttaggtgtattaacacgtcatattaagatatgtctaatattctatagtaggtagtaacattttgaaagagatgcagtatatatagatgatgatgaaagcaagctagcgacactggacagtgatactgatacgtacatcggctatggaacaaatcttgtccctcttgtcctctgcgaagatgacacttgtatgtgtagtctcgactactgcacactgtaggctgcgcaaaacagcagaattcagagataaccggtcgtgttcggttacaacgtgcccgtacccggccgacgacgactacagtattgcttttcctaatgtcaaaatacatgtacagtatttgagatcgcttacctagctacttgcacgagaggcctaggaagtgagtattgtaggtctactagtttgcgcatgcatgcatgcactgttttgacagttaggcataggactagtatgtactgcacacggctcatctgaagagaatggatacaattaagtagtggctttatgcttcaaagtaacacgggatatgaagcaaacacagcaccattcaaagcccagatatcagaactgtatggctttactatttggcacagaaaatttcctgattggctatagtgcattagtgcatgctccctccgtcccacatgaaacaaacataggacttaatgtgaaacaacgaatttgaatagtcgtacgcatattcagattcgtagtattatgatgtgtcaaatctagtgctagattgttttttatagacatagggagtactccctttgtccaaaaagaatcaaacatcccctcttaggacaatgtatgtggacatactcatatccacatatatcaacctaagagaggatgtccggagtcacattctcttctaggttttcttttcgggacggagggaatatggagtaccagtacagtagcctatatggctatatattgtgcagcacactgcagcatgacgtgaatccttaacctatactgcaggtagctcacgtgagtgcagagttttctgcgtgacatacagtatgagagaggaatgatacaatcatatactaatagagaaaccggccgaacgtacggtttcgtccatttcttttctaatgagtacaacatccaagattgagaccatgcaattttctcaatatcatcgaaaaatatacggctagatcaggctgagcattgtagatttgtagtaagttaaatataaccaatctccagttctcaaaaaaagagagaaaattctcctaattaacattgtctcttgcgctattgtaaccatgtttacttgcaatggaatgtggaaccaaggagtagctagtatccggcagggccgttggtagtatagaagagagacaaataagaaagcaaagctagcaaaggtggacgagatgttgatggacccacaaataggcatggtcccaccgttctttttttttgcttgttttaattgtaattagttggaaatgtggaccacccttttcccagttggcgccaggtcctacatctggaatattttgtggggtgtggacaattggagcacatacgctttttagtgttttttctttaccaaaggataactctaaacgacatatttctcgttctttgcaagtacatttcaccaagtgttaaacattatatcgtgtaaaaattttctatacaaaaattcctttttgacgtgtcaccaaaaatcctagccagacagccacatcaaactcaccttaaaagtttcttagtagttttagaatggttatattctacaaagtttaagaaagatttatgtacagttcataaacattgtcatcaacttaatttccttactcctttactccaaataggacgagagaagatgcatgtacgggcgaaaacttaaaatggataaggcttggtcttctaaaaagttttatgcgcaaattatactcttacgtactttacatccatacatagcttgatcaaaatttccatacacaagcaagtgttgcaaacaacttctaattaagcaaacaaaagacacatagccccaaaaaagggatagtgatgccatgtattggattttgtcagctattaagacgaatgatcaaacgtatatgtaaaagttaaatgttgtgattttttttatagcaaatcaacaggagaggctaacactacactaatatactccatcagtttcgaaatgtttgacaccgttgactttttagcacatgtttgaccgttcgtcttattcaaaaactttttgtgagatatgtaaaattatatgcctacataaaaatatatttaacaatgaatcaaatgataggaaaagaattaataattacttaaattttttgaataagacgaacggtcaaacatgtgataaaaagtcaacggcgtcaaacatttcgaaatggatggagtattaaaatacaatatgtacaaaatatttacaggttatattacaacaaagagtatttccacctcttttgctctgtgcgtatggaaaggaaagttttccttgaaatcctttttccaaagaaagaaagagatctgaacatcatggaaaattagagcatatcttctaaaccaaatattccagcaatatattcataaaacttcttgtcgaaactagatttcggcaataataaaagagggtggctatcaagctggaaaagtgtatgggtttggaaacaaaggatttatacaggttcaggccttcttattcaagaagtaataccctactcctgtccggggatgaatccgccgagtgtattattgattgtatgatttggagaaaatcaacatctctgcccctagaggcacccggaccccccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacaaaagcatatgcggcgcataaagaggcattctagccgactgctttttagccataataaaaagaatccgaatggttaacactctaaaaggttcacgaatgaacacacttgacaggcatccgaataaaaaactctaaagattacccaccaaatattataaaaattatggtaatgaataagtctaatagcctaagctatgactatccaccataatgaaaacaggcatatgtggtgtaaaatccgagtaaataaactcataaaggatttaccaaccgcctaaaaaaaatgactacaatatataatcagcctaagccataatattggtcaataaaaacgcacacttacgtggcaaagagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacgtgacaggccacacctgaaaattcgcattgcaataattccgaagaattatatgaccgcgtaaaaaaggattttatcagcattggacaacactattgtgcgcataagttgccaaagcaaaaaatgcctaagtccctaaggagcacaatgggccacgctgttaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgcaggcaaactagggttcaccaatccactcaaatccaccttcgaaaagttcatcaaaatccttcccgtaattcaccgcctcaatccctcacctctccctagccatcccccgaatcaaatcagcgcattcgggtaaaatcaatggcggaagagaaagaaagctttgagggccaatgggcgccatccgacgtgacggaggagaacctgaaggagatagtggcgcacggcgttctccctgccaaggagatcatcgggtggcggccagcgtgcggtgaggcttttccgtcccccgatacacacgaggttgtggtcttctctcatttcttttatggcggcttcgctcttccgacctcgaaatttttccacgggatattaagcttctatggaatcagcttgcatcacctaaacccaaattccatagtccacatcgccaatttcatccatgtttgtgaagccttcttgggaattaaaccccacttcgctctgtttcgccgaatcttctttctcaaaccccaaccaaacaagagcaagccatgtgtagtcggaggagccggatttcagctgaggggaactttgagccagaagtacttctcaatgcccttcaagacttcaaacaaagggtggcatgcgaactggttttatgttcagaatcctgagcctgctcttcccgagtactcttgtcttcctccagtgtaccaagatacttggaactctcttccgattggggacgaagcagcccaagccttagagttgatggaccgcatgctaaaactcaaagaacaaggcttacaaggagagcagatcactcggcacttcatcaaatgccgactggcgccagttaaagaaagatcccgtacagcttttgagtttgacggcaagcatgatcctaatcgcgaagaaccagactctctggattttaaaatcatgaaggagagaatgtataaaatcttctcaaatgctattgtcgtcagctactcacatcagctgccagttgtgccatataatgcattcaatccacctccgcaggtatgtatctgaaatcttcaacctatgaccaaaatagtatcttgtcttcatgttgagttaactaaccatggaggcatcttattcaggaatatgtattgataaaatctgatcccccaatcactcagcgccggtctcctcgccagcacaccgttcagggaggtggagggccaataatcagaccagattcgcaacctcaaacctccaatccaactggacagacaggttctcgcaagagaaaactggtgcttgacaacgatgaaggcgacgacgacaacaaatctggggacaagggctcgcctaataaactctcgaagcgtaccatgcccaggaaaaaactggctggccgtcaaatgccaaagattagaacatcttccaggtataaacctctcggtaccatttccctttgacatgcttctctcatagaaattatactaaatattgaaagaacactttgcaggaaaccatccgacatagatccaactggaaaagatcctgatcaagccgtgacagagccaaatttatccaaggatcctgagccaactgccgaaagccagccgactggtgcccatgcttcgggtgataaggccgatccgagtgaccagccgccgactggaaaccagtcgacagcagctgaaactgcaacaacccaagagcccccgactggaaaccagtcggatgcaggtcccgatcaagaaatccctgaagttggagcgcagacgacaacttcccaaggaccagagactagtaaagactcaatgattgggtctccaaataaagaacaagggtcacctcacgctcagctaggaacatcctcaggtaactcatcttctcaagtgataccgatttaaataactccagtttgtttgcctaatgtcttggaaatacatcaggaccaccgggcgatggcgaagaagaaattccccgcataaaggcggctgatgattctcgtcctcctatcttgctcaaatggtgggacgagaactcacaggttgccggcatcgtcataaaccgtcaaaaagaagatgaggaagtgtgccagctgaagaaggcgcttggggaagccactcgtattgtgaatgtaaatctttcaggcgactgcctttgatgactttgttttctttttagcagaactaaaccatgaaccatcatgcagagaatccatcttcgcaatgaggccaagactgcaactttagaaaagctggttcctcatttgggaactctggaagcagttagggaccagctacacgaggccaaggagcacgccaaaaagacagagaaggaattaagggaccgaattgcccagctccaggattcaaacttcgagctgagtggttcatcaaaaggtaatcttctagatctgtcccattaatttgtactgtcataactgtatcctcaaacatttggatttcaaacagcgcaagccaccaggatggctcaaatggagaaacaaattgaagccttgaaaaaagacaaagtagaactggctgcgcaaagggactcagccttgaaggaggttgaaggtactaccagctaacaatctggacttctctcttttaaatacagcagattcttatcataaatgtgttttgcagactgcaaaatcaaatctcaagctcaatttgatgtcctggttggtaagatcaagaggcttgaaggagcaagagatgaagtcgccaatgtcgctacaccactcgtccaagctatgttcctcaataacagtggtccgagtgcactcgacgcaaccgaaattttcgacaagctgagagttgctccggatgtatatttcaagaacatcaagaaagctggaagtatgggagctagcatggcattggcgatgaccaaatcattgtacccgagaattgaaattgacgccattgatggctttgcagacgggacaagcgaagaagctgctcttgatctcatcaccaatgctcaaaatgcggctgacaagattgcaagtgacgttgtagagcaattccgcaacaacgaccttcagccgagcaacaataactctgatgatgaaagaactgattctgactgagtatgaatgtaacaaatggaggctcaacttgtacaatactggtgtatttatgctgtgtttgataattctagccaagtctttgatttcttaaaagcttttatcaagctttgttgagcctaaaacccaaagaagctattaaaaactttcagtcctcgcagactaagtagaaaaaacaaacaaggcaatgatagaccaagtaagcaaattgaattgataagtaatcaaactccattattataatgatagcccccgactgacaacttcaagaagaaaacttaatgttgacagtcaagatagggaagtacaatgataagcctaagcatagaaacgacgaagatgttcaatgttccaagagttatcgacgagagtaccgtcttcgcgcttgagtcgataggaacctggtcgggtgacttcagagatgataaatggcccttcccatagaggagataacttgtgccgatctcgtgtagtttgaattttcctcaaaaccaggtcgccgactaggaaggcacgggatcgaacattgcggttatgataacgccgcaacccttgtaagtatcgagccgactgaatcaaagccgcttcgcggacttcttccaatcggtgcaagtcatccactcggtcctcttcgtagcgttcttcacggaaatttcgaaagcgcaaagactcaaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgccttaatcccttgaagtatcatgccattggctcgctccacctgtccattgctcatgggatgcgctactgaggcatagcaaatcttaattccaaagtcttcacaaaagtctttaaaaactctgccagtgaattgtctgccattatcagtgatgatccgattgggcactccaaatctatgcacaatgttgatgaagaagtctcgagcgttatctgctgtgattgtgataaccggtttagcttcaatccacttggagaatttgtcaatggccacaaagagatgcgtgtaaccgccgactgcctttttaaacgggccaaccatgtcaagcccccaaaccgcaaacggccaagacagtgggatggtctgcaactcttgagctggtagatgaatttgtctggcgaaaaactggcaaccttcgcacgtgcgtataattttgtcggcatcggatactgcagtaggccaaaagaaaccctgccggtaagccttgccgacaatggtgcgtgcagcagcatggtttccgcatatcccagaatgtatgtctttcagcaattgtctcccttcctctaaagatacgcagcgttgcagaatccctgaagggcttttcttgtacaactcagcttcatgcataacataaagtttgctccgccttgaaatccgctcggcctcatctttgtcttgggggagttcttgagaagtcaaaaatcgtatgaggggctctcgccagtcggcttcaaccatagctacgtcatgagtgcccgcaacttgagtagcatctttgtgaggtactgtcggcgtataaaggtgttcgacgaaaacatcggagggtgccgcctcacgcttggatccaaagttggcgagtctatcggcagcttcattgttgtgtcgaagaacgtgactgagctcgagtccatcgaacttatcttccaatttgcgtacttcttgtcgatatgccatcatgttgtcgtcaaggcaggaccactctttcataacctggttgacgaccagctgtgaatcgcctcgaactattagacgctttatccctagggagattgcaatccgtagtccatgaaggagcgcctcatactcggcgacgttgtgggacgtcgaaaaatgtatccaaagcacatagcttaatctttctccagttggggaaattagaactactcctgctccagtgcccgaaagtcgttttgacccgtcaaaatgcatggtccagtgctccatcttctccgcgggggtatcctcctggcactcggtccattcggcgacaaaatcagctaacgcttgggacttgatcgaaattcggggcttgaatgatatgtccaaagacatcaactccaaagcccacttagcaatccgtccgtttgcttcacggttgtgcagtatatcaccgagtggaaatgatgtgaccaccgttaccgagtgaccttgaaagtagtgagatagcgtcctggtagtaattagaataccatataacagcttctgaacctgagggtacctcgttttggagtcggctaggacctcgctgacaaagtaaatcggtcgctggactttctggagatggccttcttcctcgcgctcgacgaccaagactgtgctcacaacctgggaggtggctgatacatacagcaacaacggctcctgcgggtgtggtgaggctaagactggtggctcggtgaggagcttcttgaaatcttcgaaggccttctgtgcttcgggtccccactggaagtcgtctgttttctttagtagcttaaagaagggcatcccccgctcgccgagccttgaaataaatcggctgagcgccgccatgcatccagtcagcttctgaacatctttctgggtacttggcggtttcatgttgaggatagcaataactttctccgggttggcttggatgcccctatgagacaccataaaaccaagcagcttccctgacggtactccgaaggtgcacttttcagggtttaatttcatcctgaaagcgcggatgctcgcgaaggtttcttctagatccaaaatcaaatcatccttttgcttggtcttaacgactacatcatccacataggcctcaacgttgcgaccgatctgtgttgagaagcatctctgaatcatacgttgataagttgctcctgcgttttttagtccaaacggcatggtgacatagcagtatgctccaaagggcgtgataaatgaagtcttcaagcagtcggattcctttagtcggatctgatgataccccgagtagcaatccaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtctttcctgtcttgtgcgaatcggcggagtcgttgtttgataggcttggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagaaggatctaggggaatcttcttagtcttggcttcgctttctccactttttgaagtcttggtggcgggcacttctccttcgctcgccgtggctgcagccagtcggatatcctctcggacagacgtcatctcgcgggtttgggccatgtcgcaactctccttgtcgcatgtgacggcttgcttgatgtcgctccgtagggataggactcctcggggaccgggcatcttcatcatcatgtaagtgtagtgcgggacggccatgaacttggctaacgccgggcgtccgagtatggcatgatatgctgtctcaaaatcggcgacttcaaagctgatattctctgtgcggaagttttcccgagtgccaaaggtgaccgggagggtgatctggccgagtggagttgcggataatcctagaattactccgtgaaaaggcgcattgcttggttttagctcggagcgagggatctgcatgtcatccaaggtcttggcgaagaggatattgagcgcactgccaccgtcgatgagggttctgcgaagcttgacattacggaccactgggtctagtaccagggggtaccgccccgggtggaccactcggtcaggatgatccgagcggtcaaacttgattgcgatttctgaccatcgaagatactggggcgtgtcgggttgaacagcattgatctcccgttcagtcaacttttgcttccgtttagactcataagccaaggggccgccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagctggcgtacccttatttggcttccaactaggacccgactgctttgatgcggtgacggcgtcttcagctttggcgtactcgttggctttttcaaacataagcttgactgtcctgggaggtttacgcccgaacttgccgaccaattcttcgtggcgaatccctttggtgaaagcggcgatgataacgtcgtcggtgatgtcggagatcttattacgttgttcagaaaatcgccggatgtaatctctaagggattctccggacttctgaataacgttgtagaggtcgtattgtgtgccgggacgctcgaaggtgccttggaagttggcgatgaagtggtcgcgtaattcggcccaagatccgattgtaccacggggcaatccatggagccaagatcgggcggaatccgctaaagccactggtagatagttcgccatggccttgctgtctcctcctgctgcgcggattgcgagaccgtagacggtaagccacgattctgggttagtggtaccgtcgtacttctctattccagtcggcttgaagccggctggccaatccactcgacgcagatcgtcggtgaaggctgctactccgtcaaggtcatcgtcatggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaaccgcccgtcgtgacccctgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtcggtggggcgcgagtcgacggtgggagagctgtagtagccgtccaactgatccgtcgaaaccgtgccgagtggttggaggatgacgccgacttccctgaagctaggcgaaatcggtgttgaagccgacttccgcctaggcctacgggatgaagacgctgtcgtgatggaggcggccgccgaatcgtcggggagcttcattaggatcggtgggtaagccccatcatcttgatctggtgtcgttggagaagatgcgatctcgcccgagtggtttgaagccaactcgattgagatggtcttgaagtaactttcagccgcgtttgggagtccaaacgggactgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctccccctacctggcgcgccaactgtcgaaactagatttcggcaataataaaagtgggtggctatcaagctggaaaagtgtatgggtttggaaacaaaggatttatacaggttcaggccttcttattcaagaagtaataccctactcctgtccggggatgaatccgccgagtgtattattgattgtatgatttggagaaaatcaacatctctgcccctagaggcacccggaccccccttatatatgggaaggagtccgtgttacaaaagataatctatatcctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcatcgccgtgtagatatgggatatccataatctccacacttctgcaaagaagggatgtccgaaccgaagcttagctgatcgaatcatatttttcaaaaaacacatggagtaatattatggctaactgcgtacattggaggaatggagtagatgctagctagtggaactcgttgtgtgctaacaaagccatatgaaaggtagctaaaattttgcaacaacagccttttgtaaaagaaataaagaacaattgcacaactatttaattaactttctagtcaagtggcgtgcatgctttttgtcatctctatatacgtaccataagccaccttcacgtacatgatgaacagtaaaattgcactggaattcaatcacataagaaagaaaaaacgagtgattacaaactcaaaggacatagccatgcaatccaggcaatggtgaccggcacattaaattgcattcaagcactatttttttaatacaatgaggtgcaaaatttttacatattcgtgaaaataaaatatatgtgatgttgcgaaataaactatgatgaaaatacctccaataactctagtttttcaaaattcaatttctagctgtgactgataagcagacgatgacaggcacacttgtcactattgcacccccaactgtgctacatatattgacctctacaaacctacgcgaaatgatcatggtgcttcttccattagtcagtccatcaggtaaaacaggctagctctagctgctctcgctgcagtgacacgaagaaaagctacagctatagagagaaggcaatgattagttagacttaaggtgtgatgttttcttctctttcctagaccttgtttggatccggaggactaataattagcccttcaaaattttactatttagaaatattaaacgtagattactgacaaaactcatttcataacttatgggctaattcgcaagacgaatctaacgaggtatattaattcatgattagcgaatgattactgtagcatcactgtagtgaatcatagattaattaggctcgttagattcatctcgcaaatcagcctaggggttatgaaatgtgttttgtcagtaatttacgtttaatattcctaaataacaagatttcggagggattagccctccggatccaaacaaggccctatcttctactctcacattttctgcgtacaattttttttgaacgaaaaatagcactagagtgccttttcattgaatagagcaggagaaaatacaacccctaggggcaacaagaaaaaatcgaggaactgtagttatacactatacatagtgtgggattaactcgcgcaaccgcttagcctctgctaaagcccaaaggctagcctcttctttgatttttgataggaggaaactcgttgccacctctttatggtcaaagattcaccgatttctattttctgcatacatatttcttaaactgttagtgtgtgttttttaaaaaaaaacataaaagaaaacattttataaaaccatattaacctattttaagctaatacttaattaatcacattaattgttaattgattgtttctttttttgtgcgggaaggaatgggttttaaccctcaccttagaagataggagtagcacagagtgtgagtagacgcaataagccctgcagacgccgcatgtacagactacagctcgagaagacgcactggaactagtctcctgcagatatttggatgggatgtagcagttgcagcggcagcggcagaaggagaagttgctggtaagaagtagcgcgcagctgctcctgcgcgcgcatgtacagggcgcgaggcgaaagcttgacgcggcaaccaccacccaccccccaccccgcccggctcagacctcgccatcgatcgacctgctcgcgctctctccctccctccctccccattgatcccatgtatgtgtatgctttttgcgccatatcccaccttttttccgtttcctgcttgcttgctttcctgacgagatctttggtttggttggtttctttaagacccgtgcgtccaaatcgccatggcttttcatcttgttttccttcttttccctgccctcccaggacaaagcaagattcctgtgtttctgaggcttagctgaggaaggattcggcctacctgctctcttctcctgcccggccgattgctacgacttgcaacacgcatcaccatagtaatagtatcgtcgtgttcactctccgacgacttaattgtgtgcgtgttgtatttcccaccgtcttgtcacttcatcacacatctggctacatcgatggatcactggtgctactagctagctagctcgctagttactcgattactggctgaattttcgcttctgtctccatctattttacacaaattaaagtgagctctcctgcgctctcaatttcattgctgcttataacttattgtgtttagcttggtaattagtgattgtttgtgtttgtgtttgcttttgctaggcttttggcgatcggaggaattgaaacaccgatatggcgcatgatccgaacctggggttcgcggattacttctcggcggcagatgcatcggcgtcgtcggtcacgacgctgatgccggcgatggacgaagcggcgccggagctgttcgggttgcaggccgggatggagcttctcggcgtgcgcggtctgggtatgagtatgatgcccggcgcggcaggcaaggtcgccgcgctggtggccgacgctggggacgacggcggcggcggctccaccatgcgcttcctcagcgagcagcaccaacagccgagccaggcgccgctgtcgctgtcgctgtgccgcccggacggcgtgctgcacctcggcggcgcggcgcggccgcagcaccaactggcgcccgcggcgccatggatgacgcaccacgacgcgtcgtcgtcggcgccgcaagtgcacggcgcgtggcacctgcgcagctcgaggttcctcctcccgacgcagcagctcctccaagaattctgcagcctccccgtgg

SEQ ID NO: 13186 - DNA, 14176 bp, Oryza sativa
cattggctatttccatctttaccacgtccatacacgtacgcttggtgcagtgccctgtacgtgtactcctagctagacgtgcagatagatggctacagtgaaaaatcaagtaaagggtttcttaatttgagctaattaaattgatcgatgaacgtgtgtatttgtgcaggtggacaggaggtacaggaggtactgcgagcagatgagggcggtggccggggggttcgaggcggtggccggggagagggcggcgggggcgtacacggcggtggcggcgaggacgatatcgaggcacttccggagcctgagggatgggatcgtggcgcagctgcaggcggcgaggaaggcgctcggggagaaggacgtgagcgcggccgggacgacgcgggggcagacgccgcggctcagggtgatcgaccagtgcatcaggcaccacaagtcgctgcagggcgtcgccgccatggacagccacccgtggcgcccccagcgcggccttcccgaccgcgccgtcaccatcctccgtgcctggctcttcgagcacttcctgcacccgtaagtactccactttacattgttgtttatacgtacatacacgtattacgtatacatatatacacgcatgcatcaatcatctagctactttgcatatccatccatgcttgatcgatctccacacaatgcatttcttgcttgatcgattacacttaaagtaatgcagctgactgatacttaattagatcccgttcttttctccgacaaaacttggatgaagattaatattttcgtggcatgcttttcaaactgctaaatgctgtgttttatatgaaaaatttttatataaaagttgctctaaaatatcatattaatctatttttcaagtttataataattaaaacttaatcaatcatacgttaataccacctcgctttacgtaaaaaacttaatcttctttttcaagagaaaagaacactacacagtgtgctacaatgtatagcaatctaagttcaactgttcacgtggcagtcactagttagtagaattaaggtgacttttggttagtgcaatcacgtacagaacgtaagaatgtcagtgactaggtgtaatagcctagtagggccggtgcagtaatattatcgcgcgtgacacacaatttgctatggacggttgttcgtaattagctttttcgcggtatatatatatatatatatatatatatatatatatatatatatatatatatatataaatttattctgcagcgagcattgttctcccggaccacatttgtcttggcatcaaatgctcaagtggccgttttgccatattgcgcccctgcttaattaagcgtacacgtaatgtcatgtgtgtgcctcactattcttttgccatgcatatggtctaatataatgctctccttttttttttcgacaaaaataacggttaagtactctcgtgactgtggtttgtgcacaacgtaggtacgtacttactcccaaaacattataagtagctagctatgattaaagttgcgtctgtgtcagtggtaatatgtttgattttttttaagtttgtttttccaaatttattatttagctagattatactccctccgtttcacaatgtaagttattgacatcaatataaatatgaaaaatgttagaatgaattatattatgaaacggagaaagtagtatattttgtgcaatcgaatttcctatgaactctcaggttttgtattaacaactatttatcacgtgcattagttgttgcaatgtgctaatatatatacatccaaacaatatatctacgttattataagcttgaaccatatcgatcaatgattcaagcacgtctatttttctcaggttagcatgattattttctgattaacatttttttaataatggacacgattcacatcttggccctctaccaattaataaacacacggtcaataagttctaaaatatgaataaacagactcatcaaggttatgtgaatttatctgattagcatgatagtaattagtaggcctggagaattcattttcaccttgttttaataatagatgcatggatggattgtttgtcggaatattatactactgatgaccagtaatcgatttagatctcattatatttgcgtgagttgttgaatttttttgattcaattcgatcagattcatatatgcatcggtgttcatatgttcaatcccattcaggtatccaagcgacgtggataagcacatcctggctcgacagacgggcctctcacgtagccaggtaacatgttcttcgtgtattgatgcatatatactatttcccccgtttctaaatatttgacgccgttgatttttttaatcatgtttgaccgttcgtcttattccaaaacttttataaaatatataaaattatatgtatacataaaagtatatttaacaatgaattaaatgattaaaaaagaattaataattacttaaattttttgaataagatgaacggttaaacatgttcaaaaacgtcaacggcgtcaaatatttagggactgagggagtagtatagcctgaaccaaatcatccactaataccctaccatgaaataattaagagtgtttttatatatggtcctcaccgggagtttctagtataaaatttgttacttggatcaaatattaataccttagatatgaggaggtacgtagtcgttacctcctcaaatatcataaaatttctaaataatcatacaagtttaatttgagtagctagtttgttcatttttgggaatagtactaaatattgcgcccactgattcgatcgccgtctcgtagatgatacatcaattcatcgatcggttgccatgtcaaggtcctaccatgtcctcttgtgcttgcaaatgttttttggaaacgaatttgtttagccatcgacctcccgttacaacgacatgtgttgttgttgcccgcgcgcgtttcttctgacaattcgatccatggcaggtgtccaactggttcatcaatgcgagggttcggctgtggaagccaatggtggaggagatgtacgtcgaggagatgaagggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctcgcgcgcggccggcgctgcggcgtgcattggttgggcaaccgaattaagcgtttttgttggtggtggtccttgattttaccgacctataggtacagttcgtatatatctctcgcgatcgatcgtacaccagcaggggagtagcccagtagatcgtcgtcgatggcgctttcgtgtggttcggaagcgggcagtttattttagcctaccggcccggcatcggttgccgggggttgtgtggtcgtgtgttgtgtagtggagacagcttttatttgtactggaaatctggaatttgattgatggttcaacttaggccgccgtgactgcgctggaactgggactgcacgctatttgtatgcggcaacagcaacagtgctgcgacaggtccgcttcaaataagccacaaactactccaacctaactaatgatttaacggtgtaagaatgacttgtgtttaaaaaaacaaaaaaaaggggctatctgtttatttaggtttacaattttcgattcacaagtaagctagaccataaactgagagacagatatgtcccgtaagcatgctagccacatgacccaaattatctaatttggattcagcaaaacaaattacaccccctctgattcgtaagaaaaatataaaaaattatggattttatttctatagaaaaatcctaatgagttttttttaaaacaaaaatgttagacactatactttcacttgaaattcgaacgaaatagacaatccaaaaattttaaggaaagttagcaagagttttaacctcttgaaaaattttccctaagtttatttctctaattcaattcacgtgttctcccatgtaatattcgaacgatcaatcattcatgtattttccttgtcttatatatgttctctttgtttccaattgattatcatattacatgaatatgctaagactaagaaaagtcaataactctcgcacactacatttactccggtaacaaactcgatacatgcaccatctctgctcttaaccaataataaaatcacaagacattgcatgttagtcatacatagttatgtgtatggatgcatgcactaatatctatttactctcatacgcatatgacgaatagacttaggaaatagatttaacatggtcataacaatctataaaacgttatatgatgattaattggaaatagacaattttctatttctcaattgcgttcatattaaaatcaggtattttatatactttttcaagagtttcaaatgagtccttaaaaaataaagatattcgaacatatttctttaaatagtgggaaaaatccagtccatgcatcaattgtggatatataatgcagaaaagcatattagttgtcgatatccttgtaaacggtactagcatacgtgatttttcttttaataaaaagaactgcacgggaaattagttaagcagcaatccgacggcgtaaaaatttagagcgccatcagttggtctaataagtaaaagcaaaaggtaaaatttaattaaattttcgaacttgtatttgaagttgatttcaagattttttttaacgtaattcccttttagcattagtttttaaattgctataaacaaatatataaaagttttacatataaattaatttttattttctaataaaccgttttggcttatcggtgaatatgggcttaaatcgcttgcaccgccatcgccgtgcaactcaataatattcgagtgttgcttgctataacacggcaaaaggcaatcattaagcatactaattacaagacttgaaacgttagttgagatcataattaacgatttgtgtaaaacttcgaagatttggtcaggtgggaggtcactttcatatcatcagcaaatttctgtcatcactaagaagaagaggtgtccatcaccaaatgtgcgagattctcagctaggagagttggatactacctccgttttttaatagatgacaccgttgactttttctcacatgtttaactattcgtcttatttaaaaaatttacataattataatttattttgttatgagttgttttatcactcatagtactttaagtgtgatttatatcttatacatttgcataaaatttttgaataaaacgaatggtcaaacatgtgagaaaaagtcaacggcgtcatctattaaaaaacggagggagtatatggtttggccgcgtactatagtgattttgctcttgctaacagctagctgcgtgtctgtgtgcgcgatttttttttcggaaaaaaaataaaaaacaggatgcggagaacgcatgaacttttttcatttttaaattttttgttttaatatttatagaaatattatactggcaaaaatgtttacaaaaatatatcctgccgcacaagtggagagcggcaaggtgatgtggcacacggcgtcgtgtgcgcattttgcgttgaggtcccttgccgggtgaaatgcaattttcgccgcacgcaaaattcacatacccgctcagcggtctccggcgtctgctcacacacgtcaccctaccgttctcaaggagggttgcgtggtctatttatgtaaatattttcgtctgtataatatttctgtaaatattaaaaaaataaaaatgaaaaacattcgagaacgcatgggctattgggctgggtgctggagcccatggccgtcaggcccagaggagaaaccagtgatcctacaaacgcgacttgatcattgaccactgaccatgctatttatggggtaatcagtccaggttgcaactggggcctacaatttctgttccctatatgctccacagagcgactcgccctcaaacacgtagactggaacgaacgaacagacgaacacggtgcactccactactacgctatttttgaccatgtggccattagtgatctgtgctcttttggccgctcatcgatcttggccaccactgtcgtcgtcatctccttttccaggccttatttggcatgaaaggaggaggcggcgatcggcatcatcacaaggacgccattgtcatgcacgccgccggcaaggcgcccaagtgcaaggcttccttcttcctctgcagcctcctcctctactttctcctcccggtgctcgccctgtacgtcgttgccctcgccgtgtcgccgttctactcgggtagctcgtgcccggaggagagccttgccagtggcgacgttgcacatctcgcggccgccggcgatgctggcaacaggcgtaacgactcgtcgccgccgtctgatgacgccgcgccgaccgggctgggtcacattgtgttcggcattgccgcctcttcggagctctggaagagccggagggagtacatcagaacatggtggcggccggagcagatgagcgggttcgtgtggctggacaagccggtgtacgagttctactcgaggaacgcttccacggggcttcccggaatcaagatcagcgggaacacgaccaagttccgtacacgcacggccgcggcagccggtcggcgctgcggatcacccgcatcgtgtcggagagcttccggctgggcctccccggcgcgcggtggttcgtgatgggcgacgacgacacggtgttcttcccggacaacctcgtggacgttctgtcccggtacgaccacacgcagccgtactacatcgggaatccgtcggagagccacatccagaacctcatcttctcgtacggcatggcgttcggcggcggcgggttcgccatcagccgcgccctggccgcgcagctggcgcacatgcaggacgggtgcatcgaccggtacccggcgctctacggcagcgacgaccgcatccacgcgtgcgtggcggagctgggcgtgccgctgacgcgccacctgggtttccaccagtgcgacctgtggggcgacgtgctgggcctcctgggcgcgcacccggtggtgcccctggtgacgctgcaccacctggacttcctgcagccggtgttcccgacgacgaggtcgcggacggcggcgctgaggcggctgttcgaggggcccgcgcggctggactcggctggcgtggcgcagcagtcggtgtgctacgacggcgacaagcagtggacggtgtcggtgtcgtgggggttcgcggtggtggtgacgcgcggggtgctgtcgccgcgggagatggagatgcccatgcgcacgttcctcaactggtaccgccgcgccgactacacggcgtacgccttcaacacgcggcccgtggcgcgccagccgtgccagacgccgcaggtgtactacatgcggcagtcccgcctcgaccgccgccgcaacaccaccgtcaccgagtacgagcgccgccgcgtcgcgcccgtcaagtgcggctggcgcatccctgaccctgccgcgctgctcgaccgcgtcatcgtcctcaagaagcccgaccccaacctctggaaaagggtaatcaaacacacaccgtagttaaaacctgaattgatttgtacaacaaagaagcttgatttttgtaatggtgctctcaaaccggcgtgcgtgcagtctccgaggaggaattgctgcagggtgttgtcgtcacccaggcaagggaaggaccggaagatgaccatcgatgttggcgtctgcaggggcggcgagttcgccagaattgaggtagccaggtaggccacctccattaacaattttccgatatggcattattgatctgatcaccagctcgcgcgcgttgcgtttggttcgcgcagggaagctagctaggatcagttgctaggacagcaaaacgagagcagaaggcgaaaaccatcaagcatcaaggacggtatcggagcaggacgcgcccacctcgcggcggtgcacggcggatcgctcggttactgcttgcttcggctaatgatagctgtaaccttagataataggtgtatgtaagtaaccgaactcaccttgatacaacactgtgccggcgagaatgtggcgcacttgtgggcgttgtacaagtacgggcagtgctgctgcgaacggcgacaggcttgtttgtttgtgagcccgtcgactgtcgaggtgttcaaataatctggcaaacaggtgaagaccagaggctacgagtgttcaaatagcccatgggcaattttcaaaaaaaaaaagaaagctcatgggccatgtatcaactaactgatgaataagttcactttgtcgcagagtatgaaattcatcgagttacaatgggatataatgggaaccgaaataccagatatattacagatctctttcggtttagggaggaatttcacactcgatgacaaattgaggaacctaaagtgaacttattacactaaccgaaaggggtgcaacctctgttgggttctttttccgagtcggcccgagatgtcctgacaaaatcctacttgggccgaagtgatagaagcgcaagcccaatagttcctttcagcctgctagagaagcggcatatacgactcacagcgttaaatgagcggggcagaagagctcacggctcccatcggatgcactaatcagttaaagaaaaaactaaatttcatatttttaaatttaattttaagatatttataacatagtttctttttcagcattgacttttaattcaccaataacgcatatataaaaattttatctacaattttatttttattccttagtaaaccgtttcggtttattagggaaaaagctaaacgatagcgacacaaacatcggtctactactcgcgtggtccgacggtggcgatctggtcgtcggctgcaccggcggcagagtgcggtttatgagcacacggagtgaacacaaatcatgttgcgaagataataatgtatgcaaattggaaaattatagagctacagcaaagggatagcaaagctatcaatcaggttctgggaagtggcaacctatgaaaaaagagagacacaaacaaaatcgagaagatggcatacctaccatacaagtagaagaacagagcagaaatttgcaatctgcagcatgctttgttttgagccgaacaaatcggtagtcagtgggcgggggggcataggaaaatgtgatgacccaatcagcgtccactccattgtccattccactattccagtattccaccacgcgctgccctccggtcgttgtcccatcttcctccgagtccacttccccgtgcccgactccacacaccactccaccgcatcgcactcgtccttccctctcccttccaacaccaccacccgcaccgtccgcacactcgtccgcttccgtctcattctctcgtggacgcggcagtggcgccacgaccacgcctccactaccgcctcaatggccaccgtcatcgtcatcctcctcctcctcccgttactcccgtccaccgccctcgccgccttcccctacttcctcgcctgcggcgccgcctccaacgtctccttcccaggcgactccccagcgcgcaccttcgtcccggacgctcccttcctctcgtccgccggccgtgtcccggcagtgacgagcaccggctccaacacgatcccccctctctacgctgccgcgcgcgcggccggctcggggttctcgtacagcttcgccgacccggacaccgccacggtcaacgtgtcccgcgtcctccgcctccatttcttccctttcaccagttcctcctctgtgaacctctcgtccgcgagcttctccgtctctgttcgcgatgcctacaccctactctcctccttctcgccgccgcgcgacggcgtcgtcaaggagtacttcgtcccgggggacggctccggcgagttccgcgtcaagttcacgccggacgccggctccaccgcattcgtcagcgccatcgagctgttcccggctccgccggagctgctgtggagacgcccggtgaagccggtgggcgccctggtcgacagcgtcgacgtgaacgcgtggccgcagcaggcgctggagacggtgtaccgcctcaacgtcgggggatccaaggtgaccgcggcgaacgacacgctgtggcggacgtggctccccgacgacccctacttctccagccccagggggctctcgcaggtgaactcgacctcgaccccgatcatctacggcacgtcgatcgggtacacgagggaggtggcgccggacagcgtgtacaagacgcagcgcgccatgaacatggcgagccagcagttgttcctcactccggggcctttcaacttaacgtggaccttcgcgcttccgccgccggcaccggggtccgactccgactacctcgtccgcctccactggtgcgactactcgctggtgagctccgttgtagcaacgggcatcgtcttcgacgtctacgtcgcgcagaggcttgcttccaaagacctcgaccgaaacgcggcggacgcggcggagcagcccaacgaggctttttacctggactacgcggccacggccccgaccaccgggaacctcaccatcagcatcggcaagtcggacaaaagcgatgcaggcggcatgctcaatgggctggagatcatgaagctgcggcgcgccgataatttgaactccgccggatcgcacggcaggaggaagaagattctcatcggcacgctctcggcggcgctcggcgtcgctgttcttgcgtgcgcgctgctctgcttgctcgccgtgctgcgcaggcgtagacaggcgccgactccggcgccggaggagaaggagagcacgcagctgccgtggtcgcagcacacgcaggatggctccagctgggttgacatgtcgaacgcgtcgggcgcgggcatgaccggcgggctgcacaggatgagcatgcagctcaacatctcgctggcggacatcacggcggccacggagaacttcaacgagcgcaacctcatcggcgtcggcgggttcgggaacgtgtatagcggcgtgctccgcgacggcacccgcgtggcggtgaagcgcgccatgcgcgcctccaagcaggggctgccggagttccagacggagatcgaggtgctgtcccgcatccggcaccgccacctggtctccctcatcggctactgcaacgagcagtcggagatgatactggtgtacgagtacatggagaagggcacgctgaggagccacctctacgggtcggaggagccgccgctgtcgtggaagcagcggctggagatctgcatcggcgcggcgaggggcctgcactacctgcacaccggctactccgagaacatcatccaccgcgacgtcaagtcgaccaacatcctcctcggcgacgcgttcatcgccaaggtggccgacttcgggctgtcgcggatcgggccgtcgttcggggagacgcacgtgagcacggcggtgaagggcagcttcggctacctcgacccggagtacttcaagacgcagcagctgacggaccggtccgacgtctactccttcggcgtcgtgctgttcgaggtgctctgcgcgcggacggtgatcgaccagagccttgagcgcgacgagatcaacctcgccgagtgggcggttagcctgcagcagaaaggggagctcgccaagatcaccgacccgaggatcgccgggcaggtgaacggcaactcgctgcgcaagttcgccgagaccgcagagaagtgcctggcggactacggcctggaccggccgtccatgggcgacgtgctgtggaacctcgagtactgccttcagctgcaggagacgcacgtcaacagggacgcgttcgaggacagcggcgccgtcgccacgcagttccccgccgacgtggtcgtgccgcgctgggtgccgtcgtccacgagcttcctcatggatgacagcgtgaccgactcggggatcgccaacagcaaggccttctcgcagctcagcagcggcgatggccgttgatcaatcagctggtcagtgaaccgacagtcggtcagactcagatagagaagtttgtaaccataatttttcctctctttttttttatgctgatctattctctgaatccaaaacccatgcacgtcgcagcaacgatacgtcttcagaaattttgctgaacacgaacggaataccgtaatctgcagcaaaattggtgttgcaattttttctgtccttgctgtctgcatcgtggattcatttcatatgttagcgcgtgacgaaatgacttgacccaggatgaacagatcattttatatgttcagatgagaacaaaatcctttgcctgttctttcttcccaattggccacgggcggccgttttatagtacaaacaacaattctctgcaggaccttgacagagacttgtgtacagttgagttgtattgtactcctacgcatgtctggcgtcaccctgatgaggccaaattctcgttaccgtgttccgcctaactctttgattataatgatgattataatgattatcttgttagtggaagattcattaatgggatcattcctaaactactggctttagagcataataatatatggttcacacgattgctgacctagaaaagccgccgtcccgccaaggccattagagaaaccaaaaataaaaggaacttttttttttccaaattcgatctcgccgaagcttttgcatactacgatgatcatgacatacacgaattgtgtggttagaactcagccaaactgggacgtgcatagctgcaatgcacgcattcttcagaatccccctgattgtctcccttctgctttgactggaaggacggcacgcatgcatgcgcccaggaagagtaataaccaggtaaagccaaattctttgggctatttccttttcgtttaattatcaggtgctgaccgctgaccgtgccgtcgtaatcacactgccctgctgactaatctaaaccattttttttatctattatcctttgactgtttaattttgactacaattccaagttgcaaccagaaatcactactgccctattcaggtggcaaccgatatgtccacggcgaaagagacagcccaaactgcaaggcaaaaggctatggtacttgggccaaaacgtgtacagatgctctcccctccgcaagcccaaccaaatccacggcccaaacgaaaaagataaaagcccacgctgatcagagcattaaaatacctaaaccaaccggcacggccacgacgcgtgggccccaccatccagcgagtcctcggctcgtcgcacgcgacgcggtgaattgattgatcgaccgattcctccccaactccgctcgccaatccacagctggcctccatttcttcctcctccccttcgccgaatcccccacaccaatccgccatggctagtgttctcgccgtccccctcctgctgtgcctgctcgcctccgcctccgccgcccgcttcgccccggcggacaaccacctcctcgcctgcggcgcgacggcaccggccgtgctccccgacagccgacgcttcgtccccg

SEQ ID NO: 13187 - DNA, 47193 bp, Oryza sativa
gcgggtcttctcctgccgcgcgtcgtacgacctcgcacgtccgccgccgcgggtaccacgtcatgcgcctccacttctaccccttcgagcccgcgctcgcgtccgcgcgcttccacgtcggcgccgccggattcctcctcctccacaacttctccgcgtcggcccccgtcgtgaaggagttcatcctacccgtccactccgacgtcctcgtcctcaccttcgtccccgagtcgggctctaacgccttcgtcaacgccatcgagctcgtctcggcccccgatgagctcgtcggcgacatcggcaccctcgtcacgagcagcggcactgaccagaccaatggattgtcgtctcaggtctatgagatgctctatcggatcaacgtcgccggccgcaaggtcacaccgttcaacgacacgctgtggcgaacatgggtcaacgacgagcgcttcctcgtcagcacggaatcatccaacagcggggtctggtcgttcggtggccggattgcttatcccaagggtagcagattgatgacacgggaggttgctcctgacaacgtgtacaactcggcgaggtcagtgagctcacagggcaaagtgacatggggatttcccgtgcctgcttccagcaggtacctagtgcgtatgcacttctgtgacatcgtgagcaaggctctaaatgagctttactttgatatctatgtcaatggtcagctagcagtaaaggatttcgatatctctggtgccactggattcttagcctatccatattacatcgactttgttgtggatgttgaggatgaaggggccctgaaattggccattggtggctcgaagaatagccgatcagacgaagtgagcggtattcttaatgctgtagagataatgaggatgaacaaaacaaatggtggtattgatggggattttgcagtttctctgggcatggagtatgtggctagcaaggggatcggagaatttactcgctcactgctgtgtggtttcatttttgcgggattgttgttggttttgttaatgcttgtggtgaggttgaggactgagctgaggaataatggtacaacttggtcttggcagccaaatgattctggtgacgggaagctggctagagcatatcaacttgtgtccgctaagacagactattgaacatcatgagatgataatctttgaggagctttaaactgtggctgttgacctattgtatgtaatgacatattgcattacttcagttgtaagtattgtagttttacacttttactcccttaatggtaagttttcggttatttgagcttggctaatggagaaaacggtcgtggtgttgtatctggctcaagatatttgtttgtattagtactgcttttaatagctctatccagtttgtgatgcttgaatgaatatgcctgcaatttatctagtttatttatgcttttgtagtactggttattgttatatgccattactataattcatattcttgatatgaagatagcggctaaatcatggcaaatagaatctaccttccaatgttagtgttatttactattctttattctacttggtaaggcaagggggaagctcttgtagaaagccaattaagaagtagtagtatttcccttggttctactttttttttctttttgaaaaaagaaacttcagttacagttttggctgccctggcatcctactttggccctcatggcctcatcgctaagagcttttggtaatctgggctagctgtaacaattaagtgtctgcagatcatctttgtttgactgctgagaacttgtaaataacatgctaaaatttgacataatcacacaaatttcttaaacttggttgattcaatccagattattttctggagttcagacataccgagggataatactgctttggtcctttcagatcccaacttctacagaatctttgctttgcttatctatttgtatacgtgacatgtcttcaatcttacatgtgcaattgtttggattttggaattagactccaccgaagtttagggatatatgtttacctttctgttataagttctaacatatcttcttttcttaggaacctgccatgattcaacaattatcatcctttgatacttaatagcttttatttccgcctctacatctatatttcttttgaaaaaaaatgcaaagaagatgccttcctgagaactttgccatcctactctgcctgttgatgtcttttctggtgtgtttgtgtagtacaggagtaagtactatcattcatctatccaaacactagcatcttcctctgttagagcgccaaatgaaatattagtatcagcagaggaaaatctaccatatgcccctatccaaatatccaatgatgttattgtgatctttttctgatgattgtttgtgccctcatttttttgggggctactgttgttattgtgcgggtgggattgcttcagtcctatactgttactgtgcaaaaaaaacatcttagggaatagttaattcttgttgggtttgtatgactaattgtcttatattagttctgatgccaaccacaaagaacctaaaacgctgtaacactcataggtcccaatttccctatttgaacaggttttggtggttgatgtgacaactgtattggtggtactttctaatatcatcactagtcattgtacttcaaaatttaattggaatctatcattttgtggctggcttttattgtgaatttgctttcacggtactgtatagtgtattaaacacgtcgtgtgcttttctaaactccttgttcctgaaaattattctgatcaatagtgatgtggtatctctggatctagcagtttccctcattttcctgattctctttcaatcgaaatgtagtttttctatcagtttttagtgtattttaaaaggactatgttttgaattatttttcataccccaaatttagcagcattcgttcccttgttaaaatctccagaaccttctgaagaatctgttactgcatcattgaaatgcatgctgagcatcttctgttgggttgctctcatctttgaaccaaattaatgaggattgtagaatcatctacttattttaggcccctcaatgtaaattggatcggcccatctaaatatgaatggcctgacatacctaactggcccaacacattatgcctcatttggcatggttcttgtactagaagactactaggctgtgatagtgtttcacatgccatagtttgaagaaagaataactagggaagagatttttcatgttaaatactctgccatatggcggcactgcatgatagttggtgcatgtgtctcttacgagtcgattgaactgagcccatataaccatgttgcagaaacattatatccaagtattattttgcatagtaccttatagaaaggaaagacagtattaacaatcttgtagtcttctctcggtttttatggtttggttaatattgtttttttctactaatgttgtagtagctgttatgcatagccataagtcttcgaaagttaataaatgtcatttgacttggctttataagctactaggccagaatatgaccggcactgcttatttcaagaaaaacgtgcaaagcaaactgcacttgcatgtcccttaggaatgtgtagttgtaccagctaacaaccgtttgacaaggcatactgattgattagtgcttgatgtcatctgaaatcttatcttttgaaaactaaatggaagctggagaaactgtgacaccattagattaccattgtcaaaaacctctggattcaactattttttttttcaaaatggaagctggagaaactgtgacaccatttgattaccattgtcaaacacctctggtttcactatgaaattcatcaaaccatcaagctctttctgttacctgccagtgccctgcccctttttagggtgctctgatttcatttgcacctgtcaggtatctatagagagatttatttggtggaaagtaatttgactagaatttctgtttcgtataatatgatctctctctgtccaatacctcaaccatttaacttacaatgtcaagaatttgatttcccacttaattactaaaccgcatgctctttattctgtgcagctctatattaagtgtttaatttcttaaatttggggatactatgttcatgatgtttcaatattaaaaaaaggcatcttggcatcattcaatgtatatatgcatttatctgggccctatgtattcccaaaattatgaagtaaagtgctttgagtaaagggtgggcatatcacaactcatagaaagctataatctagtgggggcaaactgtactccaatgttccacaaaaggattaccagaagatgttgcattaaaaggtatggtcggctcatgctggtgcctagttcctctgcctaacctgatgtttttagtgttggaatcaagatctgtagtaaaaccttaaatccagtgtagggcacagccacacaaccgctggtctgctatcgccactctttatttttaccacttgtgtccaatatttgctgctatcgccactctttatttttaccacttgtgtccaatatttgcgaagttgttccacctttgcatctggatctttgctgttcatgtgacggttgcatgttatgagcctcacattttttttggctgatggtctcgtacaaaagctctctactatgctggagcacaaaatggaattatccttaatcattctacactttcgtctttgttagatgctcttgtgcagaaagtgcttttcaaaattcaatgaaaatgcctctttttctgcaaataagagagcgagaataaaacctttgatatcaccctttttctatctgtaatcactatgcccgaccattagtaaaaaagaggttgttctgctcaaaagttttgatcgattctctttcacctgcagctgaggttcttttttctagtgggcgtggcccatggaatgcctcaactttgatctttataacagcttagatgcttaacagcgacaaatcctttgcgtcaggcaaaataaaaccagcataccaatttgcgtactaatacagtaaacgtcaagcaatgtacatgtacagcttcaggacgccacatgtaagtatgcatcgatgcattgtcaactcatttttatccgtgtagatcacatttattttatccgtttacttttgtattagcacacatcagctctccctctgtctctcatctgctgatgtctttctgaagactatttatataggaagctttctgaatgctgtagttttcattttctgtgttctttttttctaattgtccagaacatgcatggtacatctctctcgtctatgacagcaaaaaaatgaaataaaatcatatacgtatatctatctatatgaagtgcttgcattttaaccttgattaataataacgctgtctaggatttgcaccatgttttgctgacaacaatattgaacctgttgctcgcagcaaaaccgaaccaaggcagcagcacacgagtggaacctgagcctagggcggagagaattagtatgtccgaatgtcgttactgccgtcctgttgattgtttacagagacaattgtcccatgtttaagggtctcagaacttgttttgccaggaccaggttcttgatccttgaactgtattttaattattgcccttgatatccaagcctgcttccccagctgcatgacaagcgtcctgttccatgatttgaatattgcagactgatccatgttgcctggcttcatttaagattggacaatgtgacacgatgatagcataaccgatgcttcattagcagcatcttatggagatttgacaacgtgaggaccacattccttggcttggatttagcttagcttagctctttctcccaggattaaatattcaaagatcattttactgatttcatgtgccatttcttgagctggcagctggaatttcgcagggtgacatgaccagaggcctggatggaaggacgcccgtgcggcagcgttgtcgcaggtttttttgtcaggattatcccaaccacccaactaatcccgtcatgtgttactctgagttttctcttagcagcataattttgtctttgacgatccatctgggcattatttaggatgtttagtcctaaagaaaagcttagtttgacggccagtatgttgaggtgtttgtcattttctttgtaacgaaatgactactttctccgtctcacattgacacattataatactattaatctttgtctcacaataagttaaattttatactaaatatagcatatcatagtaattatgaacatgaattcattactacgatgatgtatcacatgcagtattagattaattcattgagaaacaggagtacctaccgtttacccttggttgctcttagcttaatttggtggccttgctttttccagggaagaaatgctccattgctagctccctccatcgctttttagctgttaccactactgctactttaaaacctactcccacaactgaagataactgaaagtcacaaagaaatcttgcttaaatgtctagtttttgtcgacaaatatgtatacagtgaacccaatcattacagcatgtcaaatgactcgaattactccatgtttatcatagcgatgagtagggaaaaaatggattgtctaaaggtcagtctagcatgttctttttaagaattaaaacttatagatctacttgtatgaataaaataaataatatatactattaagcgagcaaattatttgaaaaaaaaaatctaagcaaggctgactaagaaagtttccgaaggaattgcagttttagaagcatgtcacgaataattcaattaatagtcgaggttgtaagctaaaagttgggaccttaagattttctaaagtaatttgctatacacctgaattatctcctctctctttattactgaactagcatggtggcccgtgcagattgcgcggctagcatcattatattttctctcatataatagcatatatgttttcttattatattattcaaatatattaaaatgacatcataattttaaattttgcaataactttacgaaactacaaatgtataatattcatattgtattttatatacgtgttagttattaattatttttaatatcaaattttagttatttgtaagttatatatattcctgtatagactctagactcatcttttcatatttctttttttaattctgaattttctgtaaattgtatttctatatagactctaggcacttcttctaatattatttatttttatttctgaatttttattatttctaattgtatttctatgtggactctaaactcatctttcaatattctttaatttttaatttcgaatttcagttacttgtattcctatattgactttaaactctttttcccatgttttttcttaattttgaattttagttatttgtaaattgtatttttatacggactcaaaactctacttttaattttattatgtttattctgaattttagttagttttaaattcctatatggactctatactctacttctaatattcctcattttttaatcccgaatttctatttttttcttaattgtatttctatatggactctatactctacttctaatattccttatttttaattccgaatttatattatttcctaattgtatttctatatggattctatactctacttctaatattccttattttaaattctgaatttcagttatttcctaattgtatttctatatggactctagtctcctcttctaatatttcttattttttaattccgaattttaactatttctaaattgtatttctatatggactctagtcttctcttctaatattacttattttttaattccgaatttcagctatttttaaattgtatttctatatagactctgctttttctttttctccgattaatgtgagaatttccaggctatgagagcgaacgtctaatattccttatttttaatcctgaatttctatttttttcttaattgtatttctatatggactctatactctacttctaatattccttatttttaattccgaatttatattatttcctaattgtatttctatatggattctatactctacttctaatattccttattttaaattccgaatttcagttatttcctaattgtatttctatatggactctagtctcctcttctaatatttcttattttttaattccgaattttaactatttttaaattgtatttctatatggactctagtcttctcttctaatattccttattttttaattccgaatttcagctatttttaaattgtatttctatatggactctgccttttctattcctttaataatataatagatttttcttcctaccatcctcctcaatggtgtagtatccggtgccagtaagacccgccgtaccatgccacccattcctcctcacaacctcggcgatgctagtcgcctccttctttcttgactccgatgaccccgcgtcgtcacctcccattgcctcctaactactctatgaggcttgatgaaccactttgcccccttatactcctccatctatagttaccctcacgccaacgctactgtcctccttcgatggctcctattatcggatctgatgtcaccttttattgtttcctaatcactcaaatgataaggcttttcctaccgtcattcttgcccgtgactgaggcagaaccaccatctcctccttgcattgtcatgtccgctaacccaccgttgggtcactactgcctcggtcatcctaggaacacctcccaccctcttctgccatcctgaccctgaaacctaaccaatcggagactagctaaagttcattagagatgaagacaacacacaaatctcagagaaaaattgcgatgttatgaattcagtgatattgcccacaaaaatgtcaaagtgatgtctaacaaaatcgctttctaaaaaactaaaatgtcatacctcttggcttcgatgacgtcactgctgccaataaggagaagatgcgctcctaattcgtgctccacaacatctgacggccacaaaattgactggttagcaactactccctctgtttcacaatgtaagtcattctagcatttgccacattcatattggtgttaatgaatctagacatatatatctatctagattcattaacattaatatgaatgtgtgaaatgctcgaatgacttacattgtgaaacggaggaagtaattagcagcccgtcaggaaaaaaaaacaacattctattaaaaatttcaagagaaaaagaacagagttttgcaatgagagaaaagagacactgcaggggcaacatggacattgcaccgaacggtccaaggccaaggagaggagacgaccccctatatctgcgccgtgccatgccgtgtagtcccttgcctgctcagcacgctgcactgcactccaaaccacacagcctcctcgtctcgtcttctgtctcgcgcgcgcacgccactcgctgggagctcatggaggtcggctcgctgcagcacctcggcgacagcttctcctaccggtggctcaagcacgcggcgcaggcgccgtcgttcaagcgcctcgtcgacgacgatgtcggcggaagctccaggtacttcatcgacatggaccccgccgacctcttctccatgcggtggacggctccgggcaccgacttcgacttcgacttcgacctgcccggcggcgacgacgatgccgcctctccgatcccgctgctggtcagcgcgagccagatcttccacgatggccgtctacttccccacgagctcgacgacgacggccgcttcggtgcccaagaagacggcgatgccgctcgcgtcgcgcacttgctgagcgagccccggctctcggcctcgtcgccgctgttccactcagcgcagagcacgccggcctcgctgagctcgtcgtccagcgcgaggagcggcgccagcaagaacgccagcgcgccgccgctgctcgccgcggggaggcgtggcggcgggtcatcgccgtggaagatactgctcaggtacctgcggttcctcatgccgctctaccggaaggtcagggcgctgccgccgctgcgtgctccgaggacgagggtctcgccggcgagccccgcgagcgcgagagcaagggcgtccacgtccagcatcgactggtgccacggcattgccgacacggccgtccatgacgccatcctctactgcaagaaatccagtgtaagtgcaccgaaaccatcaaacacaatcaagcaagcatccatgcacattcacacagatgttgattagcatttaatggcagttcttgctcaaatagtttcttgtcatatttctttcagggacaaaatatatagccaggaacaaaggattcacaatctgcaagagcatgagctgatcttgtggcctctcaactcaagatcctctcgttttttccaccattatttttgttgtacatccacataagttatacactgtatatgcatgtgacaagctgcatgaggagtacgtttaacggttgtaaacagctcgtttagggtgtaatagatggctccctttcttgtctttctcgtttgtctttggccatgtgaatcaattgagcatttctgaccattcctgttattaattaagtgaactaacaagaaattcataagttagattaaagcatctagatcatttgttggctcaatcatgtgccttttccgagcataatcgtgtccctactctaacataatccgcgggagtattattgtactagatctcagcaaagaaatcctggtaatactatactgctgatctggtactcatttagcacgttctgttaacttgacgctccagtggtgcctattttgaaattcatttgtaacaattcgatccccatgaattgaattatcctttccatcatatcgatgtgaaagttcaaaaacatcacttttatgagtttttttttctccgtgtggaaagtgcaaatttttagtgaaaatcatcctgactactcagttgtaattttgtgatttttagtcagaactttgttcaattttagcacaaatttaaaattcaaaacttgcaggctgctttaaaattaattttctaagtaggccttccaatcttctacttgaaattagttgcttcaaaatctcccttagaatttgcagtttaattttgaagtcttgaaattcgtggtttcaagttaattaatttcaaaatattgaaaaggcaaaatcctaacatagttaattgttgcgcgctatcatgtttgaacccgcaaaacttcgtcataataaactgtgtgttgcagataggattagacatataaaaattgcaacgatttagacagttagtaccttgtaatgcctccatgtccgtatccttgtttaccaagctcgaatttgaccagcaacaataatatataactagagtcataaattgttcgaagcaaaatcaattgaggtcccgtacacacggcaaccagaccaacaaatatctccaaatataaagcctaaatgcgccattaggatgggccattacgtcgtcgatgaatatatgattagtaccatcagtcgatcgattgggcaggagttgttcgtttttcccaccaacccaagagaaacagaaatgttcaacacaattgttaatttaaattcatgcacgctgtccttgtccaattacacgagaatgtctcaaaaaagagactctgtatacaagccagcgtcagcaacaacatgcatgatctctgcaagaaagcaactctaaattagggcagtaacagtatcatagacttaaaaaaaatgcttgctttgaacgacaacgcaggtaaaatatatattcatgaacagggatattgtttcttaaattaagaaacaggatgcaagaagaagtaaacgaaaggaacccccaatataatgcaaactgatttaattatgaacgcagcaatatgcaaattggattgcgacgcgtgattcgtacaggctaaatgattaaacaagcacgcccaattgcacgccaaaatatagcagaatcatttgtttcccgatggatcagcatagctagctagacacgcacacctgaattgactggctaaacccagaatcagtgagtgcagagccgtttggtgcatcagcgtgaatgcacggttgcagcaggcgtaccaaagccacgcagtcgcacacgtacacgccatgggcgttccaggcgatgccgtgtatatgcagatatatctgtatacgcacgtagatacgtcaaactccagtggatttatcgtctcaaaatggtcgtatcgatcgcgttttaaaatttaaacgtagcggtccatgcgataagatgagcaccgtacatggatacgaatcggccgggaccagtaccagttagcagataattaacgtgctcgcagagttgtcgtattgccgcaacagatgatagtactagttttcgaggcagaacgtacacagaccggaccggttcacatccattaccacataataatagtatcattacagttattaacatgtgagataatagaaggatgagattcatgtatcagtaactataatgatagtgatattatgatagaggctgtgtttagttccactggtaaaaaaaaattgtcgggtctaacatcaggtatacggatacggatacacatttgaagtattaaacgtagactaataacaaaataaattacataatccgcatgtaaactgcgagacaaatttattaagcttaattaattcgtcattagcaaatgtttactgtagcatcacattgtcagatcatggcgtaattagacttaaaagattcctctagcaatttacacgtaaattgtgtaattagttaataaaacagcctacgcgagctggttcgctcagctgcgtttggaacagcagccaacgagcggtcgagcagagtaaggccgaaatgagtagtagtttttgtcacgaggcgggcggaagagaggcgagacgtgcgcgagcagcggggcggcaaggggaatgagctgggcctacgtgcacgggagttgggtgttcggggcgggaccaggtggtgcacgcgtggatgggagcgtgagggggggtccgggtgatgagggggatcgatcggctggctcgaccgatcgaggggatccgcactgcactagcacctgcctgccctgcccgatcgatcagcgattcggtgcccaccgcggatgtactacgtacgtacattgcccttgtcgcaagctacctagcgttgcctcgttaacagcaggcagacggtggacgtttggaagcccacgaacagcggcagctcatcagccgatcaacgcgaggaagctcaaagcttgacgtacgacggcgtcatcgtactgccacacttggttaacggtttctgatgacttccagtcataagcctaccacatctgctccaaaataagttaacctcgtatggaatatgactatgtctaaatttatagtattacaatgagagagactagagaatgaaatctcattaggatgggatactttaagtgactttttcctgatacctgatacccgagtaccggctggtacctggtaccctggtatcgagctggtacctagatatcagaccttggtacctgggtaccaggcatcatacccagagagagagcgaacaagacaccaccgtcggccgcctggtacctgggcatcttgacttcgcttgaggcagagagacgtcgccgcagcacgtggcggcacggcacctggaccacaccttcgagaagctcgcgtcggcgcacctcccgctcatggcggcgtcgcccaccgagccactcacgctcccctgcctcgcccaccgcctcccgctcaggctccaccgacgaggcgcactccacttccttcgcctcttccctcgcgtgtttgacctccgcgccctgctcccgctctccctctcgctcaccgcgcccaccgctgagctcctcgctgtcgccaccttcgccgcctaccctacggcagcggcggcggcggcggcggccggctccggtgagcggtggggcaacgacgaaggggagggctgcacctcgggtgccatctgatttagggaaggagagtgaggtaggaggaggggatccggattagtaccccgtcttcatgggataccgatgtatagattttctctattacaatgtatcatatcccgtacaagattagtttatttggttcggatggagtataagagaagaaagccaaaataaaaactgtctttgtcaccatgcaacgaactactcgatctgcctgatcaaaaccgtcacagctcccggcccaaatagtaaggcgaagcaatacgctacggcctacggtagcgatcagctagtagcaacgcgagagaatgtaagtatgtaacgcgtagagacggatcgatcgctctcgtgccggtcggtcgcgggctcgcggccggtgcgcgctagttcacgtcaatcccacgtgaatgccatgagcggcaagggggtaagcggacaagcgagctatcagaggccctcgcgtcgcgctacccgccgctccggttgcggggggctgtagctgcacgggacaacgccggctttaatgcgcgccttggcgctgcccgcgtccgtcgctctcccggccggctgggatcctgactcctttgcactgcttttctttatctggacgagccaaaacctgtggtttcctaacgttttcagattgattgagatttggaggtttggcatgatggattgtgtttggcagcgtttcgtatcgcttgaaatctactacgtacacggtacacggcccgtccttctggaacaaacatgggaagatggttcagcccgggccattctcctcgcggagaaatcgaaacattaggagttgggccgtgagcccatctgcccatggcagatcaagtaagtggtggcctgtcatgatctcttccaggttaggaataagtctactttgcttttcttaactaggggtcgaatctgatttgtattcctaaaccataataccagatattttgacaccctcgactattaaaaccagtgcaatttaactctctcggcggtttcggaggataattttactgacatggcgtcccagtcatcaaataaattttttaaaatgtggggcccccttgacatctcatccctctaataacctctctctctctccttttttcttcttggcgcacggtggctgacggcacaggcggcgagacaacgacagggagcggcaacggcggcatctggcggcgaggacgttgcggtggggacgacgtgtgaagcccgagggttctcggctccttccatcccagaggcaatgacatccatgtggcaagggcccgacggagggggtgccaactgcggctgttatagtggtgggcgcacagggtgggctgcccgatggcagtagtccagggtgacgaggagggccccgtccccctgatggcggtggtatggggaaacggatgtcgctggcaccgaggaagcggtggcttgtcgtcagggctggatccagggcatcgctgtgcctaaggcgaggtcaaggcgggatatggatggtggcgtgttggcgatgacttgggggctcgaaggatggtgccggcagcgggcatggccaccctctagtggtggcgttgggggtgctccccagtcaacaatggagtcatgggtggcggtgacacaacggggttggcgtggcctggccggcgaatgtgtcgaggagctggagatatccccgcgcccctctccctcattctgttgttgcctgccgtctcgctcctcgtccaccgagtggcccttcatgcacggagcaaagggggatgagagcgggggaagatagcgtcagcaccggcctcgtcgactgcgtctccgccgatgcgagcttgccttcgctccgcgtgtgaaacaacaaaagaaagaaaaacagggagataaggatggtttctgacgtgcggaccccacattttttccctcttatcacttgtcggtcatatgtttattttttaatttatttgatgactggactgccacgtggacgtcacgtcggtgaaaaccactcttaaaacagttgagagagctaaattgagctagttttcatagttaaggggtaaagatatctagtattacggttgagggatatgaatcatattgaaagtatattttgagagagtacaagtggacttaatcctccaggttatggttgcgttcggctgcactagttgtgaatggctgcagctagcagccggtgtgaactctgaacagagcctatgcccatcgcctactttttgaagttatctcgatcaggggccccgggcaacttgtacacgccagccgaaactgtcagcaggcacctggccagctaggcggcagcgtatcatcgtcagcacccggtctatcaccaaacaatcagcgccgaaccgactatacacacgtagtactagtaattgaatcggtacaatgaactcgtactcacgaatccccttaattggtcaatgctcggaacaccaagcacaagtcaatccattgcacatgcaggtagcaggtgttgacacctcttgacacagcacatctgccgtcctgcctccagctcaagtggccaagttccccagaacaaaccaaaaccttgtgaccacaagctcacagcttttattgtcatctcacagtctcacagaccatctagaacgctgctcaaaaaatcaaaatcaggggttaaatccaaaggctccatccaaaacccagtcacaatgcagagctagagattaagcgagtctaatgcaatcataatccgttttaattaagctcctctcttcagagcaaaaggtgccaatagtttgacatcatatcgatcctattcctgagagccgccgtcggcgtcgagacataaaaatcacaaatggatcgtggagcatgtgcttgccgcaggcaatgatgaaggatcagcattctcctcagaacagaaacaacggcagcacaatacaagcatactaccttccagggaacgaagccgccgggatggaggcgagcaagtaaagcttcagggagccgcacagctaagcctagtgtgaacaataatccggcactaagcatagcatcaatttaatacaaatcggcagaaaagcagtgtgagtgtgtgaggctttgagctaccaccactgtgattagcacgagctcaaaagatgatattattcccatccaacgaatatttggtccgagtttaatagtggcacactccaactaaacaactgaaaccactatcacaacttgcagtagcagtataaatagggcactggtcagcaacgcatgctcgtcagacagcccaaaagctgagagagagcacgcatccaaagttccaaactagtctgcagctgctgttcgtgtgcatatccagtgagtgaagtgcaggaagatgaccaaccatggcgccacctccgctgctccgtgcagagatggtcacggatcagcagcaagcaggagacacatgcccaggcgtgggcagatcaaggcgaggattgtgtcggcagccgtgcactcagtcgcctcggtgctcttgaaagccctccacagcagccacatcctggtcagaaaccccttctgatggagctatcagctagtataccgaaattaggcgagttacctgttcggctgtacctggaatcagctggttttcaagtgtaagcatggttcagaaagtgatagcctagatggatgtactcatgtacatttctttctccctccctcgtttcgcatcttgtttgtacactagttttgttattatcaatcacacagtgtggttaaagattaagcaagctcttgctactccgacccgattgcctttctctgctaccaattccgcctgatgatggtgagggacgcgaaccgccgcaccggcgttgccttcctcttgcgctgccggtggagagaatggccgcctcagccttcagtttcgagaattgccttcgcggcctcacgggcggcggagaacggggatgtcgcagactcgtcgggggacggcgcgtgtccgcatctcccaaactcgcatgtagaacggcgggaacgagctctctcggtatgcacaacactgcagcaactccgcacgccggggatgtctgtgttgtaggctcgtagtcgtagccatccaccacggggatttagatccactgcagtcgactgatcatcggcctcacatatcaggcacgatacaatttgctgcagaggatcctgaatttctgatcaccgccacggcgccacatcgtccaacaagagtagcagggccgcgccacaaggctgcagaagaagggggacgaacgggaacgacgggacgtactagtaaaagtcagtaacggaaggcggcggtaggagagggggtttctcgtttagacccgtctggtaagtcgtactggattgcttgggtgtgccacatttagtgggctttctgaaacaaacaccgggttgcaattacggcccatgtaatggagcctacactattcatcctcctcttccttttttttatataactcctctgtcctcggctcaaagatcagaatgtagacaatctcaatcacaattacacccattttccccaccgtttcgaaggcatcccatgctccaattcatgatggcctgggtcatccgtgccaaacctatgacttcatgccaaacaagctttcggtattcgttacaagtcactactcttcttcatccaaaaaatataattaaaaaaatcatctaaacacctgtaagcaaaataaaattatttttaagagcttgttcactttgttgtcaaatcaattttatcaaaatttattatgttttaatgctaccattttttggtaccgttggatatgttcaatttgatgtcttctaaaattttataatgttttttcgagataaaatttttgaaacttctcaattttgttaggatagtattggcaagatcattttaaatttgttaccatactataaatttagtacattcaaagtgaacaatgtctaactccatagacatgtgggccatattctctctccccaagagtcagcttctatgcttaatgcccaatacttttattaggactgctaaaaagatgtctataatgtatagaaaattcacactgtggatgctcttataataaatactcactagtaaggatgcatttatcatgtgtttggtcatagggatatgatgggttgggttggagaaaactagttctttaaagtgtttggatcagggataggtgagatgagatgatcatgattcctgaaaagtaatatttccttcaaataaaaggctccatcccttaaataaaaggacggatcaatctaactcactttctctcttattggcatccgggacacaccctccaaacccttaaaaatagtaccattccaacccttgtggcaaacatatactcccaatcaaacacaagccatcaggcccgccagtccgcaacggcatcatggatggacataagatcgaggaagaagcaaccacgaggaaaagaaaacgaaggattcgccacccacgctagcaattttcttctgtcaattcctttcaccattttcaggctgaattttgtcaggcttccagcccaattaattaattaggagtaggatatggtcagatttttcttctggcaattcatgcctgctcgtggatcagaccgtacaatttacgagtacttcactgtttcctttctagagatgttgtgtttggtcagatttttcttctggcaatcatgccttatccaaacagagaatggcaagatatcatctcacacaaagaaagcaaccagccattagtccacagtggcacagtacgtgttgccttgcactcttcaccttcatcacgccctgcggctcaagattcgcatgctcgtgttgtattcaccttgcaaggcaaaacacatcacgagttgcacagcaaaccttcgcttggacagaacgagtccacagccttaaccgccatgcaatgcaccacctcaaatggcaatgggcattggcagaaagcgagatgtctcggccggttaaaagctccatggacgcagcacacgcaagcagttattgccacgtctattggctcggcaagtttggcatagcaggcagaaagcaatcaataaatagcacgcatttactggggggttaacataggcagggattgatacaggacacacccgtaatatcctccaccggtctaggcactttctgtatctatatatacgtaagcacgtcctgattcttgttgcatttctcgtcctgatttgcgtcctgcagctctctctcatcacagtttcgcaatggccaaaaaaacaatactgcaggtaagtaacgctctccgtctccgtccaatccgatcaattttcgtggcgtcttaggattattattttcttatagaatcaagaaagggaattttggttggttggttggttgcaggtggtttgcgcggtggcgctggtggcgctgtgcgcgtgcggcgtcgcggcgtcaccgtcgtcgccggcgggagcggggtgccggaagcacgtcgcgaggatcacggagtacggcggcgtcggggacgggaggaggtccaacacggcggcgttcgccaaggcggtggcggacctgtcgctgcgcgccggcgacggcggcgcggcgctggtggtgccgaaggggaagtggctgacggggcccttcaacctcaccagccacttcaccctcttcctcgaccacggcgccgagatcctcgcgtctcaggtgatctgagccaccaacaacatcggttgcatgcatcaaccccctctcttattaccatttaccatgattaactgcgccattatctctatctctatctcggctggtgtttcgccgcgaaagtagcgcatgttaaatgtccggttcctactactagctctaattcacctatagctaatctaataaccaatttatatgatagtcatgtcatacacacattgtatcttggagtcgagtccgtgctgcagctgactacatatctgtagctcactgcttttctctctcatcttttatctcattaaaatatattgtagctagctaatagtctgctatttttctctctcatcttttatctcattaaaatatattgtagctagctaatagtctgctattgtcccttctcttaccgtcacacttgtgaccaaacagtcacacgcgaccgccctaaagttggcgggtactagctacttccgttttattggcgtagatgatgctttttgccagggaaaaacgccttttttggtctggggtcccatatctgtcctcccaggctcccatctgttcttgatggaatctcaaactggcaaactgttaatacgaacattaacatgctaaatgccacggttacatgctgtattttttttttgtcgtaatcaaccttatctgattgtcgctctcaagaaatgggaggacaacgtattaaggcggcgcttaaatatgtgccaagagctgtatgttgggagcttgaacccggtgatgtgtcattgcaattgcggtggttgcctattgtaaggatgagctggtggctattgaatacatgtaaatgaaccggttttgatcagatagctgattaattagtttggaccattgaaggtcaatcgatgttaatgtgatccgtttcagttgctaaccgtgccgtactgagagaaagagaatggattgggagtgttaggacaaaagctctgccatgtcatttcagaaatttctactgttatatggttgctccacttttatgctttgaattttgtcagcacataacttgtggacctgctactcttatctgtttttgttcacccgttttcagttactagtgtaactggttcatctctcattatctgaagtgttgacagtctaagctgttcatttcgttcttcagaacttggaagattggcctctgatagctcctctgccatcctacggaagaggaagggacgaaccaggcccaagatacagcaatttcattgctggatccaatctcacagatgtcatcatcactggtacacgaatgaatgcgtgatgaagattgctattttctcaaccttttcgtgtaactgctgtgattgtggtatatgtttagctgtggatatctgaaattgagcaacatttcaggtaggaatggaacgatcaacggccagggccaagtctggtgggacaagttccacgccaaggaactcacctacactcgcggttacctgctcgagctcctctactctaacaatatcatcatctctaatgtcaccttcgtcgactcgccgtcatggaatctccatcccacctactgcacgtaagaatcatcagtactcgcaaccagaattcagtttctgaacggttagatatagatcatgatgctcaccttctttgtgttccgtgctgcgccagcaatgtgaccatcagcggcatcaccattctagcacctctcaactcgcccaacaccgatggaatcgacccaggtataaacatacaagtcacactgcacttgatcaatgctgccatgaggaaagcattggtttgtgctagatgtgatgagctcttgttgtccatggtgcagattcttcctcccatgtcaagatcgaggacagctacatcgtgtccggcgacgactgcatcgccgtgaagagcggctgggaccagtacggcatcaagttcaacatgccgagccagcacatcctcatcaggaggctcacctgcatctccccgacgagcgccatgatcgcgctcggcagcgagatgtccggcggcatccgcgacgtgcgcgccgtggacaacgtcgccatcgacaccgagtcggccgtcaggatcaagtccggcgtggggcgcggcggctacgtcaaggacgtgttcgtccgcggcctcagcctccacaccatgaagtgggtgttctggatgaccggcaactacggccagcacccggacaactcctccgaccccaacgctctgccggaggtcaccggcatcaactacagcgacgtgttcgcggagaacgtcaccatggccggcaggatggaggggattcccaacgacccctacactggcatctgcatgtccaacgtcaccgcgcagctcgcgccggacgccaagaagctgcaatggaactgcaccgatgtcaagggtgtcgcctccgacgtctcgccggtgccgtgcccggagctcggggcggcgggcaagccatgcgccttccctgaagaagagctcgtcatcggtccgcctgaattgccaacgtgtagctactgaaatactgatataggatgatagtatggtgtgggtaatggcctgggctatgagatgcttgggaccaaagagatatatatgatgtggtttagtgagtaaagttaagcagtttgaaaatgctgccggataatctctttacacccaattcatttatgagtgctcatctgcgaatgacctgaccaaagcaaagccttttcattttgtcttctgacagtaaatacagcacgtgacaagataacaaaatcatcaaacttctaaacgaaactttgcaaaaacaatgacaattgacaaagtgagaagcaaagctcaacgtgcctaggcagcggtttgcaatcaccgtcttcccctgcccttgctcatgaagtggtggcgcttcaacctcttcttccggatcaccacggaggacttgatgtgctccgcgaacggcatgccaaggagggtgagcagcctgagagcctcgttgtcggtcttcgcggtggtgacgatgcagacgtccattccattcttcttcccaccgacctcgtacgggatctccgggaacacgccctgatcacgaaggcctatggtgaagttgccatggccatcaaagctgttggggttgacaccaaggaagtccatggtcctaggaagcccaaggttgatgagcctatccaggaagttgaacattacctgcagcaagccaaaataagctcatcgatcaaacatattccctaggttcccaaatacttgtcactggatactattcatatttgaactttgatcacttatattttttagaaaataaaatgcatatacctaaaaatatgccatattattaaaggttgttactccacatagataggtattaaactttcgttcgtccaaccatttaaaatttgtggtcaatgtaaaatactgacggccaacggtgacaataatttggaactggatggagtaattgcaattctcacacatactttaggctattatactgtcatgcaaatcccaaattgatacaacattgcagtccccaatttgtcaatgtctgcatcgcaagtagccagaggtacagaggactcaccctgccgcggagcgtaacggcaataccaatggtgttcccctcgcggatcttgaaactggcgacggacttcttggccttcgtcttgacgggccactggccggtgatcatggcgaggtccttcatggcggattcgagccccttggagttaccggcttcagcccccaacccgcaattcactacaatcttctcaaccttgggcacctgaataaaatcgagaatccaaaacacactcctctaagctcaattattgaacaacaatcgaatttcccgagttccgcaaagaaatggccatgtctatcctataattgcgagaagggagacagaggtcgaacacctggtggacattggtgtagccgaactcctcggtgatgagggggaccaccttctggtcgtatacagccttgaggcggtgcaccttctgtgcctcggtggggtcgacgaggacgatgcccgaaggcgaggtcggcggcggcgccggcttgggtggcgcgtcggccgcggcggaggcggcgacgcggagggctcggcgaggaggcggggagcggaggaggaggcggacgttacgggaggaggaggcggtggtggtgacggggaagggggccggcgaggacggcagggtcacagccgtggccgccattggagcgtgcgcggagacggaggtgggagctgaggagggagctttatgccatggatggattacgggataaggcgagttggctgtggctggctgccgttgctgtccagtgtcgcaggtgggctttctcgtcatggttcggcccatcgaactgttcgacatggtttcaggccttaggcccatcaaaaccgttgatttgggccttaggcccatcaaaaccgttgagttgggggtgaactaaacacggcctaagagaagggtaaagttacatgagtcaacaactgcaagtctgcagtgtgtgaatttcgatatatgccttgttttggtcaaccggtaacagtgtttgagtatgtggcccattctgtattttctaatgcactacaggacatcactagtatagtagtagtatgccattaaacgatgacttcaaacataaaaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaaggtcccagatcacaacattgcgcttgccctaccttgttctaccaaggaccagcaatgccacgaccgtgatcctgtgaggatcgacttgacaccaagagtagaaacacaacggacaatatcttccttgtcagtttgcaacctaatcctgataaactacattaacctccttgacctcaagaagtaactgtcagtctgtgaccttgtcacttgtcagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggtactgattaatatatatcattaccagcagtactagcaaaagcatcagccattcagccccagcacatcatttctaatacctgtgtgctccaccgtccaaatgagcttccaaatatctatctaaattattcttctattaacaggacagaaaagcatattacaaggctacaattgccactgaagcaaaaactaataagagatgacagcaaataaaaagaaaaaaatgtgtgataagtagctctcattggatcgcatctaaggtctctttcctcttaatcctcctcttgatctccttctccagctcctcaatcccacccacctcctccagctcctgtcaaccacataaaacagagacattttagaacatttcagacaatttttccgacgatcacaaatatttgtaatacatcttagaacatttcaaaatttccagtccttttatatcaacacagttcaaattctacattagcttcccaatcacaaattcatgcttgcaataaaggagtactgcaagtatgcaaactactcgacaaatggacaccgttggagcaggagtaagccaacaagcatccatggtagcatggggcacgaggaagcaaagcatgaatagcatgagacacatctcctcaccttgggaccaaggaacagcccatatggcacaccttcgaacttgtccatgtgatgtatctgcaagaatgaatggcaggcaaggatggatcagctcacataaattcagaaccacggcaagagaagctcagagacagggatgcgtggtcggctgcagttaggtggagagcgaccgggccggacctggtgggcggcggcgacccgccggaagtagggcacgttggcgatgggccccaccgggaagcggcggtggaccaggccgtcgtggacgaacatgtacgccatcccgaacagcgtgatcccgagtccctgcggcgaacggacacgtcagcacttggatcatctctgcccagagccccagatcacaaaaattcaaccttggcaatcaaattgaacaaaaagaaacgctgctagcgcttgtattttacttgttccggtgagaccgttgatgggtacctcgcatgggtgaccatggcgccgtcgcaatgcgacaacaatacctattgctttagtacaatctacgttatagggggaactatttaatcattcgagggatgttctctcatttgcttacagaatatccaaaggttatgaaattttttgacaacactcagataacatatctgtgcaactacataaaatcttatattcaaactcaactcacacgttgagatataaaaaattaaattcaatgtatgattagtagcgtaatgttcacatctgaattatcttttcttttattcgtgttgtgtatatggaagttgaacataatttttggtggactgatagatctcactatactctacattattactttttaaaaaaaaaaattcataactatttgtatcgaatttgaaagagaaaaatatacgagataacatccctcaaagatattagaatccattataggtttctctgggaactcatggaggccaggccactccgtttttctaaattttctcgatctcgaatgttcaattttttattgtttatccgatgcagcaaggacatcaagatcttttggagttcgctctacgctttggcttctcttgacagataaattcatttttttttggcaggcggccatggaatgtgaatgtaatcaactgaacatagtactacatcatgcacttttgtcattttaatacggccacgttaagcacgcttggtcaaatcctggtacagtgtgtttgagagaagtgatggggatttggttgaaatggaggaggatcgaccactcaccgcgccgaagcagaggccggggacgaggccgcgggtgaagaagccgtaggcgaggagggacatggccgggacggcgttggtgatggcgaagacgtcgttgagctcgaacggcccgtctcgcgggcggtggtgcgactcgtgcatgtgccacagcgacgcgtgccacagcgcccggtgcgcccaccgcgcccagaactccatccccacctgcgcaaaatggcaaggcaaaaccaacacggttacacgagcgacgcgcggcgtcgtgcggacggtgcgtgtgtgtgcgcttaccgcggcgcccaccgatagcgcgaaggtgccgaacatttccgtgaccgggatctcgccgctgccctggtcgagcacgcggagaaattttagtgctgcggcgaaggaattgccgaattgggtaatggtaagatgcgagcgggagtttggcgatggcgtgttacctacctccatttgccaggcgaagcggtagtagacggcggcggcggccatggacgtgatcccgaggctggacatcaccgctgccaccaggtacgtccgccgctccgactgcttccgcgccgcgcgctccgccaccgccctccgcgcatcctcctccggctccggctcacccaccgccacgcgcaaggggacggccagccgccgcgccgggagcggcgcgaacgccagccgcagcagcgccgggggcgatcggtgtgccgccgccaccgcggcgggggagaggagaggggcccgcgcggccaccagcctcgcgacggccatggatgccgcagccgcagcctacgcgaacgcggacgcggggatggatggacggttttgattgggcgggtgaagcggtccgcgtccgcctcggggagcgagaggcgtcgtccaagacaagtgggtcggatggagtcgccgtcgtcacgagtcaacttgtgattgtgagcatggaaattcgtgaggaacgccggctcggacccggtggcttttatataggagtatcaggggccatgtggaaacagcgacttattcacgttgacactaatttagagtattaaatatagattaattataaaaccaattatataaccttatactaattcacgagacaaatcttttgagcctaattatgtcatgatttgacaatgtgatgctacagtaaattttttataattatagattaattagacttaaaaaattcgtctcacgaattagctctaatttatgaaattagttttttattagcatatttttaacactccaaattagtgtccaaacatccgatgtgacacggactaaaaagtttttagtcccatctaaacagcccctcattactccctctgtttaagatggtataaattataatacaatgtatctggatatacctctgtctatatatgttgtattagaatatgtcacattctattttaggttgttttttttttctggagggagtaggcacgaatgcacgatgcggatgcgagctgagtcatgcatattttggaatggaattattctcagatcatcagcaattggtgtattggagattaaggtctttcctgaagctggggttatctcgttgccgctgggtgattggccaggttgaggccgcttgcctgagctaccgcggcgtcaggggcagtggaaaatgacattgcaggttcagggcacctgattcgccacgtggccgtctcaacgcatccgcgcacgcagcttctggtcagctatacaccgcgccggcgagccgtcctccgctgcgtcgccatcacaacgagttactcctgacccctgatctcaagcgtcggagttcacctttcgattgagcgctcgattctggtctgacttataaaggtgcgacatttttcatcattttcttatcgggaattggctgtttattatatatctaaattcttgaaaactattcaaaatctctttcagcatatactttcatcaagtatccaaacctcaaaaattctgagatttactatcggttttcgtgaaaaaacgtaaaccctaactgagatctgtatgtagttcatgttctagctcatcatcgttctgctccatgcatgccatggccaatgcttgctgggcacaataatttttaccaccacacttcttcttttaggcatagctcctttcctttgtcgttaaaaaattggagaggatagaacatctttctaaagtacgaactccacctgatcatgttcgcttatccagaataggaatgtggctgcctgccctacgaacgccgtaggccatggaaggggtgtgtacgtgtcagggcagcgtcccgacgcgagcgtttgcccggcgaatgctgctgctcgccgccccactacgtggccactggcatgtacccaccgcacttgccgacgcccacgctttcctcccgctgcagtcacgcttcagcagctcagcacctcccactcgtgaattgggcaccccatgaaaaagatggaaaaagaaccaaaccgcttcaacctcaacgatctactattaggggtttacaaaaccacacgattaacacacggttattacgattaccatgcacgataacctttgtagtttttaaaaccacggtatgtcttacggttaccgcgcggtaaccatcttaccgcgggagttcggtaaccgtattaaaaacggtaaggggaaccctactacttttactcagaaccttagatgctactcagatcactataaccactgggctatatgactatttacgaagccctactactatcccccttgattatactcgcaagaagagacatctagatcttttaccttcgccctggtgtagtcaagtctcatcgtttcgctacctgcttacctggtgatcggtggttcggtacaaacacgacggaatatacgagtgctctcgtggtgccgatggcgacgcgcgacgagaggccacctgacggcgacgggagcctcgccgtagtgggggcggccgcgccgcggttgctcgcgctcggcgacacgtacccgacgggggatttaggataactggttttcggaggtggacgtggtggtcaaacgcgcggtgagttttttaattgggggaaacttttggatgatttggatctccaagctgccgtaacagtgccacctattccattttcgcggtagcctgatagcgtgaagtgtgaaccctgaaatggacggataatggaatatggcaatatcgcatacggagtatgcaaatgaccgaatgtgtgtgtgcgggtcgtcgtccacgtttctcacagtctcacctgtctacgacagcaatcgactactactcctccgtctttgattttaatattttgtttgtactatttaatcatttattttattaaaaaaattatacaaatataaaaaataaaaaattgtgtttaaagtactttagataataaagtaagtcacaaataaaataaataataattctaaatttttttaaatgagacgaatgatcaaaacagtacaagcaagttaaaatacgttatattagaggacggaaggagtactacggattgattgatggatcgggatggctttgaggacaaatatctttgctatctgcttagctgcagtcgatcgagcagttaactaattggtttctactccatggagtaaaaggaaaaggaatgaagcatctattgttctctgaaaattgacaacagctcataccactaaacacgctaagcatgtgcaagaaaaataaaagaagagcggcaaaacatatactctctccgtcttaaaatataacaacaatcaatcttgtatgttcagatttattgtattagaatatatcctatccagtacaaagttgctatattttgaaagagatagagtagcagtactaaaagcgctaaagcatgtttttagtaaaagaagaagaaaaaagcgactcaagttctcaaactcatgcttaacacgctaaacatgtatagtaccaacagtacatgttttagcggcacctttgaaaaactaggggcacctttgaaacgtatataatattaaaaaaaatagatgaataaaaaacacataattttaacagaataaaagtacgaaacaaagtccattaacataattaattgagtattaattattacaaagcttgaaagataacttcatttgacttttaaagaaatttctatataaaaaagttatttttagaaaaatcatttagtcgtttagaaaacatgcttatagaagacaaagagttgtaattgctaaacgaaaaaataaacgaggccgaagtgaagctaaacaagctatgaaattaaataaaagaaccaaacatgtactaagtaaagctaaacaatcttttttgtttggcatgaaagctaaacaatctaaaacatgtactgccaagtaaaacaatatagcaaagcaaaaaaaaaaagtaaagctaaacacgctaaaaacatgaactaccaagtcaaaaagctaaacatgcactaagtaaaacaggtacgaagtagaagcacatttcttttacccattcataaaataaatgtactaaaaaaacctgaaccacatgtgttcgctatttaaggttcccaaccagaaccctccgtacggaaaacggagcgatccattagcgcgtgattaattaagtattagctatttttttttttaaaaaaaagattaatttgatttttttaaagaaacttttgtataaaaactttttcaaaaaacgcaccgtttaacagtttaaaaagcgtacgcgcggaaaacgagagagaggggttggaaaaggggtgtccgaacacaccctaagtagaagcaactaaacatgtactagctgagaaaaaaaagtagaaataaactaaacatgtataagtaaaataataagcatgaaattaatacacgtgctaataagtataaaaaagaacaaggtaactaaacatgtactaattaagttaaaaaagtacaaagcagctagacgttgtactactaaataaaataactaacaaacatgtaatcaatacatgtcccaagtaaaaaaaatgcaaagcaactacccctctgtcaaaaaaaaaaaaaggtccaattctaaggacaaatctggattctgaatacatgcaatccagatttatctctagaattaattttttttgacagagcgattaaacttgtagtagaaaaataaaataaaacatgggccaactaataccacctaagtactccatccgtctcaaaataaatatagttttgcactattcatgttcaatgtctgttcatcttacttgaattttttattagtatttttattattattaaatgataaaatatgaatagtactttatacgtgagtcttttttttcataattttttcaaataatacagacagacaaacgttggatacgaatatccatggctacacttatcttggaacgaatgcagtatatactaactccgccccgaacaaatataagtctaggttgtttagcatgtattaagatttgtgaagaaagattattatgcctcgcattaataataggaaataattttaatgataagtaaatgatgggacaattaagaatattttattatgacaaatgttgtaagaaaaattaaatcatagaaatataattattatgagatggaggtagtaatactaggacaataccaaacatgtagcaaaaaaaggtaaaagttgaatggttgttaagggtaaaatagaaaaaaaattaaatgataagtaattgatgagacaattaataatactatattatgacaaatgttgtgggacaaatttaaattaaaaaatactaggacaaaaccatacttaaaaagtagtgggacaaatttaaatataaaaatactaggacaaaaccagacttgtttaaaatataaaaaatactaggacaaaaccatacttaaaaagtagtgggacaaatttaaatataaaaaatactaggacaaaaccatacttaaaaagtagtgggacaaatttaaatataaaaaatactaggacaaaaccagacttgtttaaaaaaatttataagtgtggctgctgggattcgagcccaggtctccacggccacaacgtggaattctcaccactaaactacagccactttattaaacaaggttaattagtcatcatatattgaataaaatatggttaaagcacaagaacaaacttccagagcattttttgcacgcaggggcagccggtagctaaccgtatctgtttgttattgatcgcagggcaaaatttgcagcttggcatgctgaaaccgcgatatacatttgtcgggcagatctcagtgttactctaagtctgaatgataatagacattcgcttcttcagtaattttcctccaccctcccattgtcattgtcgtgttcttcaagttcaatctgaattccaattctcaagcactgatcgttccatgaccccatcggtaggcaaaggagcaacaatttctacagattttcctttccagaaagcgatctatagatttcaccttcaatcaggaaggatactggaaggtagcaataagtgaaccgaacggcccaagacaatccatcacaaggatggcccatgtgaaagaaaacccacccaactgcaaattactaaggcccagcctgggcaaccaatcaccgacctttccagagcccaccgtatagcaactccgggcctatacggcacggcccgttatcgaggctcaccaacccgagcgggaatctccaggcaaaatcatcggctgcctcaaaacccctgagccgtgcatcctagggtttccctctcctcctcccctctctccccgtccggcaacgcagcctcaccgttcaggcggcggcgaaggccgcgtcgaccccgcgcagcgcaggcgccatggccgccccggaggcaccctcctgctacgttgggatcgcgcggcagtccgccgccttccgcctcatgaagcaaatggtgcgtgatactacctaattcaaagttttcctcatgcgttggggcatgcagtatgctattgctagacgtaggtttatgttggttaacatcggttgatcctgtcggatatggagtctgaaggagttgctgttgttgttcctgttgaattgtaactagcaacgtttgttaatgctacggagtggaatttgggaactgccgcaaacgagtgaacttggcttggattttggaaaggagttgaaattcacattcttcacgagttatggctgcacatagattgaatttagtgtagttaatatttctaatcgaaccaaatgagtaacgtgaatggaatggtggtttgcactccataaacaagtttatttcgtcagattatactgatttttctgtaatttagatttgttctctttttactgattttaaagtgtagttagcattttttttttcattatgctttaggggtgggaagaaggtgaaggccttggtaaagataagcaaggcattaaggggcatgttagagtgaaaaacaagcaggacactcttggtatgtttctatatagatcttctactttagaagtctatttgtaaggatatatatccttgttaaccacccgtgggctctcttaaacctaatctgatcgtttctgcaggtgttggtgtagacagtcctcataacaaatgggtatatgacaccacccaatttgacaatatactaaagaaactgaaagtggtatggcgtgtaacaattactttgtttgctctatgtataaattggtcattatttcagttcctaattgtttcctattatctttttcttgtcatttgatcgttgctcccatcttctttggcagcaatccgctactcctgctataaaaggtacctgacggtgtttgtgcgtatagttcttattttcatcttgttaggtgttgtttgataacatttttggtgtagcagaatttgaagatgatgtaagcaattcaccagatagtacaccaaaggaagctaaaccaacaaacaatgaagttaccaaagttacccgaccccaaggaaggttggtttgctcccatagcttcagtatttgtatttctgtatctattttttcttctctttacagtttacgcaatacttatttcagatataagaaaagagagagggggaaaagtgtgagcggttattcagcaaaagatcttgaaggcatacttgtgagttgttattcttatgtgtgcctatttctttcttagctaatctagttactatccatgagcaatttttttcttgtgcacctgtgtaaactgtgtaacttactttattacatgcatgaaatattgtgtttgcacaggttcgcaaaagtgatgacaattgcaaagtggaccaggaagttgaaccaacatgctgtgatgaacctgatcccatcatctgtcaagatacaggtctgtaatttgcatgtttagtttccccatcattgcttcttggtctgagccaggactgaggtgccaaacttttagaactagaatgtgtacacactgcatacaagtcactgaacagctaaatggtaaagctctgctgattatactcatatactgttaattttggttctctactagacgagatctaccatgtcagcatctaagttgctaattgcttaccagagtaaagcacattttatttgctctctaatctttctctcttcactaatggtttgaattgtgactacctgattggttgtactgcacatggtctgatgcttggtttggattgaaatgattctgataaatttgttactctaaatatgtaatcttcttttgagaccatagactaatatcattgagattttactaatagttcatgacaactctctgttcagtatcgcaagctgatgatgtgaactggtgggggcataaatttggattcaagtcaggcggctttctaggagcaaaatcgcgcaagaacaaatcttctgctacaaaaggtacttcaaatgtccgccagacatttggggaagaagaccaagaaaacctatacaatcttgttcaggttggtattaacagtctatcagatctcccataatgtcctataacaagactgtccatttcttaatgtgcttttagagactttttaaccacatataagcaacttgcctttgaattctatatttttcttacagtttggcctgaaattgcaaagtcaatttagacctctgttgattgattatcgaacaaatctgatgtatttaaaaacatatagatatagctgagttctcaataatatccattccatctaaatggtctttgtaactgctgcaggacaaagccacatctggaaagcagggtcttggcattaagggtctgccaattaaagttgccggacaccgttggaaagggaacaaaacttcttttggtgatagcgatgaggaaaattcaacccaatccaatgaattatcagagttggaagaagatggtgatgaggaagaatctgctaacgataatgaactaatagacgccaatgtgaatactgtgaaagaaatgtgcgtggatgttaaacaaaaacataaaaccaaggtcaagaaactttgcaaaacaattcttcgtcaggtatggttgtttaattatcatactctctgtatgtggcttcatgtgttgtgccgtaatcacaacgtttatttacttgtattattcccaggccccagcacaatctatgaaattgaaggaacttaaggtagctgttgaagcacattcagagtctatgttctccaacttctcttgtaggcgtgaagctctattgttcttaaagaggaaggtacgggttttctttttcatttggcagaggctttgcgatctttctctctttcgttatggagtaattagggagcacctactatagaaggtatggtatgtagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcagaggcgctctacttttagaacatgttttttgcacattgattttgttattatctgaaaccggtgccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcgcatagtcagcttcgttcacagcggtaggcggcggcccggcgtcttgaggcgatgcgcattggtcgggggaattcgggataagcagcgaagtcattcatggtcgcgccagcgacgccgaggccgtcgcggatcctgccgcgagcgtcgcactcccactcccagccggccgccgtcggcctcgcgtccgaccgcgccgccgccgccaccgtctcctcccgccgccgccgcaacttcgtcttcgtcgtcaacccctccggtactcccccctcctccaccccgctacccttaccccctatcctatgcgcgctctcaacgcccttcacgtcgtcgcaggcgccaatggccgcacgggcaaccagtggaagcagctgctcccgcacctccgcacccgcttcgctgaccaatgcgatgtaagactttcgatttctcttagatccctggatcgtagcatcctgaaccggaagctgcaattgctgtatgagaccatatttgggatcagatccccatgctaatttgggggctctacggaatgttctgatttgttggtattgcgtgatcagatttgtgagtgcatcacctcggccccgttcgacgccatagatatcacgagggaggtgtgtatgggcttcctatagctgccagtatccaattgttaatttccccttttggttttcttgttacaatgtgtgtatgatgatgatgatgtaggctgtaaaggatggggctgatgccgtgattgctgttggtggtgatggaacacttcatgaggtattatttgtgttgacttttgcaatatggatacaacctttgtactaaatttgtccagaaacttgatattcaaatacggtaatatttgtggatggaatgtgcaggtcgtcaatggcttcttctgtaagggaagtcctgtccatgctcttgatcaaggacctgatcattccacagcgcttggtgtgagtgtacttagtttctagctattctatccaatcagatcacccttctagcctcttaaattaagcattagactattctgaactgaaatgtttgtttatgcactggaatttgttcggtagtgaagcggattgtttttctctgacagctcattccacttggaactggttcagactttgcaaggacatttggctggtatatttctccagcataatctacatatggtgtttagataacctctactttcactgatgtttctttcttttgtgcaaccaggacaaatgatcctcatgaggcgattgatcgaattgtgagaggttccttctttgattcttcttttatagtgtgtgctgtcagtccatactcgtggtctcatagtggtcattcatctcctggtatatgtatatgaatgcacagtaacattattaaagtaccagttgtcatatgactagccaggtgattgggtttgtcttaaaagatttgaaataaagtttttggaagcataacaatgaaattgctattataaactggccatcttcatgaaaatatacaaaaactagatttatgtctactacgaattcgcaatcataacatatgaggctcacaggtgcatatttttgcaggagtcaaatcaaaactagatataggtatgatggaaggcccagatggaaacccacattattttgttaatgttgctgatatccatttgtaagtcaagcatggctcatttgacctgtgaaattcaatggatggtttgaaaaggaaaaaattgctctgcacctgcaggagtgctaaggcgggttatttttcttctatgtacaagagatttggcaacttatgctatgtttttggagcgctcagagccttttggggacatagtaatcgagatcttagaataaaggtttgcatcgcactggttttagaaggaagcttagttgcaatcttactgatttttttcgtcattatcagtcccacacctcttgaatttactagtgcatataataggtaaatggtggagaatggaaaaccattcgtaaagtcactgcactatgcataggaaatgccaaatacttcggcggtggtatgaagatcactccaacagctgatcctttcgggggtgaccttgaggtgcctaaaaagtcatttttctttatagttttgagtaagcattaagaaaagttagcctttgttaatttatgtgtcatttcataggtcgttattcttcaagatttcaaatggcatgatttcctgctcaagcttcatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttcctcctgatatgtgtctcattagttctaaaacaggattcaatgtttgttaagccttctcaaaatagctaacatcactattaggctgtttaactgggtattctatttggggtcactaagtgacaatatttttgtcgcagagttcagtcgattgaagtagcagaaaaggaagttagtgctgacatctttgtgcaatctgatggggagcattttggttttcttccaaccaaattttcagttcttcccggtgcagttgatttcttctgctagattagtatgcttcttcctgtgggatacaaaggtttcttaatccttgtcaagtcactacgtgtactttgaactagctgtgttattttgaagtgatatcgtaattgaatagttacattcattttctggcaatacatgggataaaatctgttgtcacccgccatgtaatgactataattatatgcaacatttgctaatcaaactaccataaaaatttggtggtgacggtgcactatgaactgtttgaattatactggaccaaactggcatcaatgtaaatgacacaatgacttttaggcttgtaccctgtgtaatttatacttttgccttttgctcaacaacagaaggacatagttagctgcagtttcaatacaaaatttatttaccttcagcttccaacttcgaagttactattcttactcatagtaccttatgaatcagtcacacgatgtactcctatatgagactgatgctgctagaattcaccacccaacgttttctcaagagtaaattgcactttacactggtaaaacgcacctatttttgctttgtactaattttagcacatactttcagtttttatcagttgtactccctccgtctcaataaaaagtgcacttagtattgggtgtgacattttatagaacacttatatgaaatgtcacatccgatcttaggtgcacttatattaggacggagagaatattgaaataagtttcactttatgttaggatacatcatcaaacctatagaaaattcactaacttatataaaatttgaataaaactttgtgaaacatgttctaaatttgaatgggtccataaattccacttgtgttttataagattttctttcaattatgtgctgcaatctagaataatatacctgcatggaagtcaaaatatgtactaaagctggtgcaaagccaaacaaagatatgctctacccaatgctatgtaattcctccgtcccaaaatgtaaagagttttggttgaatgagacatgtcataatactacgaatcttaacagtagtcttacggattaggatgtgtctcatccaactaaaacttcttgtattttgggattgaaggagtacaatatactcttctcttaatttgtttggttcatctattattttttaatgggtatagtattttgttagggggagtactaatcaattacacggccgtacctgtgattatgaagtcgatttaaaatttctttcttgtgaagtgattctcaagcagagtatttgctgtttgttccttccatacgtaaggaataatttctgttgcttgaaaatttaaatggccattgagatactcctagaaagtaccctgtcccctgatgctgcggcaccagactttaaccctgtctatgacttgactttattctcataatctgccatgttctcctgtagccctgtcgcttgaccatgacgacgtcatacttatacgttctgaccttgtaaaacttgtactccctccgtcaaaaaaaaaaaaaagacaaaccctgggtttccgtgtccaactttgactgtccgtcttacatgaaattttttataattcgtattttcattgttgttagatgataaaacatgattaatattttatgtgtgacttgtctttttaatttttttcataatttctttcaaataaaacggacggtcaaacgttgaacacggaaaccagggtttttctttttttgggacggaggtagtacttcctccgtcccaaaataagtacagccatggttttccgcgcccaactttgaccgttcgtcttatctgaaaattttttgaaaaaatttgaaaacataagccacgagtaaagtactattcttgttttatcatctcataacaacaaaaatgctaattataaaaaaaattaaataagacgaacgatcaaagttggtcgcgagacgaaggtagtactacttacagcagctttggtcatgaacagcgtgaaaagaaagtgtgttccttctccgctgccgcctgggcaaagaagacgaaaataatggtagaaactggaaaaaggaaggaaggcttgtccaaagcataatccaataatcctacgtcgtgacaggtacggtatccgttttttccccgtacgtccttcccatgtgatgcgtcaacagttaaaaaattgccctcttttgctcggctcatccgcgcgccgcgcgcgtctcggccaacattggcaaacacgcgacgcagccaccgttccgtccccgcatcctcctgcgtctcctcgtgctcgtgcggctctcgcgctcgctgcgcgcctgcgccgaatcgagcgaacgccgcagccgcaggttgcagcgcgcgcgcgcacgtcgtgtgcccgtggctgcgtgccgcgagtcgcgacgccatgctaaaaagaaaaaaaatatcaccggacgcatcgcgtcgtatcgggcggagcacacgagtcatggacctgtacgacgttgtgggggcgtgagttttactcgtcctcatgtcatgtcgtccgcgagaagcaaaaggaatttacgcacgcgctcgtgggtcgggtcgtggaacgtgaacggcttgtacgtcggggtatatggggacaaaatggccttctgttgcgttgctacaccccgtggttggcgttgcacgtaaggcatccgtcgagcagccggagcgagccggggtccgggggtctgattgtgtgaacgaatcagtgatcgcctgaatggtgatcggagcatatatgctttggctggcccggcgtgatgattactgcgtagcacagtagcaggacgcactggaacagtactagtaagaaggccatgattattatcgtgattagagtacacagcctcgtaattgcacatacgcaacggaggcgctgccaggtgtcgtgtaccattcttttggtattagacttgccatgactatcgtgtgaatgcctgaatggcaattccgagccgtagcttgcgtacatcttaaagaaacccactcatcgcgatgacgctatcagccacatgaacatcaccagccagactgtatcctcagggagcccggccgccaattgagaaaatctgcaaatgggtacgactgctaattactactatgatttaataacacaatagtagaacagtgtgaaggtgatactaccaaatattcgaagccttctctctctatctctccacgagtccatgtcaaatggagaaggaaaagggtggagctcttttttgcttggccctgcatgcgtctgcgtcagagcgcgcacgaccagcacacacacccccacattccgttggtgcagtgcagtgcggtgcgcgcggctcaactttgaaagcggacggccgactgactgacggctcgacgtcgccgtgccgccgagctgtcacgcagctagctgacagccaatgctaatcttggaagcgcacgtcacctaactcctctccagaatccaaatcacaaggggccccggcacacacaagtttgcaacgaggtggtggtcctcactcctgaccgtctgtcctagtaatgcaaggggaaattatcctctgattgttgatttgtctccacatattaggccccgtttagttcccaaaattttttcccaaaaacatcgcatcgaatctttggacatatacataagcattaaatatatataaaaagaaaaactaattgcacagttatggaggaaatcgcgagacgaatcttttaagcctaattagtccgtgattagccataagtgctacagtaaccacatgtgctaatgacggcttaattagtctcaagagattcgtctcgcggtttccaggcgagttctgaaattagttttttcattcgtatccgaaaaccccttccgacatccggtcaaatgttccatgtaacacccaaaaattctcttttccctaactacacatacccttgggagtgttcgttaggtggagataggagagattgtctatcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctagtcactttcggatactaaggaagagctacggcttgaacaaaacgcataatttccagtcttatcctctattcaactcctcattgtattaattgctgctcccttcgtttgaagttaaaataattatagctatatattattcagataaaaataactatattttagaatattttagaacagagaaagtagaaaggagctctcacgtttggccataccatctagtaactatgtcaaccaatagatcatacttcctccgtattagccattaaactgatgagtatcggtaaagaagttataaaatctcattacaatgcgtgggatgcgcgatatagtcattactatattttaactcagtgttgtggaagattaagggcggttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggcc

SEQ ID NO: 13188 - DNA, 3358 bp, Oryza sativa
gccggcagcagcggcagcagcagacgccgacgccgacgccgccgcagccgctccaccggcggcgcaacatggggtgcagctcgccaaagcagagactccgccgccgccgcagcggacgcagccgccggtgctaccggcgggatccacgcggtcgacggcggccagcggcatgtcggccacgacgagcggcgggagcgagcgggacggcgccacgccgaggagcacggcgagcggctcggctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttattttttattttttaaagaaatcaattttccctttctgtttaaactggggtgtgtgatttcgtttgttcgtaaaaatgccactgatttcgtctgtttaaccgtgtttgtgttcttgttcatcggtttctttggctgtttgctccggttgtattcttgttcatcgaattgatacgcagatctctaatcttatcttcttctgcgataatgggttgttggacttggatatgatcagtctgatggaccaggaagtgagctgtcaaaaactgtgaatttccatttgaagaagggaaagatccttttttttttctagtgtatttgatcggattttttgtgcatagaggtgcaacttgtttcagtttattcatgaagcagtggtctgctggtgaacggttgggtcgtggggctcaagaagtttcaaattgctgtcatcatttacctcttctgtgcgcccatctccattccccattcgcctcgatatctgtgacgcaatttaatcctacacggctttctagggactggattaccgtttcattttctcacacattttcttgttctgttttatgacaacaaaaaatcaaattgttttcctgctttgccaggggccaggctgagaaggagttcaaggtggaggttgaagcgatcgggcgtgttcggcataagaatctcgttagattgctcggctactgtgtagagggcgcttataggtacaatgaaatctcttcatcaattttgtgcattattattccctctctgattaatggatgttttactcacattgccgttttggttgaacaggatgctcgtgtatgaatatgtagacaacggcaatcttgatcaatggcttcatggtgatgtaggggaagtgagcccactaacttgggaagtcaggatgaacataattcttggaactgctaaagggtaatgcttctctcactgttgcacgccaattttgccaaagtgggtaccttgaacagtgttatattggtatgccttgcctgattctgtttaatacttcgacattaaagattatgaatattatgggcaaatataggtcatgatcattcagattttagaagacaggtgctagctggcatgggaggcttgttttgttgtgagacatgcatcatagttaggatagtagagtctaattctggtgaaattgattgtcgtaggaattcaggtgctttactcaagtttgttaggttgtgttccttagcatgcacatattcccaaagacagctgattctaacccatgtttagcagatacgaaaaaaaaaacatgtttttttctttgttagcattaggcatcatttggttgttcagaaaacaattagaatttcatgtgcatttaaatagtacaaacgccaaagtaaaggtgtcgaatttcttggacattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattttggtcttgcgaagctattgtgctcagagagaagttatgttactacccgtgttatgggaacctttgggttagtattgacaatccacacacaacctttactgtacataaaagttagtacatcttatcatgactgaaattggctatgttgcagttacgtggcacctgaatacgccagcacggggatgttaaatgagaggagcgatgtttatagctttggagtacttataatggagattataacgggtagatcaccagtagattacaccagggcacctggagaggtcagtatcctacctattctttcatgaatctcttccaggatcgttggcatctgatggagctaaattgtcttcttttcaggtgaacttggttgaatggctgaagaccatggttgctgagaggaaagcagaggaggtagtagaccccaagctgcccgagaagccttctcccaaagcactgaaacgggcacttctggtcgcccttcgctgcgtcgatcctgatggccacaagaggcctaaaatgggacatgtaattcacatgctcgaaatggatgatctactatgccgcgatgtatgttctactcacttatgaactttttgatttcttccatttactaaacagtatagttaactcattttctgattgcaattgttcatcatacaggataagaaacccggaagagatgcgcctcagacatcggacagacacagctcaagggatggcgggaacttcagcaagcgtgagaaccaacggtacagatgacaacagcccagcactacagttgaacatgagtttgtatggattgccattagggattgccaatattaaccatgttgtcattacataattttttcccctctcgttggatctcataaccagctctccttgctcttttgactgtattatactcgaacatcattctatgacacttgacacttataaactac

SEQ ID NO: 13189 - DNA, 36245 bp, Oryza sativa
tatgccccagctaatgcttacagtgttaatgtgattctacctaatgcaagtacagttgtctgctctaatgcatcttttaccagtccactcctgataccagctgcctgctttactgcactgggagaagtaatgctttcttcttgtagcctaatggttggtgcctgcttgcacatgatgtcacatgaccattttctgcatctcatctcatctcacacttccatcctgcatctaaccctttgtttatgatcgccattagtagttggctgcagagcttgggacttgtatattctgctggcaaatgcttttgtccactatactgcatctggtgatcagctgcacagcatttgcgccagttcttgtcgcttcgccttgtcttgatctaaatactaatcttcgtttccatgttcagttgctgtgactttttcgtactagtatattcattagttcttttttacagccaaccagctctggatcttgtgctaataaacttgaccgctgacagtactgattaattagcaggtgatgatcctaccatcacgtgaatacgtgatcgaacaactactgtgcaatcaccatgtatgcaatgaatggtcaagtactaacatgataccatgccacaaattagtttgatcatgctgattcatttatttgacactgtacagtctgtactactgaagtggaatagcatgagagaagtttctttcatttttcaacggttagcttggagctactgtgccctggaaatgttcagagatggattcttccattagaaaaaggttgagttatgacttgtgagttgagagagtagtgcaggacacagcacactagtggccaaaaaaacggcttggaggattcatgaaccgatggcagaaaaaaacaagaggaaaaaaaagcacagcgaaaggttatccggcacaggctgccgcaaatactaaatcttgttggacagagacatttttgggtgatatctgacgcgttcttcaccctttccccactttattcgatagaataattgaataaacattcacctatcttgataatgcttaatgccttagtctaattattgcacaaagtctctcaacaacctgaaagacgcagctaagcctgccactgccgttgtgatgacttgtgaacagctgctgctgcttcatcaagctgataatgcacaatcatatgccatggtacaggtacacgcattgtcgaggtctacgtccacatagcttcaggcgatctccgtcctgtagcgtagcgacctcgtgaacacctgagctgttccgaaatggacgcgagcaatatccacaaggcaccaggttgtcgggttgccgccgttggggttttcccggtgggccagtcgacggcggcaacgccacatggaatagaaccagcccgacgtactagaagaaggcacgggcgccagtctgttgcggctagctcgccccccatggcctctggtccagcctttaactcgtcgtgttcacctcgcggttcgattcgattcttcttctgccagcagcccagccttcaccgtgagtgctactatactgatacgttgtgtagccatcgatatgcaccgtccgattagtgaccagacggccggaattacatcgatttcgatcatgtttgatgaagcttaacattctaaaaagacaatcggttggtagtcagtttatagaaatatgaatctactagtttttttttaattatgcaattgcaacttcttaaatttcaaataaaaagctgaattgtttcgaaaggttttgttttaggagaagtttcagctaccagaaactctctcaaatatgcccatagcccatccgcagttggccgctgccgttgttacggctcccgtcacgcgcggtgtctctcacgtcctctgcggcggccgctgctgcttagctggatagcaaacgccgagccgtgcacgctccgctgccatggacagcgactcgcgtcgcgcagcacggcgccacgagcgcacaacgcgccgggccagcctcacgcgcgcgcggacgacggcgttccactggaactcggtctttctcacgagacgccgacgccgtcgtctactcgtcttcgttcacagatggatagggaaaaaaagggaaacaaaaagggcgacgcgcgtgagcttgcatgattgatatgtaccatactaatataatctgacaaaagaaggtaatgctaagagataagagaggcaatgatcactttcagcctttggaaagctgacgctgaggcaattatgtagggaaaaatggtttcatcaagttgtgctagtgtcggcataaaagactgcaatagtgctagttccgtatcaaaggtgccgcactgacactgaggatgagggtgtatgtacatgcatggggagctcttttgatcaatcacacaagagagatgatgacactactagtaagcatatgcctgaacaagcacacacacatacatacaggtagtatgacatgcatgctgtcagttcagcagcacaagagatgccggagagaacaacagctgcgttttagcttctaccacttgcagttgcctggctaccaccaccatcagagagagggcctcttggttgtttgccgttgttctgtggggtcaggttgtctggtgcagctctctttggcctcaactacagtcaagataaagcgttgataaatagatgttccatactgatttatgtaacctttgtgagagtcttaggctcttagcagcgcaccttttcctcggatttttgataaaaatgcctcaacaggatgttcttggggtctgttgttatcactgcgattccagacacaaacggtcagggaaatagtgaaaatagcaacaaaaaaaaaagaggtgatttctgtacagtaaaaaagaaaacttggaatagttggggtagttctggtaggaatggacgagagcccagaaagaaccaaaacgaggtaaagagagcgagcaactatcgagtctgatcgactacgaaaatatctaagagcaggtacaatagcaggctattagccagctgtaaacatattttaatgagagaaaggatgagagagaagagcagcgggctatagatctgtagccagctgcatcgcggactctaagacgcaatgtatgtatgacaggtgtgaccatatattaatagtatagtaagcaactattgtatgaattggctattagattggctatagatgaattggagttagcagtgggctatactattaaacttgctctaatgaactaaagcactcaagaattcaccactatcagaagcaatatcccatgcacaggaaattcaagagggaataggcagcaaaaatacggaggggctgttcagattgttgccaaaataaaccttacctaaaattttagcaagttgacaatattaccaaaattttggcaggatttcttatgtatttaccaaaatttggcaacaaaccaaatgtaggcacatttttggcaactttgccaaaaaatgatatggttgaaaatggcatcaatctgaacagcccctgaataaactggaaactaaggaactagctccatgcctgcaacggaccaatgaagtacaatgtttacatagaatatctaaaaacaatgttctttttttttagataatggaaatggtttacatctttggcctctgccaacaggcacacgggcaatgagtcgagaagaaaaactgtgttctataaatgtaaccatccaaatcatattggcaatatggcataaacagaacacttcaataaaactatgttggcagcactagaggaagatgactaatatgagaggttgctttggttggccagttcatttgctccttactaataaattgcccagcttgcctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctcaaccttttctgctctccctcataaagtcatactccaagagaaaagtttgctttgaagctataaaaaatgtaccagaacaaaggtcgtaagggaactacttgaaagtaagctgggcaaattagccataatgtatgtgagttacatatcaagaagccaaaactacagtcctagggaatgcaaaaaatattgactttgaagacatatctaacagtccaacagaatctattcatggatctatcactcagaagatactaaagaggctgcattactgaaaacagtatagatgattggagttaaatatgccagccatgaaaggcaagatagtcactttttggctcagaccaaacaactcagaggatctgctatgccatgtagagtactactgtaaaaggaatttgatgcaatgtgaatgagcagtcacattcaactatacacatttgaacgtttaggaaccacacactcagaagtgaggagcagcacagggaaatcagcattggtaaaagaaacaagggagcaagataccttgaccgggaggtggatccgtcctgtgtgttgcaatgtaagtggctggtacgacattctgaaacacaaaaaaaatagggataagtattggcagtttcgcaccaatgcaacatgtccggactccagagaataagttaccagcttgatactctgacgagaaacacaaatatgacaaactgaatatatgctttgcaaattacaatgcaagtggctgcctggaatgacattcggagcaaaaaccgactagtaattcatcaccacaactgaaaccttaaagggcgttggccatgagagaaaccaaatcctaaatgtataatccatgattcacaaatacctcccaaatgagatattatgatccaactatttggcattgggacttagaaacaaatagtactaaccaccttttgttaatcatgcgcactggaatttcagacacacgctctgacacacaataggactgactagaggtaaagctccggcgtgagggatcaggcacacaattcatggcatcatcaacacaatcaacctaattctgaattgtacttggcggtcggaggcatgagatcacgacagctaagcacagagatcgatcgcgagtgaggggggacagagtcacagaggggctgaccgaccaagggctgcgcggaggggtcggcggggacgacctggctgaagttttgcgggttgtaggacggccagccgcccagggagctctccatcgccgccgcggagctcgccgtgacgtctccgactccgactccggcgacgccccctcttggtttctccacccttttccagcgaccatggattcgtggaggactataatggagcacacagagtcaacattaacttttgggtttcggcccattattgctatcttttgggccttagatttcactggccaaatgggctttaaggcccattttctacctatacatttgtgcttagcgttgtcttgtgtaattgtgttattatcagataataccacgattatacgaatgaattaattcttttagataatggaatgtaacattccagtctttactcaaagagttacagccaattattacagaactcacacagaacaaaactcacatagaaagttcacgatagcacaaacaaagctaagcaaacataaactaatacacaccaacagaagaaaaatatgccataactattgaattgtattagagaaccgccacccgaagttggcaaatatatgcataattgtcgtcaaacgaatgaattaatgaattaagacagacaatagtacaagattcataagttctttttttcgaaaaaaacaaaacacaatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataactgcttgcgagacatcatggactattctgtggccatcgatgtgggggtgtttgtgtgagtgatgtgaagatgctggcgaaagccttgccgggtcttgggccggttcgacgacgacggcgcccatgggcgccgtttcccttcttggaggcgttgtcatggcattctttcatatccccacaaatttctaggtgaaaacctccttccgactttcgaacgagcggcggtggcgttacacgttgtgtcctccttgggggcgtcacttcggagaagttctaacgcatcgacgactgtcgatagtctttttcggttcaaaagctttcataccttttgttcggtgaggccttcgccttcttgggtccgcttctttcttgtggtgggcaacacgctcttcggttgtttctgctaatgaagtcgaagctgcttgctgatgggggtgcggcgacgctcggcaatgatgacatgttgcagtctcttccaaggagctctggtgctggccgtgtgaaggaagttgctcttcggtggcttggctgacgtccattgttggatgtcggagctacttttcgctttggtgactttcgtggcttcagtgttgctgcagttgtggagtcggcgctgctaggtcgcttgggcggctagcttagcaatggtaacacctcttctgcaatgtgggagctgttgtgtcgcttttgtgtttagtttggcagtgacgtcctacgattaggctccgccgtcgttgttagttgtgtagagcggaaggttttagctggttttcctgtaattaaccgtgcagctgtatggtttttgggcccggttttccttataaactgggtcaattttttttttctaagtataacagtggaacaaagttcggcattaggttaaaaaaagatcttttttggggcttgcgaggtttggacaaattttaacttataagaatgtatttacatattaatctgtaataattttcaggaggcttttccctcctaatgtagatagagttaccctcattattatttgatggcacatactgcactagtatatatgataataaatgcagacatgcaaataaacagttaaatgtgaagtgtatagcacatgtaagtaaagtaaaaaaaaaactcaaacctgcactagtaaatgtagtagaacaagtatgtaggagcaaagtatgaaagttaaaatgatatgtatacatgagaacagggggagtagtagtggctcaataaaacctccatgtttagtccttaattagaagcagatgttgtttgagagagataccaatcacaataactttaataacattttaatcctgaataacttatacagtttcatgctgtatatcttgcacgactggagcgatgaggactatgtgaagatcttgacagtgtgcaaaaatgctatttgttaaaaaaaagcaccatgaaaaattaatatgtatgaagctatgccgaaacaataaacctaaataaatgcatgcctatccatataaattttaacccgctgacaacccgacaatgagttactgcatctatcctaaaatataaaaaaattaggattaaatacatgtattacgaaagtaggcagaataccaataataagttatcatctcatccaaaaatataagaactttaggattgagcacatgtattatgaaagtatgtagaattaagtaagagaaagttgtgattcattgagaaaacgaagtaggtagagaaattaaattaggaaatgttattattggttaaaaagagtagaactactattaggagcgctagagcgtggaatattgttcatagcgccaaacatgcgttagcccaggcccaccccaccccacgtcccgtcatcccactcctaccgatccgagtaaattgtttactccgatcgggtgcctctaccacccacctttatttgagtaaacaatttacttcgataataaaaacaacttccatgctttcgatctcaccccatgtcccgcatcgtgcacccaccattatcggagtaaatgatttactacgataaaaacaacttctctgcttccggtatatattctatttttcccgtacccaaccaaccactctcgcccccactccgttttttccttttttttggatctgaatcgatccaccatcccagcccacagatcggcgacacaccatgaaggacgacgacgacaccgtggtggttgatggcggtggccggcgagcagtggccggcggcggttgaggtgaaggcactacttcaggcctcgctgctggacgctaggcagcaccataaccagcaaggaggtgttcacctgagccaatagcaacaaccagcggctactccacgtcggcgacattgatagaacaagcaagtaaggaaatgacactctaatttgcatctgcatactctctttcaacttcacgcatgaagccctaattttttttgcaaatcaaattaacatgtaatctccaatattacctgatctcaattgataggctgcacaggtcctacatttgcacatcgtgctccatgtagctggccgcagaggttaaggtggagtccaccggtgatggagattgtttgctatttttcttttgctcgtcatctgtattgacatgaacgagaatatttttacatttttttgtgcttgttagatgatggatggctgctactgtgcaacgtcaagctcaactctataccacaccgctacattcttccatgattccatgatggatttttggctgaatcattttttttcttttctagtttgattcacctgtgagtaattttatcgcttgtgtgtgattgagcctgtaatttttttcattcatacaactattttgtgatacagatcaacaatactcttagtaccagtttttattcttatactgtatattgaacacatcagtaaacatattactacatggtggctatgagatcatggctatatcgagaggaatgtggaaattgttttactcgcagaccacaaaatctaaataatattggtaaaagaattactagcgttgtaagcttgtagtaattcttttacgaccatttaggtatggcgtcatacgatgtggagacattcatgagaataaatttgttactttagaatgagcagatgtgggaggctgggagtaaatgaaaaattccacggagtaaattcgttacttttcaaacgtgcggagatactagaaaaacggaaaactcggaaagaaaaactagacggtaaatattttactaaaacgcgaaaacagaaaaactatagagaaggaatgaataacagaaaaatctggatggttaatattttacctggaccattgatgaagcacatataagatggaaaagagaaaaaaagaaacacggaaggtggggtgttaaaaaacgaaaaaaaacgacccgagaaaaggtgggatgcggaggaaaggtggggtggtaaaaaacgaaaaaaccggaagtagaaggcggtgtgcagcgctcgaattattattccgcgctgtagcgcgtggaatagcgctaccgtaaaagagagtataagtgaagatgttgcaatattttaaggtaaattttaaatgctagaagttgttatattttagatagagagagtagctaaagttatttcctttatgtaactatacattgagagcgttcatattagccacaatatatcttttattaagagaggtcaaagatgattcatcacaatctctttaaagacctatagatgtcagaacaaaaataagaaaaaattaccctgtaagatcatggtgagttcatattataacggtatagattcatctctataggtgtacaagtataattgtatctaaataaagacatgctaatagctgcatatcaaacttaattcttttttatatattttatctatataacatgagttaagagttgtttatctccgattcaattttaaaggtatattcctgtgtaaaattgtgtgaaaaaaagctagtttgccaaaatggagcacatggggctaagctgacgagagaggccagcattttcatcctctactattttccaggtcttttgaatcgtgcgaagaaaaaaggggatcgtctttttccatggatctgtaagtcttccatatacgcaccgtcatgctgacattttcagtgatcggatgaatggcggcatatatctgggaccaaataaaacctggtgcaaattggctccacgaaagccaagatcttattcagagagtaatcgccatggaacatggtgagattggcatatactatgtaagttggacagttggtcgatcaagtcatcaaacaacttacagagaagataaggtgcgaatcgatgaagctgaaccatgagtgcaaaaacgttcgtaaagtgtattgacgtacattcattgaattttcaggggaaatttgtctctaaaattgatgaatcaaacatttgaaaatttcagagaaattttccagggaataattttctctaaacttaactgccaacgtttggacagttggtcgatcaaacaacttccagagaagataagatgcgaatcgattaatctgaaccatgcgtgctaaggtttgtaaaatgtattgtcaaggattaattgctaacctataacgtacattcattgaattttcagggaataattttctctgcttgcagacagtcagtaaacccatttatgaatacttgatgtacatgtcctgattcgttctcttctctgtcaatgtggatgatgtattgatgtatatgtaagtataacagggtcagtctaaaattaaacacaagacgactttcccgacacgcttacgcgcgtcgcgttgaaaggattcaccgacttattgactcatagtgcaaatctaagtggcatctgccttttattttcaaattagtttggcagctgaagataaagcttccggctaactgctaggttatggggctaataacacacgagaagataatataactgaacagacaccactaactacagaaaaggttgcacatatgcaaatggaaaatgacatgccccattaccagcactgtgcgtgataaccttaatatacccacttatccctctatttctttcctgcttcaacgtggaattgggccatgcacgttgttttcatggcctaatatgtttcctgatttgttaatcgtgactcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaacccttccaaatctcattttaggtaaagtagtgtatcaagtaaaaaacaagccaaaaggaaaacacttgttttttttagtttgttcgttcgatgatgaagtacccacgttccactccaacagaagaggccaaactaaagatcaggcatgctgtcctaagagaaaatcgaaggtcagactgagtcctacacaccaagggtagcttctgaaacggctgggatgatgaacaaaagggtgtcttttgtgcgcagcatctaccggccaatattcctttgcaggcgtgcgcctggtgattcaccaccagcagccaccggattctccgccttgcaacccatgcaatctcgagaatatgctgcatcatgaaactattcttaatgccgagaacaacgagagaatcattcagagttcagacatcttttcgacagtcatatgctagctcctgctattagagcaaatttaatagtatagtccactgcaagcttaaaatcatctatagtcaatctaatagtcaattcatacaatggttatctagaaatgtatactacactattaatatttggtcctatccgtcatacacacattgcgtattggagtccgtgctgcagctggctacaaatctgtaagagcaagtttaatagtatagctcaatacaagctcaaaatcatctatagccaatgtaatagccaattcatacaatagttgcttaatatactattaatacctgattctacttgtcatacatacattacgtcttggagtccgtgctgcaactggctacaaatttatagccagctgttcttctctcttcctttatctctttaaaatatatttatagctggcttatagcctgctattgtacctgctctaagagtaagtataatagtaggctataaggtggctaaatgctgaggtggaggagagagaagagagaggagaagtgggctgtaaacttacagccggcttggatacaagaaccaagaaactctgtgagagagacaagcgggctctgtattaattgtaaagagctaactattatataggcaggctaagagaaggctacaaataaccttatagccaacatgtcggctgtattattagagcaagtacaatagcaggctataagcaatctataaccacatatcaagaagaaaagagaagagagagaagaaagcggactacagatttatagccagttgcaacacggactcaaagacattacgtgtgtatgagatatgagaccgggtattaatggtatgatatatttttatagttaactattgtatgaatgagctattagattagtaatagatgatttggagtcagtagttagctacactattgaagttgctcttagccttgctctaacccgctttcttttctctcttatcttttcttctcgatacgtggttatagctggtttatagtctgctattgtacctgctgttagaagtattctatccatgttcacgtgtgctggtggtgatcatgtccgatcccagctcagatgggcctaaatgagcgtgcaattcttggtcctcggaataggagctgtgcattgtccataggagtacttcatgattagagagtattgggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaagtaactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcaccctcggcctcatgtcgctcagcctcgtcgacctcgaggtcctcgccaaggccggcaccccgacggacaaggacaacgccggtacgtcctcctctctctctctctctctgccccccctagctctactgctgctgctgatcgctgcgtgtgcgcgcgcgcgcgcagccaggatcctgccggtcgtcaagaaccagcacttgctcctctgcaccctcctcatcggcaactccctcgccatggaggtacaaatctctcctgctgtttttcgatcccctgtatgcacgtatccagattggagctgatggctttgtggcggcggcgtgtgcgcaggcgctgccgatatttctggactcgctcgtcccgtccttcggcgccatcctcatctccgtcacgctcatcctcgccttcggtgaggtgaggcattgatccatctcgcgtgtccatggactatgggttgctcacttggggtttggctggctgattcggtttctcctgtggtcgcagatcatgccgcaggccatctgcacgcgctacgggctcagcgtcggggccaaggcggcgcccgttgtccgggtactcctcatcgtcttcttcccggtcgcctacccaatcagcaaggtgcgcctgctggcttagcctgtttcgttgctcttgtttgcttgcaaagaatttgggggaggaattggaaccttgtagttggtcacttggccggggtgtgctcacaatttggatttggatgggacactacaagtggctgaccgcgactaggacgcagatcggttacttactgattcattaattaattttccaatcaagggacttgtcccattctcatttagtcatctgtctacaaaattctttgtagccggtgactaattaattagtaaatgtaatctgtcccattccccattgaaccagaataagcaatcatagccgtgaagcaagaaccctgttttagtgttcttttttcctttgccagactaggaaaaatgccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgaggtaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagtccggttataatatttgctgctatatggacaatatgattgggcatttctacatgccttgaatattttcttctggctctaatatacatatattctctgggctacttgtgtttgcaatagctattggtgctttcctcagacaaatatgaataccattaaacttctgctggttcacttgttcttaggctggcaaaggtggagagctgactcatgatgaaaccactatcattacaggagctttggagatgactcaaaagactgcaaaagatgccatgactcccatatctgaaaccttctcacttgatataaacgctaagctggacctgtaagaatattccaactattgtacgtgttttgaatgacacattctattgatgctactgttctcttcttgataggcacacaatgggtatgataatgaccaaagggcatagtcgtgttccaatatactctgggactccaaacaatattattggccttatattggtaggctaaactttatgtattattaacttttttggtgccaaaaatcctgttccctagaaacttatgactttcatgttatttactcttggatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaatttcattaagtgggggaaaagatttaattgcctataagtaattcacttttggaaaaataacaacaataactttcccgatccttccattactgtcacttcctggacatcctatatcccaatgaaatagccaatcttgccactttactttcatgtgtttgttatttactatttgaccaataagcaaagaccatctcattttcaggttaaaaacttaattacttgccaacctgaggatgaagtgcccattcgaaatgttactatcagaaaaatcccaaggtatgatcttttattgctttatcaaattggctgtttgccccctaggcccctactgttcctccctaaaaagctactactatgttttcattggcttgattaaaaaatgtacccactattaactttctctgagtctgagttggaagtcaaaatctcgtgcagatacattaggcatgcttcaagaaagctcaaggctacgcatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagagacgacgccgccacctctcccgcccccgtcggaccgcagccgcctccatgccgccgaatctggcggaggcgaggtccggcccgccgcccctcccacccccgccgggctgcagctgcctccacactgccggatctggcggaggcgaggcccgaccggcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtataactaaagttgacaagttaagattatttccatggcttaaactgagggcacccaaggttgctacatactgtgatatgctttggaattgattcaaatatgcacttctgaatacttaatgcttctatgctcttcataacaagagaactattctcagatatttggaatctcttatttaaggaagctatactccatgttgccttgtaatttgcgtgtatctatctccatacaaaatgttcgtttgtcatcttctaattttcctttggtgttgctgctttttggtatatcagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtacatactttccattagccatgatgatcacttgtttttccaggaataaatatttgtttggctgtctgatcatttgaaaataccctcaggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggatcaagaagcagtggggataatcacaatggaagatgttatggaacaattgctacaggttggagatattcttaaatacagcttgttcttaatttatatttttatttgaaaacaaagtcttgcatttttcacatcctgatgcttttttgaggacaccattattttttctccatttatactcttgtttgttgtataaagattttagtgttctccaacctatgggagcaacacgtttaattcagcatgatgttgcatttttttagagtcatctagtgttttccaatagttagaaaagaaactagaaatttttcatagatgtatcgttctttgtaaaatattttcgcttatacatgcaaactggcataaacttctcttggcaggaagatatcttggatgaaacagatgaatatgttgatgtacataacaagtaagtggcttgaaccctgttactttttactcttaacagaacctccaaatgatgagagaactaacatttctttgttttgcaggattaaaataaacatgctacctctgggcaaatcattatcaccaactatatctccaagtaatgggccccattcccaaggactcaggaggacccctatgacttctccattgtcatcataccatcatggtggctccatcttacgttcccctgcttcaaacaatcctcagtctcctgggactttgccgacaataatttctcctgaaagatcgcctgcttctcaagcaccttcgcgtagttcacctaattcaactcaggtgagtagtcactttgtgtctatgcgggttatataggctatttgtgacacatcacatcacatattattttattttcattttatttcgcctaaattgcaaggaacttattttcatctacctgtaaagatttaggttgtattttccccttgaatgtgaaacagttgttggtggcctacatcataccatgctcattgttcttctgtttccttcataggtctcaaggaattcgtaaaacggcgttgagagctaaagagctctaaggacaacgtttcctgagaaatggtaaaatgtcaacataaacagattaagacattttgagcttaggactgaattatacagatcagcatatctcttgtactgttgatgcttatttgttgattacatgcttgtatatacgtatggcttagcatctggacatcgctatagatggaagtctcactacctactgtagatgtatttttgtcagcttgcaattaccattgcagaggaaagcttgaagataaaaatgtaaaaggaatgcactagtatgcatttgtgctgttcttgtatgcatgcccccatcattttaatgatcagcaagcagatgttggtgcattcactgatggctatccacaccatttaagcactgtacaagtcctctcatattgtatcagaaattcagattagtgataaggcgcaagcttatgtttgtgatgctagtttggtgatattgagcagagtgttgtgactaaagtcaaagttacataatgagatcagatcataagattgcaaagggcaaacctcataattatcgagtgggccatcaagagagaagctagtggatcagccggaccatcaaggacagttttacctgaaaagataaagggaaatgtagggcagagaaatccacttcaaccttaaaaaaaaatgtaccagacacatgctccttccgtaaaaaaaaaacaatatagaaggagacgtgacctctcctagtataacggtgatctctcctaggttgcttttttttttcttaggacggagagtgtgtatataagtgacagatccgagacgtggttctcgatccgacgaccctcggtgatcgcagttcgctccttctatacttttacggttttaccctgttgtatatgaacagaggacgaacatgtaaataaatactacttccgtttttttaatagatgacgccgttgattttttctcacatgtttgaccattcgtcttattcaaaaaatttacataattataaattattttgttatgagttgttttatcactcatagtactttaattgtgatttatatcttatacatttgcataaatttttttaaataagacgaatggtcaaacatatgagaaaaaattaatggcgtcatctattaaaaaaacgaagaaagtacaaaatattcaatgcgtgcaaccgaaggcatggatgaggtcaggatcatccatccggaaaaacaaaaggacaaaaaagagaagaagagcttctagattccaacgctacgtatccaaccgcgatcgcttcgtcaaatccgcgcgcgcgtcgtgtcgcgtacgcgcccacgcccactcccacgccttcgcgcgcgcgcgcgcgcgtcgtcgtctccctcaccactcgccccgatcgatcgatcgatcgagtcgtcgtcgtcgacccgttttctctcctcttctcgatcgttatatcgcgaccagtacgcgctactacttctcactctttgccgctcgtttcgctcggagtagccatgctccaggcgagctcggagttgcagcagcagccggcggcggcggcggcggcggccgggatgtgggtgcccgggatgagcccgcaggcggtggacgccgggctgtcggcgagggcgcaggagatcgcgcggaggcgggaggagatgctcgggatgctgcatgacctccccgagtccgagtacgagctctcgctcacggacctcgtcgagaaggccggcggtgtcggcgtggcgccgccttcgccttcgccgtcggaggggaaggcagagccgggcccggcgcggacggcgtccggcaggcagtcggagcagcagcagcaggcggcggcggcggcggggaggccggagaggagggggtcggcgaggcggtgggacagcgcgggcggcagcagcttccgcagcagcagcgacggcgtcctgctcaacttctacatgccacgctccttcacccgcagcttcaccgcgccgcgcaccactggccccggccggccgccgtcggtctccggcggccggaccgccagtgtctgctccgatcgcaacaagaggtaatcaatcaattctgactccaactaacactccatctctatgttctccatcagtttgattgcaaattaaggagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatcgcgacgtgaaacgaactgatgatgacgatgatgcagggagagagatggcgagaccgtgcggtgctggtcgctgctgtgggatcggcggtggcgcaagtcgagccggggagatcacggcaacgagtccgccatccgggccgcgatcctcaaggcggcgaaacacaacgcttcttccccaaagaaaatctgaatgctgctgctagcgtccatcgttttggtcttagatagctagcgcagacttatctgcctgccaccactgggtgtatcaatactaatgtatggttttgtacatacttatgagtgtccattttgtgcttgtgaactgattgtgtgtgaaaaactgaagataggcatattggaaatgattccataattgcgtgcacatccagggtatcgttgtgaactcaagttcagtttataatgggaggcagtcgagatgaatcatatgtattgtttctgaagcattttacaaaattgagatgcaacattgaacagatatactgtatagctccgttttccttccacgccttgcactagcacataatgtaacgggcactaccaagatctctaaacaagagtcatctatctctaaatagactagaaaagaagctacaatcccaaccataaccttataatctcaccccagatggcacttggaacgaacatacataaatatgtcactatggacaaagataacctaaaataatccttatttgccatcattcctcaggtcttattgaagaatcccttttttttctttggtgaggatcttatcgaggaattctgttggccaaccaacatcagtctcagcaactctgtatcaacaattttccggagggcgtcagattcatatttagctgacagacaaaatgtgctttgcaaatattaattatcagaagtacttacattggaaatctttatccaggattcaagtgtgttgatggcctccccggagcgttgtgtttcctgtgctaacgctacaccatcatgcaaagtatttactttaccactgacaagaagagatgctgcagcattcagcacctatgaagaaaaaaagattgattaatgttttgcatagcaaagcaactcaacgtgtgcaaggtaataattaagtgtcatatatgatttgtgaaaaaaaatctaaacaaaattaaatcctatcatgacaaggatcggtaagctgtttatgacagggcgcactgcaaacccccatctattgaagaacttcctatgaaatattcgtatgttaaagataggctaaccactgcagaattctgagttcattgtaaaaaaatgcattacaagaagtttagaaggtagaaagtagaagtaactagaaagagaggataactgtaatgattaacttacgagagcatcagcaattgaacctctttgaccagcaagaacatcctggagaacttttgcgttgaacgctggatcacctccttttagatcttccagcgtgcagcggggtataccaaaatccactggattgtaacataattttaaaaagtgagactaaaaaaaaagtgtatcatatcgtcataatgtatttcagaagttagcatgcataattagaaataagtataatgtgcataaaacatgcaattgatgagactaaactcgaagactcgctcaaattacacaagtgagtccaataaacagtctctgtttctaaaaattctgagaaaaacatagaaaaaaaaactcgtacatggatcgaagagcattttttcaatctttcttggtgtgacatcaaggatatatccaggccctacagcattgataaaagaaattctcagttaaatgcagaacacttagttttaatattccaaggtatttttttgaggaatcatggaattttagcagcagtgtagcacagtggtgaaatggatacattagtatgtgtccgtaccaagtgggcttatttcatccaaacccttcgaatggacaaccaatgctctcttcattccaaatttctgagctgccttagccatcttggtaacctgagtaaaacaaaatatgttcattagggatgaacaatgaacactagatggaaaaccagcaactgcaatatagcttttagcggggctgacatctcaagaaaaaaagctttataaccatgtatctgcaagtcaagtaacacaatatttgctaaagatgaagttcactaaaaattggaaaaggagaatcttatatctgaactctgaattgagcaacatcggttcaacagctcaacagtagatgtctgatgcttgcctttaaggtctttaatataaactcgcatcatttgtcaacttaaaaactgccctacacctactttaagtataaaaccaagacaatagtggtgatgatgacgatcatgtgggtcaacgaaatattaaattgtcactttaaaaaatcttttcttgcatatcatactatttatgctttgatgatttactagaagaaaagaagaaatgaataaggaacttactatgttctcgtggtaaacaccaataacagcataaggcacccttgctggatttaagagaggaccaaggatattgaaaactgtctttattttcagcttcttcctcacaggtttcacgattttcattgctggatgatagtttgcagacatcatgaatccaacacccacctcattgacacatcgtttaataccctgaaaaaagaaaatacaataatatatataaaccccaccaggtttctgatgccataagatgcatataatagtgaataatgtaaaatttgaaaagccaggggcaaccagcctttctgtgcttagaagaaacagccacattataaataaatggagcgactacatctagaattcctaactactccctttgtccacaaatatctagagacgagtctaaatatgtaacaccattcagcctcagtttgtgactacaagaacaagctatgtgtatctgcacacagtaacttcaaatgttgatgttcataatccaattactggaatccaacaattcaattgtgcctttttacaccgataagcaaacctaaacaaatgatagaaccataaagaggctgatctacacatctatgtagtagatctgagatgtcaactagacaaatggggcgtgcttcgcacctcagtcagatgaaggttggaggtaccaacctcagtggtcagcacaaattttcagtaagctatatctgcttgcagtggcagagagacagaggactggcaggggccgtggctacccctatccccaagtatcgtactattttacgcggtacacaatttagcactagaatgagtatagatctatcatttggaacatgcttatataattcctactgcatggcctgctctacaaaattttctagttccgctaccagcagcttggtggatgtgcagctctgcagtcagcaccctcagtgttggagcaaaggtttgaattgggttatgtattatgggtatggatactggtgttgtagttctaatgtagaatctctccctctgtttatgtatctcatgaacagaccaaaccacttgtactggaactttgtgatccactgagatgcaggtggcctgcttttgtagcctaaccttttattcccagaaaaaaaaatacacatgctgtaaacatcacacgtgtctttagacgaaagggagctatggtcttcgactactcttcatagccttcttttctttgggtggcttgcaaagggaccatgctgtttcagcttccatttcatatgtacgattatgtacttgacagagaaaaaaaaagtcaaacacagaaattacttcaccaaactaaaggttaaaaccacacgggtgatctaggcctgcaacccacatcatattttagaggtattcacgaggtaatatcacttgccagttgccatgaagcatgaatagtgctcctactagtgctacagagtacaggagtacaatataaatgcatgaatataagatcctaaaggcaatactagctcacaggaccaggcagaaagcaatcagtggtcaatcaggcaaaggcaactacctcgggtcccaactcgatgttgacaccaaacgcctccagcacatcggcgctgccgcaggccgacgagctagctctgctcccttgctgcacaaaacgcaagcgagaacacattattgcatcaccactagtagtactactacctaaatccaattggagcacaaactgaagggaaaatggcatgcgcatgtataatctcccataaacaaatgaaaggggcgaggagccagtaccttggcgactttggcacccgccgcggcggcgaggatggtggagccggtggagatgttgacggtgtccgcgccgtccccgccggtgccgacaatgtcgacggcgtcatcgagcccgtcgacccggacgcagcagcctatcatcgccttcgccaaccccacgatctgagaacaaggcggagaaatctctcactcccatctctggaccagaacgaaatcaaaattagcgccgcggctgaggcggcgcacccacctcttcgtaggtctcgcccttggccctgaggagcacgaggaaggcggcgatgcgcgcctcgttctcctcctccagcagcagccgcagcgtcgcctccgcctcctcctccgagaagtggtcaccgccgatcagcgtctccagcacctgacgtcaccaccaccacaacaaacaaacaaacaaacaaacaaacaaacggctgagacgagccccggaccagatgaggacgaagagggggagaagcgacgagacattgcggggcgcaccttgtcgaaggaggcggtgcggggggaggcatcggaggcccgcgcggcggtgtgttgcacggcgacgcggggcggcggcgggaggcgcgcggggagcggccgcgcgtggtgcgcgcggagggggaggaggtgggagaccggcgcgggggcgaggggcttggcggaggaggagagcttgatcgacgccgccgccattggtgcggcgaggcgacgcgaggggcgagtggattcgtgcgggttgggggtggggttcagacttcagaggaagagagaagccagcccagtgttccgtgtgttggtgtgaggcggagacctgcgagcgagcggattttgtagggatggctgcgaaactgaaacagatctgctcgccaccaacctcacttttcttttccacttttgggtgtgtttggatctaaagtttgcaaaattccatcacatcaacatgtcatacacacacaacttttcagtcacatcatctccaatttcaatcaaaatccaaactttggacggaactaaacgcagccttgttgcataggatgagtactccctccgtcccaaaaaaagacaaaccctcgtttccgtgtccaatgtttgaccgtccgtcttatttgaaaaaattatgaaaaaaaattaaaaagataagtcacgcataaagtattcatcatgttttatcatctaacaacaatgaaaatactaattataaaaaaatttcatataagacgaacagtcaaacgttggcacgcaaacccgcggtttgccttttttttggacggagggagtatgcaggaataataataatctgtactacagttattgaaagtttgaaactacagtatctgaatatctgatctactgccgtactaactctttttattaggcaactatttccttaaatggttaaccccctttaaaacgtattataggaataaagaaataaaggataggaaaaacatataaattgaagtagcgtgtttctttaatcctataatatggagtagaaaacacagacaaggttctaagatatctaacctctcacttaattctctttagaattgattataggaatgtaatactatacaaagtttaacgtccttttcctataaatcaaaggatatgggaactaaatgttgattggttggatagcattaccgtcgtgcacgtagcccatccaggttggatcctaagcgctcgcaaaactggcatgttccatcaatagctgtgttactgtgtatatctgatttatatatagaggccggatatatccatttttttttaaaaaaatcatagggtatataggaagaaaaatcctaagaaaattattcctatgattattttttttaccaatccttcgtgggcccttagtatagaattacaacatggtgtaatttaatgcctctccaaaatgcatttggtacaatcactttgatacttttatcttataagaaaaaccgtgtaatttgatgtttgggagtaggttgcagtcgatgagtgctttagagcaagtttaatagtatagtccactactagctccaaatcatctataaccaacgcaatagccaattcatacaatagttgcttactatactattaatacctagtctcactagtcatacacatattacgtcttgaaatccgtgctgcagctgactatatgtagcccgctgctcttctctctcttcttttatctctttaaaatatgtttatagctggcttgtagcctgctattgtacctgctcttataggactatgcagcatatgtgccatacatcctacactatcatcggattattccaaaaaagaagaagattattataggatgaattattgcgcacgtggaaatcgcgatgtttctacgctttggttgttggagagacaggacgaaaaactcgttctcgtgagctcgtcctgctgatggtactctccctgcttcttccgtggcgaccttttccaacgatctggctgtaagattttgctgattcgttgcacaaacaccacaaatccaacttgctcatatcttttgtcgcgaccacgatatactatgttatgtttgaattgatgaaactgatgagactggaagattaagttaacgcatgtaaaatgaaaaaaaaatcatcaacatacgactaattatgatttaatcattataaatttgacaaatagatatttgatattttaaagcaaattccgtagaaaaatttcgcaccaatcacatcatttagtagttactccatacatctcattttaaagtgtgctgtggacctctgtatccgatatttgatcattcatcttatttaaaaaatttataaaaatattagaaaaataaatcacgtgtaaaatattatacatgttttatcatctaatatcaatgtaaatactaattaaaaaaaatttaaaataaaacaatcaatcgaacgttagacgtaattcgacagctacaaggaggagagagtatgtgctaacgaaaatggacataaaatctagtaatctttaactagaaaaggacagttgctcgaccggttccctatctcgcgtgcgtatcacatggcttgttttcaattcgagagatttcgttttgacgagacaggcatgacatgacagcacccgtgtttagatttaaaatttagatactcctttttcatcacatcaatatgtcatatacacaatttcttagtcacatcatctttaattttaaccaaaatctaaactttacgttgaactagacataaacacagcctccattaatccggtcagagaggacagcgagatagaattattttttgccagccaccagtacgtgcaagcggttcggtacaaactacaaagtcagataatgctcgcaattgcgtaatgttggattaaaaataggctacgacttctgcagatagtacaacatttcttttctcccttggtgacaagcgcggggagccggggaggacgagtagtacggctgcacggcaccgcgcttggatgtagatgaatggaacttgactactaggtgtactcctacctctcttccgttcagctccggttccgggcaagataggttgtttgctgtgcgttcgtagtgttgttgcctgcgatggggacatggggtcacggcagaattttcctccagtggttggtagatttcaggttgccggtgtttgcccggcgcctgtggattaccaataacatcagggagggatatcagaactggatgttgattttttttatataaatagatttaaaaaaatcctattttaagaatagatctttttcctcaacatcagttcattaacacgaaagttcaatgcctcgacgccaataataactggcaccctaccatagccctctgtaaaagcaaagtcaaatagtcaatgatgcaaatgggatcggtaccaagaatattagcaccaaggacctactccgtatttataaaataaactagggctcggtttagattttaacttttttttttaaactttcaactttttccgtcacatcgaactttcctatacatttaaacttttaacttttctatcgaatcatttcaatttcttcaaactttcaattttaaggtgaaactaaacgcagcctaggtcctcaagcgccgactcctctacatctcggctgctagagagcaagggtgtcagtgtcaaaacattggatcttggtgccagttgtcctgttgccaagactatttatgaaatatttttttctaggggtttatttataaaataaaatttaaaaaggaccagaccaaaatgtcttggtgacgtgtgcttccgctattacacataccgatcacgtgtgcgcatccggattcccaagaaagaaaaacattgcataatactccctggattctagggagcttcgacacgaggaaatctgcaaaggacaatggctaacagcagttcacactgccgtcgaagagtcgaaggcttccccatggggaatacgagcatcaaacgtgcaaggataaaaatcaaaacttactacagtgttgaaggtcaggtttagcaagacaacacgtacaatcatacactctgtgcccacaaggttcctgtactacaaaagcgaaaattgaatactttaggcagaaaaagagagttggcaacaaaccaaaccaagcaacaagaacgagtcagtccatttttctgtccccagcggcctaatctagccaccgagtaactccatcttcttcactcgcagctgcaaggatctcgatacagacgtccaatacagcctacagaacatgcaaacagtaggaagctgagtacattagcttaagtgcttgcacatgggataggacacaatgtgactgtttcatttcgtggttggacgcatagtgtgctactgttttatacagaaaaagagcagtaacctacttaaacaacgttattgaagagggggcaaggggggaggagatgcatgaaataatagaaatcctctttttagaagcaaatggaaaagttcataccgatgaatttctgcaattgataagtttgcaaccctccaacaaggacccctccagcatccagctctcccaaacatcaaatgtatgacttgcaaacacaaactccatcctcctattaatcttcagcacatttaaaaaagttaaatgttagaacattagcaaccctgggtgtcgataagaaatcaaaacacttctgtttctcaacccattttactactggaaatggaaaagttgcactagtagccctataaatgttgcgcatttgagcaatcaaacttattacttttggttgggtgtatctgcttgtacagtgcaacttgtacaagtagaggtataaaacctaagcattaaatagaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctagcagatgcttgaggctctttatgctgggatatggctctcctcttttcgtactccatttttaactgactttcatctgtctgctgctcagaataaaaaacttgtgaactgctaaccttttcttctagctgatcatcttcatttccagcttcgctaatttcctcatcttcatcagatattgcactacttggaacagcaccatcaaagaaaaaggactgcaatatcgtgattgctttctctcttatttccatccacacttcttcactgtagtctgcacttcgaggaagaattaaaacatttggcatctcccttacctatgtcaaataaatagtatccatcattttgctgaacaacaagttctttttttataagatggatgatgaacaagtggcaccaccatagcaatgcagaaaagggcacagttgtttgtcctctactactagcatattggttgttgctcttctgtacaatatgcagaatcaagagagttcaaagttatccctaaaatagtaagagctcaacaggtggagtgcagggaacttgaaatacttgatgctaaactaaattaaatatttactcattttccatatgtttttcctagagattccttttcaacatccggaagagcagagcattctaaatggtgatgttttgatcttagatgaatttcatccatcgcaaatggccacttatcaacaaaaaaacacatcaaaagctgatggacgtacccacgcttccatccattgtggaccttcagcaccatccaatgcacaaccagctattgtaccatcaatcaatagctgtttgagtgcacaatcatctataagttggcaacttccagtatttactatgaatgctcctgtgagataaacaagaaaattatactgtgttttacggctgaactaaaggcatgataagcattatttcggaatatataatgcataaagcagaagaaagaaaggggttgaagataaaccttaccaggttttacatgctgcagacagtcagcattaagtatatgcatcgtgtcatttgttaatgtgcagtgcagtgaaacaaggtcacttgctgccaacaaatcattgagagtatccattctcctggcggcagaaggaaatacaatggaaggccgctttgcttttccattagccttcagtagacatgctaattcagttagaatagtcaaaataatactttaccgcctagcatttcttaaaatcagtaggtaattgcatacaagtgcgacaagatatatatcatgaactttggacataaataatgtgaactgaacatgaatttggggagatttcttaatgtaacagaaagttaatagcccatgaaaactttgggggggggggggggtaataggttagaaccagataagatatacccatcaagatgttcttgtcacaatgtcatcccctcctttgcattttagcataagttact

SEQ ID NO: 13190 - DNA, 9234 bp, Oryza sativa
  unsure (1)..(9234): unsure at all n locations
ccccgaacacacacacaccaaaaaaaaaaaagcttcccatattacccccaaggccccaaccatacctcatctatgagggggcatcatagtttcttttctattcacttaatctttgctaaaaccctagaaatgcttatattttggaatggagggagtattgttcttacttctttatccaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctttggactgtctaactgttcaatcacctattccaacttaatatgttcaaagaagtttgttcatagcagaacattactaatcagaaaacaactcattctagaattgggggtgaaactgttccagtcggttgctaggtgtatgaccaaatgaaattaccacaacaacaatgcgcggattaagatccagagttttagagctgtgcaagtatacgtagaacagtagtaagaagaggaaactacaggagcgtagcaagtcgtagatccagtaccgaatggcgcggatcgaagtagaggacgtccatccggaaggcgaggctgcgagtggcgaggcagcgggcggcggcggatcgaccaatgatgccgagcacgaggccgcggcagcgcctcatgccgcgacacatcggctggacggagcctagccacccagcggcgacagcggccggggccgacgaggcgtggcgcgagagcaggtgggtccggcggagcagcccgaggaagagcgccatgacggtgtcggccacctcctcggctcggttggcgtcgacgtggaccaggcggaggcccagctccgcggcgagggcggcgtccgcggcgcggtcgggcgacccgaggcagagcaggagctgccacgggcggaggcgccgctgcgcggcccgcgggaggaaggcgagcgagggcaggagcacggccgcggccgcctccacgcgcccggaggcgacggcggagagggggacgtgctccacccccgccacgccggccagcccctcctgctccagcgacgggtcgtcgaggcagttcagtgacaccaccagcggctggcccccgcgcgccgccgccggaggccgccgagcgggccatccctgcgcctccctctcggcgctcggatcgggagcgtcgcgtggcgcgggttttggtgcgggcctcccgtctccgggccgaggggggctttttgtcccgtgcaaagggaagaggaagaagagggaagaaatgctctgctgttactacgcttgtcagagtggtgggccgcacgggggccaccactcaccagctcacgagggaacggtgcgttgcaaaccgtcagattcgcattgttaattgtttgcagcttgtgcttgtgtctctcgcgccactgccagtgactgagcagatgcaaacaaatcttgaattatttctttaattcattgtgatgattcgaaaacattatttagcatggcaatatttatgaagatctagtagctaaagtccagaaaagatcagttggcatatccatcaaaataagagaagtttgtttcttcgtacttaatcatggagttttgggtaccaagtaaagcactctctgcttttcttccctccaagcaaagcctggtttagttcccaattttttctttaaacttccaactttttcatcacatcaaaacgttcttatacacacaaacttttaacttttccgtcacatcattttaatttcaatcaaactttcaattttaacgtgtattaaacacaccccgagagaaagattgcctcacatcatttagctgccaaggatagacagctgcccgccgcctgtgtacattgtaacaaaaatgccggactgaactcaagtgaagagttaaaagatagagacatagagttccatgatttccatcaagtaacccaacaagttagcacaacaagatcatgccatcgagcatcatcattcattatagtgcatgcgcttaataccctgaacatttaccaggcatgtgatatatcgtcacaatcaatctagaacagaaaaaagtatgcagagcgcaaccggcatggaggcatgttactcctccggtgcattgattctgctcaatcacacaagcagcagtacagcatggttgctttcttcagagccctcatgaagggggaagtaccatccatgcatctatcagtgaaagctactaacgaacagtatttgtcagtgaaagctactggacagctgttcagacaaaccaatttgtcactttacgaagctgacatggatttttccttcaaacaaaaatgcatgaatattaacagtaagagatgacaaaactgtcgtgtagtatgttctgaacttcgtgctgcttgtttgtcttgacaaccttccaacattcgcacattcactgagttcaacttatgcttcacttcgctatgctacttaacttcagaaacaaaatttgagtgtggctcaattaccttgcacttctattccttgaacatttcagtgttgcatcagaggcatatgcctaaaacacactttgaacaaataaccaagtcagcatggtattaaagttttttaatcaatcagacaggcacatagtacccctagagctaataatcgagtgttgttacgttaacggtacataatactgtctgcagctaccagctactactcaccagaaagagagccatcaacagagggggcacacaagttgttgaagcaaatagggtacatctagaagaaattgttcattctcaacctcaagcaagttcgcaaggtacccactgtttcacttttgtgctcatctcactaggaactgaggtagaccactcatccaagtttggaagaggacccgtcaatgcaacgtaatttacactctctttctctgatagtctcttccagttgagctgtaattcaggtttacgtcaggtgggcattctaacaacagtgacatggcattgctcgtatacgtagcaacccaaaacagttaaacaattaccattccatattttattgttttaaacttttccatcatctagtactagaaactatacaactacagcagtcaaaatatggatatttctgtggttcatgtataatcttacctgccccggaaatgcagcacagagtgccttaattgtggaattctgaacccaggacgaaaggcccgtatcattagcaagagatacagcagcatcagctccaccacagttaacaatgatccgtccatctggcattagctttttcgcgatttccaaccaggtttcaacctgtaacaatgttgaaattaaatccagtagaaaataaaaaactgtggaagtgttccaacaagttaaaagaatatagatatacaaaagtagcgtccaggaattttctctcagctgcacttttacatggttttgaaaaattgtccaaattattccaatgcaaagaatcatatcagccatttggtcaattaggcttgaaaggaagggtcgcaaaggagagtaatccatggatgccgaagacactaaggtcacgtaaggttttttgttaagaacactaaggtcacacaagtagcttacttttgttggtgtatccaaagcaccctctattgatattgggatgcataagattttttgtcgacaaattcacatatcactatagcaagccagccaaactaagggtaataaatcaacacatcatgagataaattaaaatttattacaaacttcaagatatgtagatatcaagtaatttcatccatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacatgctttccaatatactacagataatccaactagcatactccaaaaatgcatcatccaagagcgttgtataattaaatagtaacaagagagtaaagcatgtattccatttgcatcaggtagtaagcactcaccagcaaaccctccttcaattgtcagcgttgtataattaaatagtaacaagagagtaaagcatgtattccatttgcatcaggtagtaagcactcaccagcaaaccctccttcaattgtagctgacggagaaagtgcatcaccaatgcgcacagaaagtgaaccacctgattctgttgccttttctaaatcagataaaccaaaataatcccttgacagttcaattatctgtcattcagtaatgcaaactgagagtaagaaatgggcatatgaaaatggatgcgtggagcacaagggataagtctaaagaaaaataatgcaaagaggtgcttgagctagcttaacagccttaactaggaatatattactgaatttctttttgcaacacaataagtaacaatgtgaaaatatttcactaccatctgtgagcctgtggtcaccaaacaattaaaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgcattgaatatccacaagcgtgtgaagaggtaagttgcccgtgaaaaaaatagaagtgagttgttcaaatgaaaagcctccgtaatgcttgtggatgtatgctggaattgtgatgtgtgctgataatctaattgcaattggtcggtaagacatccattcaggccttcccaaaccctctaagcatggcaggaattttgctttttatgcatagtagttatgcagaacaatgaagtatgatgaacaagataataggtgaatcatgcaccaagtgatttaccaatcctagaagagcaacaggaccacgtggaacaacagctggtaggctcacgaactcatcctgtacaataggaaaagcacaccgtattaagcatttacattgagcagccatttttaaaggatgaaaaacatcatttcaaacagaatagttggcgtagaaataggatgcgttttgcaaagaaaccaacccatcacatagataacaagtacctatatgagcatattatagtctttttttttttttggtactaaactgctatccaactaccaggagcctattactgtccttctcaaaaacttgtttatcatggatagttgacgggatagagcgtcaaattcctaatgcatacaaggcgctcaacaatattatgcttgtatgtcaaaatggcacattagtaatctaaattcaactcgatcagttcagattactcatacgataaatgcataccctgtcagcactcccgattgaaatcgctctcaaatctcacactcaactcaaactttcaactggatcaatttgggaacactggacgaacagcttgtaggcatgaaccttggtagacaaaggttttcgtgctttgctagttaatctgcagcttttcggttttcttccctccgttttgaacgacaattacaacaaggttagggccacgatcccatggtgcgctccgtgaccggttagtggtgaatgctatcccatacgccccgggtcacggcgcacgacggcacgacgcgctcgccggctcaacggattcagcaaaagcaggcgaaacaaaacagcaaacacctcacatgcaatctaaactacgctataaagattagaagcaaaggattacagttctatacccaatatgagttggtccagactccggtcttggggagaacgctgtgaacattccctgcacgatacaaccaatcgggagcacgaactcaccaaacgaatccaatttcgaggcggaggaagaaatcgcagtgtgcagcgcaatacgtacggttggtgtcgaggaggaggtagcgggtggcgggcgagtcgatgatcatgatgacctcgttgaagtcgctaccggtgatggcgaggagcgtgtactcctcctcctcctccttcgccgcttgctcctgctgctcggtggctggaggggcggagacttcgccgccgccaccgggggcgcagtacagcggccgccgcgccgaggccgctccccgtcgagggaggagggagactcgggtggcggagcggcgttggggcttggcttcgcggcggcggtggcggtggaggaggcgaggcggggagaaggttagcggcatggtggccattgctgatgagatagaatgctaatgcacggcgagggattgggttcccacgatttcaagccgttgatggagatggcgggttaggaattcccttttgataactgcaaagcgtattagcgtaatcggttcttctcttaaaccatgattatttcttaagaggccttttcggatgaggcccgataagagaaaatttcagaggcccagcagatatagtcttacaatgttatgggccataattgggcctgagtattctagtgtggttggtttcatctgaaatcaaactgcgaagcaagcaagcagtaaactcccagaataatagcatttcaaacctgtacaagacaaacaatcttgatgtgttgtattgattcgaaacttcgaacggctgtttcagaatatgagcaattttttttgggacaggaagaatatgaccatagtacttaactttctcgcaggtaccacctactccaggtgattgtgcatgataaaatgaatctgcagctaacaacctagcctctccccaacttccaatcagtttggtcaattggagcctttggacacatgcatcggacgccaattgacctgtcgccggccgccgggagacacgccgcgacaggggccacgacgccgccatgacatccgtaaaaccagcaaagctgcaaagacatcgcggccgacactgacgcacgcaacggcgcacgtcagatgagcccacgttccttgagatcgccggcaaatacactgggaattcgatgtttcaccgatccgccggcgccgtctcgcgcaccgacgcagtttctatcaaccactctctccatccaccaaattagccaaaagaaaaaggttcggttggtacttggtaggctaagctttctagctcgttttctttgtgctttggctcgctatcaacgagcagcctcccgcacttcacggcctaatctccatcaaattgcagtgacaataatgtactcttaaacgtatttaatgacacgtacacatgcagcgaatcccgaggacgtggatttatactgcaactgtagttaacgtgtcagcgcagtgcgtgcatgcgtgcgtgcaagcgtgcaaggtgcaactgtactgcatgcagcatgcgtggacaagacgtacattagctagttggtagtggcgctgtacgggagaggtttcgttggccggcggcgagggcggtggtggttgtgttcgccggcgccggcgaagagctcctcacagacgtcggcgaaggcgcggaggatgaggtggtggtggcgcgacgagttgagcgagaggaagcgatgcagcagctcccgcagctcgggggtggccgtgatctcgttctccacgatcatctgcgccatcgaccgccggaagtcgcccagcgggtcgtccgactccgtcaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagcaagtgagcttgtgcgctgtttgttgtggactagctacaccagctatagtggggagctagggggacagacttcttaaagcctgggcttaacaagagccagctaggtgaatttcagacatgctgatgcagtagcagcaattactcaactacagacacatttataattccaagtcattaaccaaaaaattagtatcacgctatccgttgttaggaggtcagtgtcagattctggtcgatttaccagcggtaatcttgggtcaatccagggtgaaaacaacattgacttacaaagtatagctcaatactatttctgaccgttcagttaatcggttactactcctatttgtttcagacttatacgcttaccattctgttcgtgtacagatgtactgatgctttcagattttgcataactctatttgcaagggaagttattacaaaacgcacgcaaggttgtactgctacgtcagaaacagggcaaagaacacatcagacaaatgaaaaactaacataccatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13191 - DNA, 10671 bp, Oryza sativa
ctttacagtccatcttttcatttatatttatacttattagctaaaatttaaatttttaactttaaatttaaaggtgatttaaaggtatttttatcgtagtttattttccaaactttgcttttagatcgttaagaacccattctataaaggtggattcaccaaattatttttgttccaaataagtcggtttcttttttttcctccaatgtaccaaacgatgggtctattagtttatatgtcttttgactgttgtcgcatttccgtgaaattttcctcggaaaggcatctggtatggttggacccaggcctttatatcctatctcccaatcgaatgtgcatgcaacttatggctctgccgtctatacgtgttctgctcagctgctctccatgctctgcatttgtagtgtggaaaataagaatttagggccctttgaattataggaatgaaaaaatagaggaatagaaaaaacataggattctgacagaaatgtaagtgtaaaacagaggattgcaaaacacaggaataacgtaggaatgaccgtttgattggaccacaggaaaaacacagaaatttgaggagagataaagactcaaacgattttttccatgaggttctacctcttgttaaaattcctccaaaacttatatgggaagaggcattccataggaattttataggattccatagggttcatttctttaatttaaagggcttggtaggaaaaattactataggaacgaaatcctctaaaatttctatgaatttcctttgaatcaaagggtacaagtagtctatacgtgttctgctcagctgctctccatgctctgcatttgtagtgtggaaaataagaatttactaggtacaagtagtttgagggtaattgaaaaggatatatttagattgatatgattttaaaccatactattgaaagtggctatacattaaacaagcctgtagatctagatatatcgatttatacaactagaaatatctagttttacaaaatcttggatccgaaagtgtgttaaataagatgttaggaaattcataggaattttaggcccctttgaatcaaaggatttatatagaaatttcataggatttaaattctataggaaatttttcctatttggccctttgattcaaaggattgaagctttccaaatcctatgaaattcctatagaatggcacattgcatatggattttggaggaaatttagcaagagctccaacctcttggaaaatttcctttgagtctatctctctcatccgattcctacgtttttcctgcactccaatcaaacgaccattcctgtgttttgcaatcatctgttttacacttcaattcctgtcagaatcttgtgtttttcttattcttccgttttttctaccctgcgattcaaaggggcccttagaggattttattcatatatgaatttttcttacaaagccctttgaataaaaggaataatcctatggaatcctatgaaactcctatggaatgcctcctctaatgcaagtttcagaggaattttaacaagaggtagaacctcatggaagaaatcctttgagtctttatctctcctcaaattcctgcgtttttcctgtggtccaatcaaacggtcattcctatatttttcctgtgttttgcaatcctctgttttatacttacattcatgtcagaatcctatgtttttttctattatttcatttttttcattcctatgattcaaaggggcccttagtgaatcctatgttttttctattattttatttttttttattcctatgattcaaagggacccttattgacctagcgagacaacgtatggttctgtaaaataaaaactgtaaacacacagcatgagcagccgagcagggagcggtgtagtgggccaaggcagccaccgtttcttcccatttccccccaagacaaaccaaatgaatcgctagttgctatgcctattagcgatgtctgttatctttatgtctttcgattgactctaattttgatctttgagcaaaagggcatttagctgagtagttacaaagagtctcagtacatcttaggtccagagtttgattttttgtgggagcgaattttccaacatttaacggctttgtgcttttaatggtagacgacgtatctctaggatggatttgccgacccagtcttcgaagatgcttataggggtagggtctgcatgcgtgcgttcatagtggtgtgaggtgcgtgtgttgtgaatgtctgcgttgtaatatgtaatcgggtagctaagggtcttattccaccatgggtgacatagttacattagaattgctagctaaaaaatcttcgtggttagtcaataataaatgagagttgaggatttgtcccatctttatttcttattctgacttatttttatctttactattttttcaacaaacttataattgtgcgtctcatgacagaagccaaagatacaatccatttttattacctaaaaattagtgataccctaattcaatcaagaccgaaggatcccaaggctcccagctgcccattccagatggacggcacggatgtacgctgatgacatctgcgctttactggttacaaatatagaggatctgcgcccctcgcgtcctgcctggccttttccgtgacgagacgacgcagaacaaaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttcattttctttggctcttcagagttttgtccatctctatcttcagagttcttcagagtttgcttaccatatgatcgtgatcaggtttgtagccagccaaatcttaattcataagaatgcaagatattcatgccttgacatgtgatttctttatttgtctatccttttcaggtatcggaattctctttatttataactacaatgcaatcgctcattttacccgtaacaattaccaagagcttgtttagttgacaatagagatatcaagtcaaataaggttgtttgtgttacacaagataccgatgaattttgtagtgttgcccttctattgggaattcataaatgttgccttgatgagatactacagtaccaataagttttttttaatgcctagaggttaatgaaacgtatagcatatggtccgcaaggctaaccaacagtggatcatcccaaacgaaaaaaaaaaactatgcatgtctctcccacgcgcattatttttcaaggtaacatacatgagccttttatgcacaagtgcatagaattgcaactataagatttttttataatagctttgatatatttaaaattttattacacatgtcctatgctaagtttcaaatgtaagttgaaaaagttggtagataaattcatggcctaataatgatacctacatgaagaggaacacttctacaagcgtcatcaatgttatatctagctatctgcaagttgagggttttcgtcaaagtatggcatcactcaagtcacacctacttaattcaagcatggcgaaccaatgaaataggactaaaaccataaatgctagataaatcatgctagaaactcctatcataatatattgctactaaatcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcaggttttttcagcctaatccttttatccctcatgcctaaaattgtacaatggttagccctactgcaaacgaccttgcacaataaaaaaatcatgcataattgcatattctagtgtaaattctttttgcatatgtcttttggacagtacacctgatatgtactcactccatttttaaaaagactaatttttaactataaatatggatataaactatctttagatttgtgttaaatggtgtgaagttaaaaataaatgtggcatcctaaatcgatccatacacactattttgtctatgggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgcttttttcttgcctttccccaccacaccacaccaccccatcttccatctcaccatccccctttcccaccctcccgtgcgaacacacccgcggcgcggagcccagatcgggatcgcgacggatcggcggcggcggcggcaatgggaggcgaggcgggggaaccgccgctggggagggcgatgagcttcgggatccccgacgtggcgctggggctggtgatggggttcgtggaggacccctgggaccgggacgccatctcgctcgtgtgccgccactggtgcagggtcgacgcgctcagccgcaagcacgtcaccgtcgccatggcgtactccaccacgcccgaccggctgttcaggcggttcccctgcctcgagtcgctcaagctcaaggccaagccccgggcggccatgttcaacctcatccccgaggactggggcggctccgcctcgccgtggatccgccagctctcggcctcgttccacttcctcaaggcgctccacctccgcaggatgatcgtgtccgacgacgacctcgacgtcctcgtccgcgccaaggcgcacatgctctcctcgttcaagcttgaccgctgctctggcttctcaacatcctccctcgccctcgtcgcccgcacctgcaagtaattattttttacccttacaaaatattactcgagtgagtcatttaaggttctcctttgttcgcttaaaaagtgttgttgtaaaagggatttgggtatggtttgcttacggaagggaatactacgtcttaggagttctctcttgctttggtcactataaaaacatcttagttctagaattcaactttggagataattgtagctcataggtattaaggaaatggtgtgctttaactgtcacaccctaattttctagtgaggtgcgaggatttagcttagatccaaggctacttagtggaaatggataagtagaaataggttactgcaagagtgcggtggatttctagataattgaccagccatatgttgtcatttgcaggaaacttgaaacgttattcctggaggatagcataattgctgagaaagaaaatgacgaatggattcgggagcttgctaccaacaatagtgtccttgagacactgaatttctttttgacagatctcagggcatccccagcatatcttaccctccttgtgcgcaattgtcgaaggctgaaagttttgaagattagtgagtgcttcatgcttgacctggttgatttgttccgtacagcagaaatattacaagactttgccggtggttcctttgatgatcagggtcaagttgaagagagtagaaattatgaaaactactatttccctccttcattgctccgcttgagtttgctctacatgggaacaaaagagatgcaagtgctatttccatatggtgctgcactcaagaagttggatcttcaattcacattcctttccacagaggatcactgtcagctggtccagcgctgcccaaatctggaaatcttagaggtatttcctggtagattagttgcatgtctttttgttatgtttcttgctttgaggttttataggaatattcaacatgggctgataatcctttttctcatgtcaatccaacaggtgagggatgtcataggggatcgtgggttagaagttgttgcacaaacctgcaagaaattacagagacttcgagtagagagaggagatgatgatcaaggaggtcttgaggatgaacatggtatggttacacaggtggggttgatggctgtagctcaaggctgccctcatttagaatactgggcagtgcatgtcactgacattacaaatgctgctctagaagccatcggtacatacagcagcagtcttaacgatttccggcttgtcctgcttgatagagaagcaaatataacagaatcaccccttgacaatggggtgcgtgctttactgagaggctgcaccaagctccggaggttcgcattttatgtaagacctggggctctatcagatgttggccttgggtacattggtgaatttagtaagacaatccgttacatgttacttgggaatgttggggagtctgaccaaggactgcttcaactctcaacaggatgcccaagcttgcagaaattggagctgaggggttgtttcttcagtgaacgtgcattggctgttgctgttttacaacttaaatcactgagatacctatgggtgcaaggatacaaggcatctcccaatggcactgatctaatggcaatggtgcgacccttctggaacattgagattattgccccgaatcaagatgaagtttgcccggacggtcaggcacagattcttgcatattactcacttgcaggaatgagatcagattaccctcactcagtaattcccctctatccttcggtttgagtgtatatgtctgataccaggttgcgaaactcacactctagtataggccgatattgttccaaattctacagtttgctgctcttattctgtttagcaatgagcacagaacaaatgacaaataaaagcaggatagctgttagttcgaggaacatattataacatcttgggactaagaattttattgcatatctgaggggtatcacttctgcgaaagctcagctcaattggccagcacggatatgtaaacttctccattttgattaggatcggacacacaattttgtaataatgttccttgttcaatgtttagtagtattatttgactctttagctttgtgtcacattgtctcttggaagatcgccgcactgtgttctaataagtcattcgctgtacaatatttttatcatccacagatcacactactggctgtattcttgctgtgacttttctatttcttctctctttggttgtgtaacgccccttgattggtctgtatgatggcgcgctgcttcttactttatcttgtttggtggaaatgtggaatcatgcatatcgatatgtaattacatatttcaataagagaaacaatagccaacctcacttttctaatctatctatgtttactcctaaatcctaatagatttgttgataggttctatgcgtttttggtgcctattcattttgtttggtttgggagtgccggtttgtaattgtgtatgcacatgctcctcctttacgtcctgtccacccttttttatttcgagtatggtgttgtcggtttacaaatttatgaggtgaggtggatgcaatctacttcctccatctcacaaagactttatttttagattttcgtatctaacatttaaccgtatatcttatttgaaaaaaaaatgaaaaaaattaaagaaaatagtcacacataaaatactatttatattttatcatctaatactaataaaaatattaatcataaaaaatagttaaataaaacgaagagaaacattatatctaaaaactgaaaaataaagtctctgggagacgaagggagtagcctataaacttgattcggtaacttgatttgcccacagtagcacaaaacccagcctgactgcctgaaccaactgtgtctgcctgcgaaaatgacagcataacagaacctgatacaacacacagtaagtatcaatatgctacagattgtagatctggacaccataacgaaccaccaataatatctgcctacgaaagtaagcataaacatatagaagtatccgatacaatacgacacaaatattatggtacacggtttctaagttggaaacaggtgcaaagtaagcttcacgagatacagacatacacttaggcatagagagctttattgatctctagaacatcaagcttcaattcattctgagcgctccctggagacagaccttgagtaggaactgcggctgtgagagtagctctccctagaatgcctcttacccgacgacctgctgcgcgacggtttcctttcactgtatcttttccttggagaatagctccctgacctctgagaatccggggaacagctatgggagtagctcctctgaggtgatacactgcgagaatagctccgtcctctagcacttggagaatagcaccttctatagtatggtgaaacagaatggtcataggaacatgacctctctcttctgtaacggtatggagatcttgaacggtagcgggaaccacggtaagatgagtatgaccgacgccgtgaaccacgtgtgtcatagggagagtatgatcgccgtctaccataaggagaaggggatctgccatacggagagtaggactgtctcctttcatgtggagagtaggatctacgctctcatagggggagtatgatcttcgcctgttgtatggagaatatgatcgccttctaccataa

SEQ ID NO: 13192 - DNA, 1357 bp, Oryza sativa
tctcgctcaggtgagtagcgtgaactgtagcgtctcttcaccagcgagtagctttgggaaatacctccgtgctggtgtcactgtataataaaaatattcagcaatcagttgtattatatcagaaaaggctagcaatgcttcctattttccagagaaatgagaccaaaccatccagacacagcagcagttaaatcaaacttaccacatgatgattttgtgcctagataccttccgggcgttggtgttcgaccacgtcttctcttggcctgtggaaaggattcaaataagccttttcgccatattagcattaaagagtgatgcaacaaattgggaatctgaacgacatgattaatatggagactatataatgtagggcatacaaccctttggttgaggtagcatgtttggctgttaggttgtaaatcttttgaatttgacgtagagcagcaacggacatctaccctgctgctgtcaacaaaagcttcaaacggaagagcactcaaatattcagctcagcaagctaaatgagcatataaatttcactccaagtagaagtgaagaaattcagtaaatatattgtgattataccttctctacagttatcacacgaccttccaacactgagcggtctagatatttgatgcaaagatcagcctccttaacagtagccatggtaacaaatccaaatccccgggattcccttgtccatggatcaagtactatgctagcatcaataacctgtaatacggtgagcttaaaaagttgtacactattttggtatccctttgcagatactctataaaggttacctctccctcagcagaaaagtgtttctccagatctcgatctgtcacacgagcagataagccagtaacatacaggttgttcccagggttttcaacatcacttgagtccacacttctaaagacatcaaaaggatatcacatactcatcagaattacagtaggcaaaaatgttcaccctcgaatatagagtgaaggcagaaacatactaagcgctaagataaataccatacctagaacgactcctataccttgaacggctgctccgtctgggcgatgtagaatatgagtcggactcatatctatcagtaggagccaatcaataatcacaagacagggcttcaaaaaatgtggaaaaaaattaagtttggtaatgcgtaccttgatcctctggagtacgacatctgcaagatagacatatgattgcatcaatatccactagagaaacaaatatatcaaaaacatgagatgccacttgaaaatgtaattataacaaacagtgggttcatagccttttgaagttgtaactgattaatttatgacccttggtgaca

SEQ ID NO: 13193 - DNA, 9670 bp, Oryza sativa
gacccagagtatatacctagcgcacgccaaaaataatccacaaaccaacataacgaaatgaacaagaaactgcaagacaggagattctttgtttattttcagcatggtaatcatgaactataacttatgcaattgcgctcagcaattgaagcttccaaccatacagtccctaagataaatcgacttcctaacactgtccctaagtttcctccgaggcatgtaggggcactatgcaagtttcgaactttcgacagttgcgtttcaaactacatatacaatggacaaaaaatgattatgccacaagttgtacaacaatttgttcccttcatttcttcatttcgtgcccctctagaaacccatgtactagcaatctatacctcttcttttgcaaagcaaatacacgcaaatcagatcattttaacaaatgagccgctatccaagatggggaactcctgccgcaacgcttcgaactacagctaggatttatctttatatagattaagaataacaaaaataaataaatataaacggatgtttttatacagatcagaggggcaaaccatcgccatactggaacagagaacgaacggattcaccgtctttagcagagataaaacatgaggagaatcagaggcagcaataataccttccttcgtcgcgacgatccgtgccctagccgagagcgtctctctgtgccggcctctcttgttctcagtcacggcgctgcctttctgcgcgtcggagcgcgtgcggttgggagaataaatggaagtgtggaatggggaaggttctggacggaggcggacgcgaaagtttctcaaatctggttgatgaatcggttgcgcgcacgaactccgccttcctcttcacgccttcacacatggcgcttcttggagccattggtttttctttcggtttgcagtaaataaaagtttcccttcagggtttggtttactttccaactttttcttcaaacttccaattttttcattacatcaaaaatttttacaaatataaacttttaattttttttctttaaactttcagttttaaccaaacttctaattttagtgtagaactaaacacacagcctagacctcttttggtcctatagaaaattagagcattttaattataatgataattctaacgagttttttttaaacaaataattcaatcctatactcccctgtaaaatttctataaaatggacacccccaacagagattttaatgaaaatataagagttacaatccttatgtgtcttacaattgtattgttcatctatgttacaaatattagggcatgtttagttcgcggaatgaaattttttgggtgtcacgtcggacgtttgaccggatgtcgaaaggggttttcggacatgaatgaaaaaactaatttcataactcgcttggaaatcgcgagacgaatcttttgagtctaattaatccaccattagcacatgtgggttactgtagcacttatggctaatcatggactaattagactcaaaagattcatctcacgatttcccccctaactgtgtaattagtttttcttttaatctacatttaatgctccatacatgtgtccaaatattcgatttgatatttttggaactaaacggggcctaagggtgtgtttggttcttccctttcccaacttcaaatctttgttttatgtgcgcacgctttccgaactgttaaatggtgtgtccttttacaaatgaaaaattctatgtgtgaacctcaacataggaaaataataataataaaaagaatggttgattgattttgctttagctgttctatttgtcagagtaattatcgagttatgaaatgctatctccatccaaatcgcacccccattggttggcttattcttggaataagccaaacgacacatttacaaacaataagtaatttgtgaataaagcatttatatacgtgttcttagcgacctaaaagtaaatgctgaaaaataaacttcaataaaaaactctaaaactagcttcaaatttaaggttgaaaattcaaattttagctgataagcataagcataagagaaaagatgaagccgcatatggcgtatccaattaaactacaaaacatattgctaggtttaatgcaagtaggacatgatataaagtagaataactatatttacttttagtcactttattacggtggttcttgcaatcagtactcccgcattcaaattagtgtcaccgagcgctatttgtactttttaaaaaaccgctatttgtttttgggttaattggatccatgccattgcaactttgtgaaattaaaaaaaataccactactattcgtcatatcggctatatgccactagaaatttctaaaattgaaaccataccactcgcgtctcttttttcgtcttctctctcacaccgtctctgttcctgtcctcatcccctccctccttcctcatctccgttcccgacttcatcctcctctctgcgtgagcagtagaacttgatgagggagttggtgacgacggggtcccgctcccgcgtgcgccttccctttccctcttcgtcgctgacacggtctcctcctccccgccactacatatttctcttgccggcgaacttccaccgcacgcgcacaagcacaatcatcacagactccggcgatctccatggctccattcagtggggtgatgacgggtgcgcgagcgcgtcgtacttgaatgcctgcgcgtgggtgaggcacgcggcggcgaggcacgcgaagcctgcggacggggaagggggcggggaagacaacgacgcgagggcggcaaggaggagggagagggtggacggggtgggcggcgaggcctcacagatgcgggagtagagggcaagggtggcagccgcgggggcacagcggcaggccagcgcagcgtggagcgggcagccttgggagggcgccgacgagaaggcggcagctctgcggagaaggaggaaggtggggtccagagccaggggaggaggcagcagaggcggcgtgagagcgcgggcatggcaggagggcttgggagccgccgccgccgtcgctgtcctcgatcccctctatggccgttgcctccatcctcgacgcaatttggagctcgggagtcgccaccgccgccgctgtcctcgatcatcgacgggaggtctcgggagctgccgccgccgccgtcctcgatgccatccgcggtgggagtgctcgggagccgccgctgccaccgtcctcgatgccatccgcggtgggagtgctcgggagccgctgccgctgtcgtcaccgctgtcctctttgcaatcgcagggatggaggaaaagatggagaagaaagaggagggagatggaaacgattaaatagggagaacgagacggcgtgggagaggagacaaaaaaaaaagggatgggactcaggaatggcatggtttcaattttagaaatttccagtgaacatgtagccgatatgacgaatagtagtgatatttttttaatttcgcaaagttgtagtgcattgatccaattaactctttgtttttagcatttgaccattcatacttaagagagaaaatgtgaaaccatatataaagttctctagattcataaaaaaaactaaatataatataggcacgacacacattcacataaaatctcatctataaactcaactttgttcgaggtaataaaaaagatagatttcatgtgaatagttatgtgttattgttcatcaaaaaattgtcatttttgttactaccaaataaaattgagtttgaacttgagatttggtgtggatatatttcatgtctacgtcaatctccaataattatttttctcagatttattaaacttttagccctggtttttaggggtttttttcttatttgatgattttcaatgaatatgtaccttgcttaaaatagtggcggctggtgtggcagcagtcatttggactatgtggaaagctagaaatgcagcatgtttcaatgataagaaaatttaagatgatctcgttgaactaattcatgaagtatgttattggatcgaatcttggtccattttgcagatacaggaggacgagcgaaagaagactacaactgagggtagtgctgctaaggagaatagccgctgagctatacaactctgtaaatggatggaagctgcaaacgttgaggctgaaatgaagaaagatcatgttttgtcgtgtttcgtcgtatatgtctgttgcaagtcctttggggattcaaatttgataatggaagtctattatctattttagtttagcatgcagttactgggtatgttgagttacagacttaagttcggcacctgaggttggcaactaatcactgttgcatggaaaacagagcggtccatcagtgcatgattagttaaatattagttttttttttaaagttgatcgatatgaattgtttaaacaacttttgtatagaaaaattttataaaaacgcactatttagcagttttaaaaggtgtgcgcgtgaaaaaaagagggaagtgagctgggaactttggctaccgaactcagccttacaggtcatataaactctgttaaaagactttgctatatgcgtttcgataaagaaatgggagacgaacccttttttttttaaaaaaaggtaccctgcttaaaaacacattatatattattaattgtaaaatgcatgatgtaatgtatatgcacatgaaacccccattagtcgtttcatagtagttcaaacattacaataattattgatcaaaggctacattatttaagaacatatggagtaaccgcatataacaagagagaaacctgtttagtgcctttcaaacttccaactcttccatcacatcaaatatttggatatatgcataaagcattaaatatggacgataaaaaaaccaattgcacagtttacatgtaaattgtgaaacaaatcttttgaacctaattacaccatgatttgataatgtggtgctcaatagacacttgctaatgatggattaattatgtttaatggattcgttttgcaatttacaggtgaaaactgtaatttattttgttattagtctacgtttaatacttaaaatgtgtgtccgtatacgttaattttttttacaaaacaactaaacacggtccttgtcgtgaaaaattatatattttaacataacagtaataggtagatggaagcaaaccgaacatgtaaataagcatacatgtttatattatgttttgcaaaaagaaaaaaaaagaaatagacagagggagcatgctatgtcgatcataataagtatttatatataggatctgttcagattgtagccaaaacaaatattatcaaattttagcaatcgacaatttggcaatatcatcgttttggcatgatttcttatgtatttcctagagtttggtaaaaaactaaatgatgcatatatttgataacttttttaaaaaggtatggtttgaaataaaattaatctgaataacgccatactagttaatttgaatttgaaagctgagtggaggaatttgaatatttgatcggcgtgaaggtcgtctttccttcgcaattcacaaaatcggtccgggtcgaaccaatcaaccaaagcccagacagtacaccaaatccaaattggcggttggatcgagccagcgccgcggccacggcacttcagtgctccatttgccccaacctgacaaaaccaacccgacccgcaaaaatccctcgacacagcagcacacaagaaaagcctctttgctcgccggagagagatctcactcccgcggcggccatggcctccgggcaggactcgtccagcacgacgctgatggatctcatcacctcggatccgtctgccgtgccggccggcggggcgtcgtcgcaccagcagtcgtcgtcgtcggcggcggcggcggcggcgggtggcgccctggggaggcccgcgccggcgccggcggatcgcaagtcgaagagggggaccctgagccagatccagaacgagaccatctccgccgccaaggcgctcaacaaggccctcccgcagcgcaacaggaagaagaaggctagtctcccgttgccccaacccccggccgctgccatctccgcaccccgcttccagtctgactctgttgcctctctgctttctcgtgcagcccgtctcgtacgcgcagctggcgcggagcatccacgagctcgcggccacgtgcgaccaggttcgttctgctacttcggttggatcgaattgcgtggtttgagcttggatctgtaggctttagctgctcttgtacctccctttctgcagaaaagttctcagaggcagcttgtgaatagtgtattccccaagcttgcggtgtacaattctgtggatccttcggtggctccatctcttctcatggtaagtatgccgtcctctactgttttagctctttttatggcttcatctttcacgtagacagcgtaattacttggtaaaagcagtaactagggtaattctcagaaaattcgactatgttagcaccacaatgcattgtcactatggtttgagtctctgaggagatcaatgacaaccttttcatgtttaaaacagaggaaaaaaagtacgagtacttaaatatgtgttgcaacttggaactgaaactgcacacatcgcataattcactgttagattaacctaacgagatcttgtttacttcagttaacttttctcttaatcgaatctggttctgtatttacagcttcatcagcaatgcgaggatagaaatgttctgcgctatgtatactattatctggctcgcatattgtcagataatggtgcccaaggtttaagcgctgctggtggcatacctaccccaaattgggatgctcttgcagacattgatgctgttggtggagtgacacgagcagatgttgtaccaagaatagttgatcagctctcagctgaatcaaccagcgatgatgttgagtgtatgcttttatactgtgctctcaatatacgttgaagttgtattatgcaaaacttgtattccaaaccaacctcttgtcactgttttacattttttcctcattggtactgctccccttttgcactgatcacacctcatgattagttctaccatattctaagcatgctatctcattttggtgaaataagtattatgttattttcttctgttttgcatcttagtgagaattatatttctagtaaacatctaattctgcataaatgataccatatgaccaaataagaatgatcacaatattattatgcatggctgagctaaaacaagatgctctttaatttcttgaaccaagcatgcttaattcttattaagttgcattgggtggttcttcatagtgctaaactatggattctggtctttgaagttcatgctaggagacttgctgctctgaaggcccttacctcctcctccacaagcaattctgagatgttggaaaaactctacgaaattgtgtttggcattttggagaaggttgataattgatatgcttttcatattcagattagttcctcaaagttttattgccctaagttcctttttggtatcccttgtttttggctataaaattgacgcttttcttctgtccatgatgtattctgaatcctttcaggtggctgatactaaacagaaacgaaagaaaggtatatttactaagcaaggtggtgataaggaggtactaaacagaacgaaagtactatttattgtatatgcacttaacccttttcttagaggtttcttatctcataccttgctgataatgggagttaagaatacacttattggaacattgtagttaacctggtagttttttcttgactagataacaaagtaggtgacaccacttcctgtttattttgagctggacttaaaattcctcactagtatcagtacaagctgtctgatgatgcctttctaatttgcatttctttgcagtctattatacggagtaatttgcagtatgcttctctaagtgccctgagaaggcttccacttgatcctggtaatccggcatttctgcaccgagctgtccaagggtaagtgtgaccttttttcctctggaaacttaagtttaggtttattttccatgtctgtttagtttaccagttatctactacctccatttcatattatatgatgttttggatttgtcctaagtcaaatttcttagatttcgaccaactttatagaaaaaaaaatcaacatctggaacaccaaattagttcatcatatccaccattaaatatattttaaagtacatttgctttgtgttgaaaatgttgctatgtttttctatagacttggtcaaacttaaagaagtttgacttaaggcaaacccaaaacgacttataatgtggaacaggtcgaataggttattgcttcttttgaggataaatgggggcatgagtattgttttgtggtatcttttatttgattatacaataatagtttttcttattgggagcctagtctaaactaaaagattagatcattgtgatgacattgctaatagtacggcgaaggaggattcttcagggtgtgcttaatggagaatgaatattcgacatctgttggtttgttaatataacctatcttgagagatctagaaaggatgctattctcgtgtctaccttaaactgcaataccgcattagtgttttttagacggatataagattgtgagagccgatgctctctttaggccttaatatggatggatatccagtgttcaagcaggtaagtgtaaagacggagttatcaaatggtaaacttcatcgaaaagaatttctccctacaaagattacaaacaactccttaagctacatatttgtattgaagtcttctttaagcaaattgatcatttcattgtgttgtctgaacataattatcaaatggacacctaagtttttgtctatctatttttatgaccacttgattctgcttctgcaacaaaattacagaggggtatagcctaatcaaaaagtatcatcaaggaacctgctgttgcataattatcattttattctcatcagacctggtacaattgcagggttgaattttctgacccagttgcagtaagacatgcgttgtcaatagcctctgaaattgccgtgagagatccgtactctgtcgcaatggcactgggtcagtttactcactgattgttgttcatcttatttattgttcttgcaagcagacaaaacatgggccattaactcgtggtgtagaacatacttgatcttttatgtgcaaggaattgtatagaatttcgactataaattttttaaaaactgtcagctgtgatatatttagtcaatatgcagtaaatttggctcatgccatttcgtagattctcattctcatgtttgttttttgttttgcaggcaagaacgcacagcctggtggtaatgttttttcccctttcttctgtgtttcatttgaacttaacttgattatgcatctgatttgtgttttagagttctagttgaaccgaccgagtttgtagaattaggatttctaatgatatgggctgtattctgcgaagaatcacgtgttaaatcgcattcatatattgttgtttgatttatatttacttgttgatgcactggcatgaaatgtaaaatataagcaataatctggggaaaaggc

SEQ ID NO: 13194 - DNA, 7245 bp, Oryza sativa
catgtattctttgatcaccatatttagttcaatggtatttgagacctgggtgacttaatagcgcaaccttttgtttattgagtattttagtgtatgatatatggattttgagaggcatgaatcaactaatggtacggtaattgcatataaatagcttcggacaccatctgttgttgtgactgatcttgctgttgattgttttgaattccacaaaaaaggaatttacctgcttgtatatctgattgcttacaaggtgtttcttttttctctttgagtttgttctactttgatgtactcatttcctattattacgctgtgtcaaatttaaccaggagctcttcaggatatccttcatttgcatgatgttcttgccagagtttaccttgcaaagctgtgccattcaatttctagggcacgtgtattggatggtgagtgtaatttgtttttgtgcctgtcttaaatcaagatgaacatgtcatgattccagagtgaatgcatttaatcgtggttctggtcaaatttgatttacgcagagagacctgacataaagtcccagtacagttctctcctttaccaacttcttctggacccaagtgacagggtctgttttgaggccatactctgtgtgttgggaaaagttgacaacacagaaaggtactgatgaggtttcaccaatttaaatttctatataactttgtttcttcacttcagttcgacttgtacgtctgtgtttttccatataaattactatatcttgcagcacggaggagagagctggtggatggattaggttaacaagagaaattcttaaattgcctgaggccccttctgtagcatcaaagggtattctgtcaaaatctgaaaaatcttctaaagcaaggcgtcctcagcccctcattaaacttgtaatgagaaggtttgtatcttcattcaaatgttcaaatagtcggtctctctattttgatttccctgtatgttttctcttgttcatggatacctattgttcatttttctcttctgtcagactggagagctcttttcgtagcttctctcgtcctgttcttcatgctgctgcaagagtagtccaggaaatggggaagagtagggccgctgcttattctttaggcgcttatgacgaggctgccaatcttcaatcttattctgataatgtcgagtctcttgattctgatcttaatgagaactcacaacctgaaggtaccatgatattattgtagttttaattattcaattataaatcagcgtgaatcatatgcagcgtaaattttaattttatttaaagtaatggaagatggttccttcaaagcattccttattgggttggctggaaaactaggaaattagcagcctatagatgtaaatacatctcttttagaattaggctggggaatgcatctttctaagcatgaaatttaatttgttgcttacatggttcactagcgtccccttcttttgttggaaatcacactatggggtcctatggtttagtaatattccactttctattaaaatcatgtaactgttcatgttgcagctactcgaaaggctaacccactatcaaatggacatggtggaatggacacaatagcaggcttattagcatcactgatggaagtagtgcggacaactgtagcatgcgagtgtgtatatgttcgagcaatggtcatcaaagctttgatatggatgcaaaatcctcatgagtcttttgaagaattaaaatctattattgcatgtgagctggctgatccggcctggccttcttctctcctgaatgatgtcctattaactctacatgctaggttcaaggtattgtttcaccccattttatgcgttactaccagctgtgtgcctcaaatataggacatatgagtttgaaagcagattgatcgtacaatagtgacttcaagtttccataggttttgatgatttaaaaacagcattttatgaaaaaaaatgaaggcattcttttcccttggacatttgattgtaattttaacaggctactttacttgcaactaattctgtttagactacctttggcattgttttgttctcccattgtttatgtggcccaagtttgttgtgcatacattttgtagctattaatttgattattaataatcttttatcatttgctaaatacatggtgatttattattcgtttgttcttacatgataggcaactcctgatatggccgtgactctgcttgagattgctagaatttttgctaccaaagttcctggcaagatcgatgctgatgtactacaactcctgtggaaggtatatgccttttatcatacattacgattaatgtcatattgaatcaccaaggtttacttcatgaaagagaccccaatttctgtggtcagtttgcaaagctgcaactacttctgtttggatgagacttttttttatacgataaaactatgacaataataacatttgttatctttctagacatgccttgttggagcaggaccagatggaaaacatacagctttggaagctgtgacaatagtccttgatctaccaccacctcagcctggttcaatgtctggatttgcatctgtcgatatggtatctgcctccgatccaaaatcagctatggcactgcaaagattagttcaagctgcggtaagaacaaattctccactaggttaattttttcattgagcatggaatcacactatgttgatgtcttggcccttcggtggatcaacaggtttggtttctaggtgaaaatgcaaattatgctgcttctgaatatgcctgggagtctgcaacacctcctggtactgcactaatgatgcttgatgctgataaaatggttgctgcagctagctctcgcaatcctacgcttgctagtgctttgacacgtctgcaaaggtgtgcattcagcggtagctgggaggtatgcccttctgaaaagctgatggtattgcatcatcttataacactggcatttttcttatctcattgtttacctccgtagatccgtattgctgctgtccaagccctaaccaccattgcaataaggtctggtgaaccttacagactgcagatatatgagtttcttcatgctttagctctagggggtgtacaatcaaacttttcagaattgcagctaagtaatggggaaaaccaaggtgctagtggtactggtcttggatcattgataagcccaatgctcaaggtcctggatgaaatgtatagagctcaagatgatctcgctaggtatgtcacccccaagattccattggactgttgtagatagtactgaactgactactttgtgtgatcatttgcagggatatccgtcagcatgataatagtaagcaagaatggaatgatgatgaacttaagaaactttatgagacccacgagaggcttcttgatttcgtctctttgttctgttttgttccaagggccaagtacttgcctttaggtcctaccaggtatgtgtcaatctttgggggttctaatctcctaaagcagtaaaactattcctggattcaaaaggttaccttattgctacaactgcttaaagttagacctataaaattcactactcaccacacgacgactattcctaggactattaacctattgcttcacagcccatgtcatctgctttcttgtcataccacgaagcattctatcacaaaaggaagagcataatatttagtaatttgataagttacttctagctgtttcttgatcccaaaagggcaattgggtgtaatgggtgtctgccttttgtcctattattctttcatacctcattttccgtgatgcggtattgtgtaactaccctatatttaatatcatgtaatgttgaatctaatctgcagtgcgaaactcattgacatctaccgcaaccggcataacattagtacttcttctggtctaagtgatcctgctgttgctactggcatatctgatctcatgtatgagcccaaagatgtgcccaaagaggccactcttatacagactggaattgaccctgatctggctatggcctgggcagcaggtttggaagatgatgtttgggaaaacaacgcaccagctgtggataaagtatggttttttactttgctttgctgttaattcatacgtttctgcttcctatcaattcatacacgtgcaagttccccttttcctgaattcgagaacaattctttgtatcgtttatgttctttcttcttggatcttatgcaggtaaaggatttccttgctggcgctggaactgatgctcctgatgtggatgatgaggaatacatgaattctaggccatcagtcggttatgatgatatgtgggccaagacaattcttgaaacatatgaagcagaggcaagtgctaaagcattatcgagctactccctcattcccactcactaaggcgcggttaaacttgacacagtcttcaaaattaatctttaactttaaatttctcatatattataatgtttgtagcaacaaaatcataatcatatgaaagaaaattgaaatgacattccaataatattattttcatcaaataaaatttaatttataataaactatttattggtcaaatatttagagagttgaatcttaaaatgcgtgcgcgccttagtgagtaggacggagggagtacctgatttcagatgttttgaattgatagaaagtatcaaaataattcaatttgtttttatatgttgcaggatgatgatggaagatcatctgggggatcctctcctgagtcaactggttctgtagaaacatccatatcgtcccattttagtggcatgaactatccgtcgttgttcagttcaaaaccatcaggatatggggcttcacaacaaacggtattcttttacttagtctttttagtgttaaagtgatctccattattgggtttcacacttaataactgttggaaaataacgtactgaaaacctatgaaatcaaatgtatgcatgctgagatgggcatatttaatttaattaaactttaaataagaaaacaaaagcttttacttattcaccatctggaaatcaagtcaccgaacagcaaacttagctattgatgtaggaacctcgctgctgcttcataacaatagatttccagatggcatcatttgcttaaagagcatcggtttgcgttttgtttcagatacgtgaagaaccaccatcatattcaacatcagttctacagaaacgtgagtcattcgaaaacccccttgctgggcgtggtggtcggagttttggatcccatgaggacgaagacaggagttcagggaaccctcaatctgggaaagcactgtatgacttcacagcaggtggcgatgatgaggtatggaggctgaaattgtcttggttggctataacgtaacatcctgagcttcaatgcttccttgatcagagcttgataggcattagctgttgtgaaacatagttatttcagtgaagcgaacctcgtgcttttcatttgttacaagaacttaatatcttaattaattgagatagctttttaaatttatgatttgataagcgagttctgtagtaaaagagaagaccaaatgaaagcacaagtaaattatttgaagtgattaagctggctcttatttcttgtcttggaatgcacacaaaagaaagtttatccatgtaaatttctttcagttgagtttaactgctggagaagatgtggaaatcgaatatgaggtcgatggttggtactatgtaagttctcttctcactttctagtttttcttgttctttagtcatgcgcaaaaacattttaatattggttattattgctgtatcttcaggtaaagaagaagagacccggaagggatggaaagacagcaggtctggtccctgttctgtatgtgaattcgtgatagctatgagtcctgtgacataatgctctcgaaagctgattcggagtaaacgggcatacatatggcgtctggggaggttccttctgtgatcttagtagtgcacataaccttttttgagctccctagcatttgacaggcacatgtccttgttggaggccaaattcaatcatcgtgatgtctgtaagacgcagcaattttcttgctggttgtgtttctttgctttatacacaccacgagtccattcaattcattgtttatgtgtagagatgtacacgtgcttcggggttttacctttcgtgtgctattctggcccgtctgttatgattgaaagacgcagtttactcctctagttctccatcagataggcattattttgtcaaattgttgctctattggaggctgtaaactgctgaaggctgtatcttgctccccaccattatttcggtcttgtttatggtgattcagtagaagtagtaggcctgttaatttgtgtaaattttgtcttgtgcggagtatacatacatgaacacatacgacaatggaatggtatgcgtcgataactttcttactctgaacacttaatgcagtatacgctatattctggctatttttatggttttcgattcctgtatgaattgattgttgtgaaattcctggatcacagtttcaaaatgagggctaacatcccgtaattttgttttatagtacttgactacttgtacagttgtactaaagtcggtactcggtagcaacacaaacaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttaatgccacttgtagaaagtgaatttgtttcttcaaattgtgactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaa

SEQ ID NO: 13195 - DNA, 10174 bp, Oryza sativa
tgtaaatcgatcggcgactataaatagataataaagaactaaacctactcgatcggctgtagatattaccaatatatagttcttatatcgatatatatttaaatcaagtgattgagatagatcggtcgccatgccaagacagttaaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaaaatggaagcactaatcccgagaatacaagccgtcataacaagttttacctcttgttgaagatcaaaaccgatgcagctcaacccgaaagtaagaactcgtcgaaataaaactaaagcaaaaaggtggcgatgcgccgaaattgtattgaacgtgtgtgtgttttttattacatagggctcggggtctatttatacccgagaattataagatatgtccataccggacacgactattatctctaacaaactctaagataccataagtctttgcggcagacttttgccctaaacatatctctaaggaaattacataaaacatcctaattaatagatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatggtcggcgcgtcggtcgctcgcctttctctactcgatggtatggcttatcctagttcgcgcgcatggctttgattttgtgctggatgttgcagccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgtacgtacggctggtttccctttctcctcctctgctgatctttgtgtcgcggtagggttgtgtgtgattcgtccgggggattgcaggaggggcgggtggtcgggggcgctgaacaaggtggagcactacggggtccagagggtcacgggtgatggccggtgcatgtttcgggcgttggtacgtcttgtcctgttcaattgcgcattgggaatttctctggattctcaaggaaaccctggtgtgtctcctcgtaggtgaaaggaatggcaaagaacaaggggattccattgacctcaagggaggaggtacaagatgcaggtaacctgcaattatgctttgttcatggataaatattcacagttgtttgagacagcctgtgcagctgagctatctctagagctttgaatttacatttacgaaagtaactgcaatagctctgaggaaagtatatttaggctgtgttcgtttgtgtgagatagggtgagaaaacaccttgttttccgcgcgcacgcttcccaaactactaaatgatgcgttttttgcaaaaattttctataggaaagttgctttaaaaaatcatattaatccatttttgaaatttaaaatagtttatactcaattaatcatgcgctaatggctcatctcgttttgcgtatcttcccaatcttctcaatcccctatctctcaaactcacccttagatgctaccgtaatcttttgatacataaatcattttttaaaattttattttgttcagcgcactcctacaacttaaataatgcttattcagaaaacagaacatccactacaaaaaggagggaaaacttgtcaacacaaggcatataaagagagagctcctattattcttgtgagattcgagtagcccacttgtccatcaattgcataaattagactgcattgcagttcttatctttggcttcaaaacaactttgttaaagcatgcattaatttaggatttccatattgttcgttccatggcagaagttttaacttctgaccgtaacttatgtaggaaattaacctagctactgtttgaaacatcaagttagttaggcataatttgctgccaccactgttcagacatttcttgttggcacctcaagaggtcattgttttggtcgaagaatgtctagaacagaattcttgcatttaagaatgcatgtttcctaccagtttcgtctcagtaaaactgtcattgctgaaactgtctcagtaaaatgttccctaccagtttccatgttcccttaccagtaataccacccccctatgtgccactttcgcatatgtgacttgtgacgtgacaaaaagataaatctggagtggcaaaaaattaaatgttccgttatccagggggcatttaaattttttccactctgcaccaaacgagtttaatccctctcacaacatcccctcttacaaagtggcaaattcccagtatatcctctctacccagcagccttgtcaagtatgacttttcatgagcaacttcactctccaaataaacttatgacactacccatctttcacctaatgagctgaagattttgcgcacagatttccattgaagttcgaagtttgaagatgatatattattttaatatacttttgtgttgatatcctttttcaatttcctagatgatttacggatggcagtaaaagaagttatctgcgatgatgagactgaacgacaaaaatatgaagaggcagttatagcaattactgtggatgaatcattgaggcggttagattcttatgtcctcaattcatttttatggcatgacctgtgataaagaggctgactatcctggttttgcagctactgccatagaataaggcgatctgatttctggggtggagagtcagaactcttggtatagttttcataattctaaagttagcatgcactattaatataaacagcaaccatacatcatttagacatatagaacacctgtttctagtatatgtatcatactctaaaaaaagtatgtgcaccatgtttatgcatcgctccttaagtgtgccaaaaaatataatattgtttgatcgtttcgctctgaagattctaccaaaagtaggtttacctgtttctagggatgaaactggttcggatagtttccgtccatccgaaccatttttcggattcggatagtttcggtcggaattattcagaaattttcggattcggaaacgaattcggatattttttctcggaaacgaaaacgaatacagtaagggtactatccgtcggaatcggaaaacgctcggaaactatccggatttttttttcggatatccgcagacattgagcaaattttagaaaaaacacgtatatatttataactttttcatacggaatcagatgaagacaaactttatatcaacattgtagagctcgatgagatctacaactttattattgactattttattatttgaggtcatttaaaggtctaaatattcattataatataccatattaatttttacaaaatctcggatctacaattcaaacgacatctgatggagatgtgttccatatcaaaattgtagagctcaacggatctaccactttgtagtttataacatttgtatttgaaagcatttaaagtataatacaaacattacaagtttcgaagatgtgaagtaaaataaataacatctccaatttatacactggtaagtaagttatacatctagtaaaaggtcttgggaatagaaaatgataatcatatttgcatatggatctcttaaaggaacagccatgaaaatcgattttcacatacagttgtgggaccgtatacaaaattgatgatataaatgttggagatgttgaactaaaataataagcgatatctcttcctttatcaagaacctcaatttgaggggttttttatataccggtaaatatttgctaccgtattcgttccgtctcgtattcgctccgtatctgtattcgataatatccgatttcatttccgtatccgagtttttgattccgattccgaaaaaaaaatatgaaaacgaatatgataaagctagtttccgtccgtttccgatccgttttcatccctacctgtttcatagtagagtgtaagggcatctcttgctttgtatcagtacatatggtcgtttcatacaaatctattctacatctgacatattgatgtttcaggttttgtctaaattgtgtcggcagccaatcattatttatattccagagcgtgaggtaagcctctatatacatggataacacatatacatgaatgtgtgacccaaaaatgtaaacatgttgtgaattgtgccttaaagaagagagtatttctaattaaatctatctctagatggttgcaaaataaatgttgttttggacattaatatgagaccataaccagcatttcaaagagacagttggcatatcgttgaaggcaaaatgggtgtcaaaccatgaattcgtactgtttctaatagactttattgcaagagaaaaaatagacaccagatattggtagaccaattaattttaggaccttccgtcaccatgcaaattagatctgggaatgttaaagtaccgagaagacagctagaataggcaatgtgccaaggtttacttgtgcttcatgatgaatggttgagagtgagatgatctgctaaagtgattccaaacatctggatttcattctatatttctgttatcttgttgtaatgctctgaatcctaagaggttcagaatttagatattttttaggttcagaggaaaaaaaattacagaacataggaatgcatttgcaactgatggatggaacttaatgaaaatatagtgaacgtctgaatgcttctctttgcatttttcttgcttataactgacccatcctccagtttggagttgctagttggatgtactcattgcactattgtctgtttccttgcaaacaatcttatgttgcttttctttcatagctagcctttacaatcccccatttcagctgctcgacttacatctttcctgtttgtgtaacagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagagttattagcttttcttggtcttggtgtacctataaaatatgtagatcaatttggaatggagggagtatatagctaactgttctacctaggaaaaccacatatatatagtagaaaactgaaaactaccgttggatcaaaaaataaatgtctgagatttgtccacgtcattatgagtaaatctgcaagtaaaatttttactcgcgatgacttggacaaatctaatatgtctattttttaccaatggtactacatatgtggtttccaccgtatattttcccgttctaccgtatgaaatccattggttccatcttatctgaaaaacttccatgactaaaatgacactaaacctaataatgtcgcatgagctaattacttcctctgtctaagaatataatagcaacctagcaaataattagacacaacctagtacaattaatctggaccggagagggttagtacattattctcctaagttactatatatattttaagacaaaggagtaggttgttatattttaggacggataaagcaggacaccaggtgataggctagtgaggtcatttggcatctaggctaaggttgttccccatcctagtgatgccattcggcatttaggctaatgctgttcgcagttcgcctgtgattcggttggcgtcacgccgtcaagctgttgaccgtatttccggttggtgccgggcatcgtaataatggcgtgttcgtcggactcggtggttgccaggggcaaagacgatgagaggacatgcttcaaatcctattcttgtgtcgttgcaagcctggttgaccggaatcatgttcttgttggatgagctgtgcgatgcatctactcctatatcttgccatatgttttgttgaacagcaacagcgaatgttttttcccctttgaagcttggttcgtttaatcctaagagaaaaggattgagagaaaataatttcacactacaatacatatgaaataaattatttccaaatccccttcaattctcttgaggaagggattaattgaacaaggcttgaatggggtaattcttttgttgaatcctacattcctattatatctattattctctttgctaaagtattggggaaaaaggttacatttttaaattggttgcaacatattaaaaaaaacgtcacgctatgcttgccaagttatgatccagtggacgaatggtgatgcccaccagcagatcgtacgttcctgacccaaatcacgcttaaaagcaagagttgctaaaacgagccgtaggtgtaacacaggtgtcattggagtaaatgatgcattgataccttgtccgtttgctaagctaagctagagctggccacaggccactgccgtgccaatgctactcgcctgctgtgatgggcccacaattcagcg

SEQ ID NO: 13196 - DNA, 17987 bp, Oryza sativa
  unsure (1)..(17987): unsure at all n locations
ccatgtggaccccctcgtctccgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgttcagcgcgggaggagatcagatcgggttcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctccgtatgtcccctcctcctccctgatcgcgcgcatatatgctttttcttttttctttcgcttcctacctgttcttttgttctggaggtgaaaaaaaaaagcagaagagggaaaaagacgtttttatggccgggggaaaagtaaagatggatctgtaggatagtgcaatctgtaatgtcgcaagcagtagtagtagatctgtggattgatgtcgtgaatggatctggtgcttgggttttcctgctcgaatttcgtgtttgagagatcatggttttgtccgtttcacatctgctgacttggtaaaagaggatcatgagaaaagtcggcttttgattaatcagttaggagtagtcgtgcttgttcaggcaaagatttgcgtcagtctgacaatcgttctggttatctcgctttgcgattttacagcttggcaactactcctcgattgaaggagtgccatactgcaagccccatttcgagcaactgttcaaggagaccgggagctacaacaagagcttccaatcacgtaggctactattgaattccaaaattgcgaacattgacaacctgtttattttgttgataaaatgtgttatgaattctgatgctctggccctgcttatttgttcaattttatgcagccgcgaaacccgcatcggagaagttgactcctgagctggtgagtgccattggctgcatgcattgcttgtctgttttcattccaaagtacttctatgtttctatgtgatgctacctcgcttttcaactaattttgtctgaaacattcatttcagacaagatcacctagcaaagccgcacgcatgttttcagggacacagagaagtgtgccacttgcagtaaaacagcgtatcctctagagaaggtaatgccccataatttctgctcttttcatcttagtttcatactgtagtgttgttaggtcatttcttccaaaattgcattgttagatgttgaaatagggatgaatgatcagagggatcttttaggtacattattccgcctaattgtattgttctactgtaacaagttgtaaggttctgccttgattgtacttatttaccaagaatttatttcaattatgctcctcaagtctttggaacatgcagtggttgtgatgataagcttttatttgcaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactgatataccgtactctattttgttgattgctttttgagcgtgtgtttatctgttcagtcgtcttgctctcttttttttttttttgggggggggggggggggggntnnnttntnnntnnnnttggtntgccgtgctngcgatcttgatngcgttggttgagctcggttcggtttgtttgccccgtgcattatctccgtttttctttttgacattttggcggctgtcatgcaaaattgcgcaagaaattagactatttcgtttaatatcaaaattggccacatttgagtattactttttgttccgcgactgcatggcaaaaagaaagatataaatatacagaaatacttctgaaaatctactgacatgattttcattttttttccatacgttaacacacgaagtttaagaacctctcttaactgctagcgttccaaagcaagaaaaggacaaaccgcatttaaaacaaactccatgttattttcaaggaccaattaatttgcatatgtgagtgcattcgatgatcatgtttacgctacctccaattttgttgaaatgtgtgatagtagcttaaggaggtagcaggacccaaagtgggtgtgcgtatccacaagtgcgtgtaattgtgttcaccttgtactaggggaaaaaaaaagaagagcaagacggtatggggtaaactgagaagaaaaaacggagaaaacctctatttcttaaaatccctttctcaactcattttactcacgtccatgctcaccacaaagaaatgaattcgcagtcaaacatcactaaaataggtaatgctccgcaagttcatccactacacctacggaaaaaaaaaatgtggtgcccaaatgcccaataatacaaactgttcccctcccgtttctttggctgtcctgttccatgctctttgccgagccagaacaaaacacaattgagcaagccaaccatggaaagctcagcacattaaggcaggtcaagatggaacctgcacctcatgtacctacgctgtaagtcagcttgtgcttgcggtggttctccaattttcccctgcataaacaccgtcacttccaagttcttcctctattctaagcagctgcagagaagatgagcacgataatcagaaaccatcccatcgacaacaaaaggctattgtactatgacttatcaatttctatagcagatgccggtgtgcaaatatgtgaatggtaatggtatatttcaaaaccataaaagttgctttggcatgattttaactaacccaaaaaacaaacctgattgtatttactgagacattctccacggcaaggagcacccgcttttatttgttcaacaacagcacccacagcccagtcagcaatgaaagattcatcagtgtcccgggacctatgtgacaccattacgccccaatgagcatcctttgcctgtctcacaacctttatggcttccgtgacagtgcctacttgattagcctgcatatcatacacaagcacaattcaggtatatactaaatgacctttgaggttgagagagaaatcagtgatcaaggaagattccagaaaataaatacttcatactctatttgcatgcaaatatcgtttgcacctctatgtctacaacatgctaaaagttaaaaagtaaattcctccagtggatagttaatcttgaattattatcatattaatttatgtaaatgcctattcaagtactaaatgccaaacgtgtgaattgactatttgtatgctagcctattaacgattggttttcattgcattgtttgtaaatgccttagaaatcaactcatatgacacaaaacttgaactataatcaacactggaatggcagtgtcacttaaataagattcaaagggagcactgagcgtcccggcacaaagatgacaacaactattaatatagtaatattaattccaaatctttctttcagatggtattaatcttggatagttccaataatacgagtaagatgttgcacaaagtagctctaatcagtttcggtgcattaaaaatagaagtataacttatacttcaccttgagaacaagagcattgcaggtatactcatttactgcccgcttaatgcgttcgggatctgacatcaataagtcatcacctacaacctgaacaaatgttatgtcatgagatactgaacaagaagaataaaagctcaaaagaacatattagccacctggcacagctctagggtggtaaacttcttcgaatgctcccagtcatctttatcaaagggctgttcgattgagacaagtgggtactctagcgtataataaagaaaaggggaaatataagcctcatgaatgaaatcaaaagatgtaacaaaaagattttaatccagacatgtgatacctgaacaaagctggctataaatctcaatcaaatcatctgcagttttgaagccctgccctgatttctctgcaaacttgaactccatgtcatacttatttcctgcacaaaatgcatgaatatagccagaaatttaggtcatcgatatatcaaaacaaactaaccatagcatacaacacattctaattgctgttcaagttctctgcttctatggttcaaagttgtacggttaatataagccattaggttgacggctgaccagcaatactgaatggcataattccactgatgacacaaagaagaatgaatactaggtggccatgaaaaatagtactccctccgtcccaaaatataacaatttttaccacttaggatttgttccaaaatataacaacttctccaccaacattcccttcccaaccaatcacaaccccttcctattcaattttacctactttcttaataaccgtgcccaactctaaaactctctatattctgggatagagggagtaaaatcaagagatgacacaagaagagtgaacagaaatgccataggtacataagctgaaaaacatggaaataatgaaaaatgagttatcaacagagtcatggattttctcaaataataaggaactctttctttaatgcatgagagatcagcagagagcttgtattcgatcaatcagatatcattcacatgattctttatttgatcaagggaactgcatattaaacaatcacacaaccaatacccaagaaatcactctttctatccttacccatgcaaaaatcggtagcggcgacatcaattgctagcttgatccttccattatatccagctctatttattgcctcaatgacaagatccaagccttcggttatgctgaacattgacccaacggatacggcacattgatatcaatatgcaggtgaccaaaagggaaacaataatagaaccacaaaaaggtacagacgattccttacttgcctggaaatatttggagcaaatccaccatcatcacctatgttgcagctgtttgaaccatatttctccaagatgatatcctatcaaatcaattggtaagaagctattcacgaagatagtaagcttctcttcgcactataaaaacaaaattttggaacatctgaaagaataaatttatctaaggaggaatccacccaaacaaattaacactaatcagagtggacagaaagctgaaaagggcatcaaaagcagaatacaatgccagttaagttttgtggacagaatcttaaactatttgaataacaggttggtcaacatatcagagtggagcagatgcatgccatgggaaggtaggcccagcatgcaagttatagtagtctagtgatagtaccttcagatgatgatatgtctcagaacccatctgcattgcttcttcaaagtttttggcaccaacaggaaggatcataatttcctataaagaagcaactttacttgcaggtctcaaaaaaaatatatgacaacatagcaagatgttgatctacctggactatcttaacatgttcccagagaaaaagaaaacttcaaacaatgaaagaaacatgggaataacaaatttaaactttgcagatttcttaatggaatctgcagaaaagagtgatccagtaatttgcagagaaatgttggctaagaaaggtaattctacaggtttagtgagaatacttgaatagggagactgtttccagcatgtgttcctccattaatgactgtaattgcagggatgggaagtgtcgtagcgcttttcccaacaagttctgctatatgcttgtacaatggaacctgcacagaaataagcaaccaactataagaatgcattgccatatccaacaccttcttttaacccagaaccgtggtgattttatacagaactattacctctttttcagcagcacctgctttacaagctgcaattgatacagccaacatagaattcactccaatctcagcctacatgatgcagtgtcaatagttattaaagcaggacaattacaagcgatagaagctgtactgagctggctgctacaaagttaggcttgacagtaaagtgagatggtagtaaagaggagtagacattaaaaaaaaattatagaaaacaacacatcaattattttcatcattaaatctacatggaacaaaccaatgttaagaactgtcatgtggctgattatacagatcgatcgactgtttgtggtaaagcacaacccttgaataatctctcattataactctcatcaaatagagctcagcaatgtaggatcaggttaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcgcggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggctgaggctgcggcggtggcggcggcgtcccgcgctgctcctcctctcgccacgcttcccccctctctctggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccgacgatgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctaggcatcgccggcgtgccgcgtgcgcgacggagaggagcacggcggggttttcgctttggcctggtttgtctgtcgtgaaggagcaaataaaatcgggtccggttgagtccagtgtgtgtccgtgtctgtcttgaacagtcgtgtgtcgcgtcgtgtcactgggtcagtgtgttgttccagtgcgccgttcatcagccgatcagcgtctgtaccggtcttttgcaactagttaagtgatgaatactataatctgttaatacgtgatctgtctgatgcattctgtgctttaatttgattgagtttgggtattactacctgacaagattagaaaccatacaagcacctttcgaatttcgtaactctcactggcggatttaacccctctagccgccaatgctcgttgccgaaaacctaaagtttttttatatgttttcaatgattgaagagtttttctttagcaatatatagaattctgttttttttcaatgatttaaaaatagtttttctttagtaaatgctctatatagctagaggctaggtttgggttggactttttctgtatctatctaagattatggtagcttgcagtgactttagaatattactctctctgttccttaatatagggcgtggctgttgtagttgcaaagaccaataaaaccgtttaaatatcagttacgctgattaattctctctgttcgaagagcgacgtttaggtagttgcgcggtagatacgctagcattaaccatcatgcagcgtgcgctcgacctgtactttccgcgcgaatagccagcatgcatgcagatgcatttttgctagcgtgctttgctcgcctggcataacgccatgtatggattgttttgattcaaaaatttggaaagccccatgcatgcatgcttgatcgaaaatttggatggcgccatcagcgataaaaaatgaatagaaaattttcacttggcgccactatttgccagcaaaattttctcctataaatatgggcaatgcaccacacatttttttccatctctcttctttcctcccatggttcaacgtacgtaatggctggttttgatctaaatctacccatcatcaattgggacgaagttgaggatttcgatggagatatatctgatttgaactatgactttgtttgggattatgacaatgaaggtgttcataggagcttcttctcttgctttgtcttcttttttttcttgtgcatgtgtgactataattttgtttcaacgcacagatggtgaagatggcaatggccgcggcagtggcaacgacggtggctgcgacggcagcgacgacgatggcggcggcagcggcggcggcggcgatgacgacggtggtggcgacgacggcggcggtggcggcgatcaaaccaccgatggagcagtcgatgcaggtaatacacgttcattttctttttgttgctgtgtctttttgctgcacgagttgaaggcctttgcatgtacacatgcacagtgccatgcttaagcaaactagccgatgcatgccaaccatagtatagcctgcacgttctcagccatcatccaccatgcatgtgtaggtatcaatatcaagaggaggagacactaccctcctgatatgaaacgagccatatatgcattgtgtttggagagatcggatcctggtatgatgaaggagggagtgacaaagtcagttgctactgatatgggggttccatggagagttgttcagcatgtatggcgacatggacaaattggaggtggaattgaagctttcgaatcgaagaagaagaataactgtggccgcaagaaactttcttttaaccctgatgccatcaaagatgtaccgcttaggcaacgccgaacactccgtgacctagctaacgctttgcatatgtcaaaaaccacattgtttaggcgtttgaaggaaggaaggtttaggcgccatacaaatgccataaagttcaccttgaccgaagataacatgaaggcctgtgtgcaattttgcatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggatttttcccttcacttactgggaggcagccaagaggagtagtcgcagtagggagaggggtaagttgtttaattatgcttagttactccacatatgacaactctactaattttgtttaattgcatgatttaatacaggaaccatggagctcaaggccatgacatctgtcacgagggacattatccggaactatctcattgaaaaggttttgccggccatcaaacataaatggcctaatgaggaacgaggacttccaatattcatccaacaagacaatgcaaagacccatattgcagttgatgatcctgcatttttaagtgttgcacaagaagatgggtgggatatacgacttacatgtcaaccaccaaactctccagatcttaatgttttggatttaggtttttttgcagcattgcagtcattgtttcagaagtcatctccatcaaacatcgaagaaattgagacaaatgtgatcaaagcatatgaagaatatccggcgaatagatcgaatcatgtgtttcttactctacaagggtgcatgagagagattatgcttgcaaaagaagggcagcactatgcaatcccgcatatgaagaagagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcactgattatacctctagtgaatcagttgtttttttcctcggcgttagtctcctctagtgaatctgcaacaaatgtgttgttggccagtgagtcaacaacgtacccaatgttgtcagagtcagtgaaacgatcggcgccggccagtgagtcgaccacgctgccctctcggattccggcatcccctgccttctctccgttgtcacccttgccgtcgtcggtgtgcaacagcgaacgagctctgcttgcgctcgcagccgcatgcgaagggcatgcacacggagcgtacgagcatgcgcgacatccatctgcgcctcctgccgcatgcggacggcggcgtcgcggagcactcggacacggccaagctccacttgagcacgacgtcgcatgagcacggcgtggagacgagtgatcgcgcgcggccgaactccacctgcgcctgctgccgcatgagtcgtgtagatgcaatcttctcctctgtcgtcgccatcgtcggcatatgaagtgtgagcagtgtcacagaggggcggtgtgtgcagtgagagagagagaggaagcagtgagagcgagagagagagaggggccaggagctgagcttttaaaagccaaaccgagtcatcagttaattctctgcatgcatctgcatgcatcagtacaggagccgaggagtactcatcaattcctgcatgcaccgaggagttgccaccctatattatggaatccaattgaaaagaagttacgccctatattaaggaacggagggagtacgactgtagtataaatggatgcttaacaaggttagaattgcctaaatatagtctctgatgatcattttctatgtttttaagataaacggttaaaatagaagcagaaactaggagtgtttatgctagagctccagtttacacgttggttaaaaaatgtaaataaatagtacgagtgcaaaatgtaaacaaagtctctacttttggttaaaaaaagtatgagttcttatgcagggacttcagtttacaggtttttatatatataaaaaaaaccaacgagacaatgaccacacctcaattagggatagtacagtcaaaaagataaacatgaagtgtagtaaattcaacacctaaatacactaagctatcaggcggtcaggcctaaagcaaagataacaaaagtactagagagtactgtagggatgtcagcccactcttcatgatttcagccatcagggcctttaggagctgttgttaagtatgatgcagaaggttcctccgttgtagaagaaatcacgagaggtgttcataattttgttcctaaaaatcatatcattcctaacattggaaaggtcccaacaagccttcgcaagtaaacctaatatttgctttttcaataatttaacatccccaatgtttggcttagttgtgaaataagtcaaacatcatattgcaaaccagaagtaatttgttaataaaacttttatatacgtgttcttagcgacttaaaagcgaaggccgaaaaatatagtccgatattaaaaaaaaaacctaaaatcagcttcaaatttaaaattaaaaaaagaatcaaattttgactgataagtataagtatagatgaaaagatgagacgttttcctttaataactacttaatatagttagaattgtctgggctattttttttatctaccaactctgtgtttattacttgtgcatttaaaacccacacagaaaagccctcacaatgtggcactagttttagttaacttgtttcactgatgaattagcaaagcttagttaacaaaaactaagcccctaagcaagtacgctcatcgactcattatctagtaaccctacgcacatgagtgtttagttgagtgataaactttgtcatgcttggaccattcctttgactagtattcggctacaactgtagtgtgtcacactttcttttaaaagaaaggtcttgttcgatagccctaaactatagcgttttttgctgtgcaggactgtgctgcacagcccagccgaacggctacattcggcaatctgctgtatcatgtgaagctcaaccgaattgctacagccggccatctgttgtatcatgtgaagcgtgtcccaccgcaattggccaacagttataactgttatttgcagtgctgcagctgctaggcctaccgaacatgttgaaattaggcccacttgttattggtggttactaacaattattttaaggattatatttgaaacaataggaagtaatgtatacaaatattatatttatggtgtgccatatttttaaaagaaattaggcccactctctcctaggtggttgctaataattatttcaaggatattatttgaaaacataggaattaatgtatataaatattttatttgtcaaacaggtacactcatttagccaatatcataaaaggaatgttatacatgcgtcattatttacaacaaattccaaaatgatacctagtgggaatatgtgctaagggccaacatattataaaaagggccccattgccctcttcccctcatccaactccatcgccctggcgtgcaaccaagttgcatattccccttgctctccttgtcatccctctcaataaggcaacgccggatgtagatctagaagcggaggacctcaattgagcgcaagctattctagatctgaacaacgtaagtactctatttgggttttatcttttccttctccctctgtgttgtagtggatctagatctagggttcgttctatttggtgacattatccttcctcatggtgacgcaccctaatctaagggagcatcacaagtgaaatggtgtgtgctaaacaacacgatggtcgtcggttggtgatagtgaaatcgatgatgacaaaggtggggaagactaagagaggttttgtaggtgggttaaattgcatgttttgtctatttgatttatgcaatgcaagtagacaaccatttgaatgttaatttcacccccaagtgcttttgggtagttccggttgttagtcctcttcggaccatcctggtcattttgcacaacagtataagtgagccttttctattatacgtgtattcgttaatcttcaagtgcgctatttgattcaaaattgttacacccccaaatcgtttaggttcgatttcaaacatccttttgaaatagcacaaaaaaattgctactaatgcacatatgcctaagtaattacacattaccttttgctttaaaaaaactttacatttgagtcatttgagtcagactttaaccttttccattcagccttgagtgctgatggttatggcggactagtagccatagaccatagctgaccaatacatgcaagatatttctagctatacggaggatagacatccgaattatccattcactcgatatttcaagtataatatatagtttatatttaaacttatgttagggaacaaaccaaaatgctcaagtgcccgattcacgaaaatattattcgtagtggttgtgtgtggatcatgagttcatcacctatttgccattctttgtgatctctgaaagcttgagccaccatggccttatgcggctgtgatctcatccctcgtgtgaccccttatgctcttgcagtctagcccagtgcgtcgcttgccaatcctcaagcttcattgaatgcaaaagagggctttgtgaactccaaagttgtgcttcctccacgcctttaattctcaaacacaacttccatatggttggtggcaccacagagtgattggttttgtgcatcgcacatatggctgtggcatagtgttgacaaaaaaaaatcgaacacactggcctgggagatctgcttagctcctgtacaggtctaaaaattgatgagatgtgggcgtgccagtcagtttgatcctgcaactgacaagatatgcaaatagtagatcaaaacagccgatcaactgacaagccgatggagtagttccagccgatagccgataacagccgatgccgataccagccgatagagatagggtttaagcaatcggctatatgtccaatgtagataatgatataaaggcaatcggctgatgatgctataataaaataacaatatagtcatgtataaaccaatcggttagcaatgatatgataaataagcatcgatccgagggttaaagcacacatcggctggaggtccgatatcatgaaatccataagattagattaaacagtgaaacctttgttgtcatcggctaaatccaacttatatgtatatgcaatccttatgagccgatgcaacatccagataactcaccagctgaaaccccgatgaaacccttattggcaatcaagaggcaggctagagattatggttctaagcacgacttagtagatcaaacttaactgatacaacactaagtatgaaaagaaacacaatatctagacaatcaagccgatgactgattttcagggtggtagatgtctaagctaaactaatctagcaatgcgatttagccaataccggcagaaaccctaaaacgagaagcagccgatagagctaaattgatatgctaagactatattaacagagacatatgataaataggtaggcaaatatatcattcaaaccagatcaatccaagaggtcgaatgtactgatgcagccttgaatgacgccgacgtagacgatacaattgcctggaccgacggaacattggacttatcccttcgccagagatcgaagacgatgcagcctcgcgtcgggtgccaagtttcgccggaacgtaaaaacaaaagtagaaataaaaagggtggcgatgcgccgaattgtattgatcgtggagatagattacatagaccccgggtgtacatatttatacccataggttgatacaattccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaattcgactattggcgacttgataactcccatcagctgattccgagatgctgcaaccgataatgattctaagccgatgacgtctttgccgattaccaaattttactgttaacacatagggctccttgtgtcgtgtgtgcatgtctctcatcagctctgagctatgcggtgataatgttgccttgctactgcgcggccacttaacaaccataggccggtctcatcccacaacatgcttgatggatggggtggccaggtgtacaccggggtactggcccttacacctaatatctgaaaatctagtaagtgggtccggggtctagtttctggtcactttcctaatagtggaaaatttattaaaaaaaatgtggtaacttctatacctaattttaaatgattccttgaccttctttgaaaaaatgtaacctttgaacctccaatcaaataccaactttcactgcactatgttgttgcattttctactggtttccttactcctccgacccttaagtgtttactaaatgtttatgcagttgaagcaactatggtggagaatcatgtgtcaaaagaggattcaaagaattataaattgaggatgggctttgtggtaaaaaaaatccatcttcttaaatatccttgttgtggtacttgtcgttagtttccggacaaataaaaaggcatatgttagaagaaaaataatattttgtttgagccttgatcagatatagatctggtgttttatgacgcgattagttgattcctacctttagttgcacgaaagagttagcttgccgattttgcatatagaatcttctccgtggcatatcagctctaaattgtaaatctattttcatccaatataacaaaacttacattctttatgcaggatggccatatttgtgcaatttgtgatgatggtggtaatttgatacggtatgcctattctttgtctagttatcctatttctttttcatatatttgtttagttgtactatttttcccctttgttattgttctcttatttaaggcactaaaccgatagtgtggattgtacttgatagggtgatggataaaattaatactagagttgttttactgtctaaggcattgtagtttaggctcactggacaatggattggaacgggctgcagga

SEQ ID NO: 13197 - DNA, 9635 bp, Oryza sativa
tgctgaacatagatattggaagcttaactttttttgtggcaaaaataacaaatggtgatatttctgaatacccctgtgccctatttttcccaccgcgggagttatttccaaaattcttaaagtattgggttttattaaggttcttatggtaaaataccggtggaaggtttttaaggttaacccgattctggtcctgaccgccaatattttatgaccggaccgagtcctaggtaaacatttttcccatatgccataattctggtaaatttgggctgcaaaaggctcaaggtttttgctttttattgtactaaaactatcagggtaaagcgctttatgcgttcaatttattttaatattatgatacttgattattgtagctgtgagggtgcctgtcgaaggtatttccaccgaaccatttccaatgatgcagattttaactgtgaaactctcaacatgagtcaagaacaagtggtaagtgcatattcctttgcctcttcaacttattcttgtttaagtattccagtattgccatttaccattaatatttttcaacaatataggaatcatcaaagttcatatgcaagaactgtgtgtataagcaacaccaatgctttggttgtggagagttgggatcctctgacatgtcatcgggttcagctgaggtatgtataagaaaaagaaactttgtatgtccttgggatacttcctcttgtatttggtatttccttgatttatcattttgtttttcaattttcttatggaattgaattaaggcactgcttgaaagcaatttttagggatggctaggagtcaatgataactttgaggaatctgagagcgatactttggaattgtatacacattaaagttcaagaactttttttttgtatgtgctcgtcagcataaaccaatttcctttaaattccaacttttccttcactttttgttaggtatatcagtgcagtaagagcagatgcagacgcttttaccatcctaagtgtcttgctgaatttgactctagtaagaacccaccagtttttgaatgccccctgcatgaatgctttgcatgcaagaacaaaggggaaaaatataacgaggaaacatgcaagaacaaggggcaggagagtatcaagaaaaaacaaggggcggaaacaacaagaaaatgcacctggcattatgcaggcgatgtccaatagcataccatcgcaagtgcttgcccaggtgtgatatgtatttggcactatttgctagtgatagtgcccttctaaaaggatattttgttgacacggtgttctcttttttaggaatatttcctctgttcccaaaggttgtcttccaaggaaatggaaaactaataagggccaagttttcttctattgcctgtaagctttttgcacttcatcctttttgttagcatatgttctccatctccactatattcgtggaacttattattcacatagaactttttcagaaagcatacgatggtagaacatctcagaagtgcaacaagggatcacctcaaatttccaaaagttatggaagagcacatgcagaagtatgttcccaaaagagaagttgaaaacaaaaaacttattgtttatgttaggaaacgacatagaggtgcatctaagaaacaaggagcttccatggtggaagaagttgatcatgggaccatggaaagtgatcatgttcagagaagtagagatattaatctgcgagcacatgaacaaaccgaagcacctcgaaactatatgtctgaccgtaacacaagcactggtttcgtgttgtcttttgcacctaagtccttgttcccactcccatatccaggcaattgtggttggcttgatgattgattcatgatagtatttcagaaagaaaactgaagatttttaagtttcatgtatggcagataactttgtctgtagcatgtaacaccgttgtgttgatgttcgtgatggtagttaattactggtgactgttgagtataaatgtctggatactgtggcagcgacattccttccattgtcaggaatgaggatatattaagtactattatcactgtatgaaatgtttttcgcgaacgcctgtatgaaatgttattaaaatgcttctgttcatacctaggtgaaacaatgcactaatgtgtaatgcaggtatgtaactctctgttgggcagctttgctctggcctctgagactgggagtgtggctgtttccctacaatggtgaatcggtgatgcaggtcacagccttgcatcttgccgatttgtccagctcatttgaggtgacggatatggtggattttgctgtgtgttcattgtttatgcagtactggttcctccaattattttcataattttcttttctgttacgggccggcggaagctgccgtgaccgtggatagcttgatttccagtggacaagggagtataggtggactgtcaattgcaagtttgccagtgggaaactccagtaactaatgcatgcctcagaaagcattcagttgagatggcatgatgaaattattattttttgcaaactagatgaggagatgacgtgatagcctatttaagcgaaagcgatcgggttgtagtccacattacgcagaagcagcagtaaaaaaacagtgtctacctccgtcagccggaataatggccagcaacagggaagttctacaggtggtaacatgctgtgacggtgtatctaattgggtttatattctaagtttgacactgatgtctgctaattttagaaaggaatacacgtgggcacgtcttggtggttacatggatgctcatactctagcgggtgtttgatacgtttgacggtattcatgtatgcgaacgacacacatacttaaaaaaatttccctcttagaaaaagaaaagaattgtctgaagaggattagataagtcataaaccgcggtgaagtggcagcttgacccactagcaatcgcgcacagccgcacggttgttatcatcaaagattcaaagctgaagccttcaaccagggcaatctccattttccactcccggccgggtcggagtcgcgcgacgacgccaccaaggcaccaactccacgtctccgccccttccggttaattcggttcgtacgcgcacccacaccaccaccacgccatggcgtgggagtaacgcgcgcccgctccacaccaccgacccgtggcaacgtttctcatctggcatccggctgtcacgttttcccgttcgctacagcccgcaaactcggggtttccccgtcacgccagccgcccaagcacaactgcacagcagcggggactccgccggtgtgcgccgacgcgagccgcatcaaccagttaccgccacccgcgcggcaacggcagcggccgcggcagcgaatcggggccagggcaagggccaatccatcctcaccaaccgcaccaccaccaccaccaccaccaccgcaaccgaacaaaactcggggaggccgcagaataaaggcgaggaggcagtataccggcgcggctggcctagtgtagtgcgcgctgtactgttcccacgtcgcgtcgaggcatcggttcgagcgagcgcgcgcgcgacgcgggcgaggctccggctcgattccgtcgccaccctgtgacagcagcagccaccgcccaccgccgccgccgctttctggaggcttcccgttggctcgtggttgcggggggactcgcggagtcgcggttgcgagttggctgcctgctactctgctagtgtgctaagcctgccttttagttagtctgggagcacgctactgctactttccccaatccaatccaatccaatccaatcctcgccggcgttggttcgctcgatcggcgcggcgcggatggagacgctcaggaagcaggccagcaagctcagggagcacgtcgccaagcagcagcaggtacgggttcctttgcccaattccagtggctccgtctccccactatgccaccaccaccgatcagcgcgtggcccgatgcgcggctaaaaaaccggaatttgggagtgcggggagctgcgtggtcgggttactggagttcttgtttgctccccgcagttaattccgcatacctagtggtaggaatcagggtagggagtggcgagtgcttgggttgggatagcagcaggccagcagttggtggaaggagctgaacatgaactgctcatttgctgcgcatttctgtatatcagatgatttgttccgaagcttgagtttcacttgttccagtagatgtgcttgtttggtaactaataacagaattccttgtgattacaggctgttcggaagcagttcagtgcacgctataaccaggatccttctcttgtcgatgaggcggaacttgagtgccaccagaatcttcagaggctatacaacagtacaagagctgctaaagtatgtgctccaactgtttgttatatgtgatataagaaagttgtctagctcatgatgtaaaagttattgggcatatgtctcattgtatagcatttccaacgaagtattgtacgaggtgtcgagggtttcattgctgtcagcaccaaacagatggagattggtaactgttaccatggaatatctgttcaacatccttccaaattttataatttttgtgtgatcacgttgcgatgtttcttcctgtagtgaaaaagctagctgaggattgttgcagatatggaaacgacaatcaaaattttggttttattcttgcaagggcttcagttgagtttggtaattcccatagccaaatggagaaagagcgggagaatcttcttaaatttcttggagagcaggtgctgtcatattatcattttcctctctttcttaagttttcagaaccaagcaaaaacaaatacattgcaacatgcaacggatatttaaataaatatatcataaattgtatactcaaaaagctttatataaatcctagaggaaaacatatataatctgcaagcacacatcaatccctaaatagcatcattataagcaacatgcacttattttctaaaaaaacacatgcacagatgttatgcttatcctcaaaacatcccactaactcaagatgtggtgtgcgatggcacttactatcaccaacaccactaacttattttatattgcatagaaatttcaatgctgcctagaatcttgtttaatgttcttaacctgaatcttctaggtttccatatatttttctttttgtacccttgacccttgagttacctgaaattaaatggtgttctcctgaaagtaacaaaacagtgtaaaaaacaattggtggattctactccaagagtacatattatatatggaagtttgctacaaacagaaacttattcagctttgctgatgcttgatatttaagttgatggacgtagcatagtttgtttatgcagtgcatggagctggagggaatttttttttattgctgtgtaaaactgagtgccttaattgcttcatttcggctccaatcttgcaggtttttgagcctcttcgagaaatgataatgagtgctcctcttgaagatgcccgcctgttaacttaccgttatcaacggatcagacaagatatggaatctcaggtaattacccgaagtgagacttcctgttcaccagagatgacaaccagatactaaaaataaattttattagatagctgatgtgatgagaaagcaactgaagtccaaggagagtagcggtaatgcagataattctgtgaaactgcaacatgcagaatcaaaattatctgagctccgaactacattatcagcattaggaagagaggcaactgcagctatggaggctgtggaggttcagcaacaacaggttacctttgaccgtctccttgcatggtatgataagcctcactgttctcataaaaatattgcttaacatcatcaaataatatgtttttgccaatggttaagacttcatgtacatggcaagttgagcctatccatcgtaacaacatggctatttctcttttgctttgagtatggtgtaaccaatacatgtacaccattaggggtagaaaactgtagacatcaaggtcacaataacctttgggttctgagcagaattggtgtttgtggccatgtttggatgttgctttttttttttccctgtcaaccccaatgtgcaggcccctttgttagttagagcatatctttgcaatatgttgacccataatcctagaagtttctgcatatctacgacaatgaaaaatcccactccattgtttaaggccttggttggttggggtggtttgtcccagtccttataaaatttaataccaggaatttgatcggttttcctaagggcctggtattgactcttaagcccacactctcatacagggttccttttctccctgctcaccttagattgtaacaatcttatcttttatatcatgtggttgcttaagttcccatataaatttctcatctggatttccatttagtagttccagtacttataccatttgtccataggatgttcctttcataaagagtcatgcatctccaatttaccttatgacccacttgcaggttgatgctgagagagcttatcatcagaatgctgctgatattctgaacaaacttcacgacgaggtacataactgttgcaaaagaaagaaatggagattcttacacctgttggcttagaggaaattcgaatgccataaacctggaaaaagtgtgtatgtttatgctgaatatcactctgtttttgttctgctaatttgcacagatggtccaagcaaaacaccatgatgagccggaaaaccattatgatgagacatcatcagatcctaaaacagctgcaacacatgagcattcacgtagcacatccgaagatcacatatttactaatactagtgaacctacaaggactgaaaccagtgaacctacaaggactgaaactagtgaacctacaaggaatggtcaggaagtgcattatgttggagaggtatgtgtgccctttgcactgctgctcataatgatcataccagaacttataatgtgtctcccactctccacatcactgtgtttctcttaattgcaggcacgatataatgttaggccttaggctggaataccggccatggattcggcgatctcgtgttaaagaagtgtttaaacataaatacaccctcttacaaatatggtacttcgactgaattttatgtccacatgatatatataaaacggtttgattctgcagcccccttagaagttaaaatttcgatagcatgagcaatacatatgtgattttttagagctactttttttttaactttttaggaatggaatttagagctactgttggtaaagatggtagtctgaaatcatgtgaatttaaattcaaaaggtgcaacttgaacataccggtgtttcttcaacataaccttttaccttaatctttacatttcactttattcctctttacacctggtaaatactatcaccgaatgtcggtatggaagtcacctggtaaaaagaagcaaacatatacaggcaaaggatatcagtatatgccaaaattactagttcaacaattttagcagttacacaatcagtaaaacagatcagcacattattatacaagctgagcagtttgtgaattactcattggtcaggtaatccatccattcgatgctcaggctgatggcgagctcagtatttccgtgggagattatgttgtggtccggcaggtatacatggtttttgcaggttttattcatgccatggggtaactaatgaccaaaattctgaagtaaagaaccatgtactgtataattcactgcggtagcatcctagtgtatacatctgtgaccgctgcaggactatgatcagatgcagtgcaagcatataattgtccccttgttatatttttaattctccaagggtgaccaggggggaccagaatgctaactaagcattccttgtctgtcttcacaggtggctcccaatgggtggtctgaaggggaatgcaaaggaaaagctggctggttcccatctgcctatgtggagcagagggacaaagccccggcaagtaaggtgatagagcctggattgctgactacttaatctctctcatactaatagttgctttcatcgccctgtttcccctgtacatggggtttttcttgagtgaatagcattttgtagaacttctacctttctgtgcatattcatgtgcttctaggcttgctgttacccaataattgtatgtaaaatttattgttttgcctttagcatctcgttttctctttctttcacaatgtatagagctattggtcctgggatgctgtaaccttccctttcttttgtggaaagcgtgcttcctgccaaaattgtgagatggatttcagaacagtctcactggccttgttccttcacttttggacccaaaagctcgtaatctacttccctccaaactctatttactcttcttttttctgttcttatcaaaacagcaaagcaaaggacggattgcagcattcggtatgtctgattgggtagaagaagaaggcatggttgctggattcctggatccaactttatctgaaaccctgaaccttaacgggaacaggagcacttgtttgattgctcccctcctctcatcatttcactgcccacaaagttaatttgccacttttacctacttttggctctgcggatgctgaatttatggggccaagccctgacgcctcttccgttgccggtccgcttcgcggaatcgcggtagcctggccatgagcgcgccaccaccgccgcctcgcttcttgccgcgacacgcacatggagctcggaaagctcgcgtttcccaagccccgcgcgatgagtgcaacgtagcccggattgattcgcgacgttagcccgtagcacgttgcgcgcaccagcggcggcaggactggatttttcacattttggtccttttgaaaaacttatttcgcaaatagacccctgaaaaaacttatcccagaaatggtcctttttgggacgccagagtggctggcgccgtcatccaacgggacggtgccagcctctctggcgccgtcctcctgccaccgtggcgcacgcgaaccgacgtggcaggaggagggcgccagcatggctggcgccgccgcctctattcctgtttctctgtatggagttgcaacggtgtcatttttattttatttttttgatgttttttcacactcaggatcacgatacaaccaaccacaaaaaaaaattaaactcgaactaccacttagctaagtttgaaaatatttagcataccacttagtctactttgcaccttcactaaaattagaccataactcttttagtaaaactctttgatcagcatgttaaacataatgcactctaccactatatgaaattacctttattcttattccaaaaatataacccccttgaaatgaattttaagtcaccagtccttagagatgtaattttttaattttaattcaatttttttgaaatttttttcacacttaggagaacaaagaaacccaccggataaaaaataaactcaaacggacaaaatatgtgacatgtagaattttccaaaactctaccgaaacggacaaaatatgttatttattaaaataggggtaacttt

SEQ ID NO: 13198 - DNA, 707 bp, Oryza sativa
ctctggcccactccccctagccacctcagcatcgccccgccacgtcggcagggggacggcgccaaagaggctggcgccgtcctgttgaacgacggcgccagccactctagcgccccaaaaaggaccatttttgggataagtttttctaggggtctacttgcgaaataagtttttaaaaggaccaaaatgtgaaaaatccaggcggcaggatgggtcttcggtgcgtcgtgcgcaaggggcggcgtgtatgggtggtggtgtccaccggattgattgcgtgcgcttcgcctcaccggtcttgggctgctgggtcctcgtgcagttatggcgcggctcgcctcatcgcccgtgttccgccgatcgctttggggggcaaggtagcagagatggaagagagagaaaatgatgcgtgccggagacttgccagtgtttaccgttcgtctgtctgcctgcctgcctgcctgggtgggtttaacccctagactagtatcttcttttggctaaattttcaggacatgtactaaactaccacgtgattttaacattagtgaagcagctagggactagggagagaaagcatcaaccaacaatcgacaacgaaagattgaggccatgtcttagttcacatcaaacttctgcctgactctcaacttttcatcacatcacattccaaacttttctacccatattaaatcttaatttttttt

SEQ ID NO: 13199 - DNA, 12847 bp, Oryza sativa
ctaggctttgtataattgtacccgtaggtgctgcacaatcaatactttacctaatacctaaatactctaccaatacgatacgccgcttagctcaactgaacatcttcagtatcatggagaagtcgacaccgcgtgtagtttccagtgacagactgacatgctctatctagtttaaagctgatattctgtagaaattttgtcctaatcgcaggtccaaatagctcaaattgaaacaaaacaattggctcaattatctatcttgaggtctatgccgacctaacaaaatgtactgctcctaaccaacatatattgacaagctgcaataactcggcctaccttcgcctatttggaagttgagagcacagggagggccgataggaaagagagaaaaacactgtagtttatcatctgattgttcagaatttaattcgtcccaaaggctaagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttggtatttgtgtgctacatttgacaatctgtgctcatttattatgattcttttgacggtttcctacaggtgaagcacttcttgccttcaagaaggcagttacaacttctgatgggatatttctcaactggcgtgaacaagatgtggatccttgcaattggaagggtgttggatgtgactctcacaccaagagagtagtttgtctgtaagaccaaaataaaccctacataaatattgtgaaatgcttagaatttcaacctggctattattttgcttcagtaatatggttttcgtttttaagatggcattttctaatagaagggaatgataacttcatagcttccattgttataaatatatctgaccaccaatatcttttgtttaggattcttgcatatcacaagttagttgggcccatacctccagaaattggaaggttaaatcagttgcaagctctgtaagtgtgtgttgatagcgttctttgcttaacctctttcttttcagcatctgaaattactattttatgtcattagatcactgcaagggaatagcttgtatggctcactccctccagaattgggaaattgtaccaagttacaacaactgtaagtttctaagtattactgtttttccagcatttgtaacaccatgtcttgcaaaaaactattcataacattcatactgttatgcaattttaattgatgcaactttttacgttttgtgttctgacttgtgagatgaccagcaggtatctacaaggaaattatttaagtgggcatatcccttcagagtttggtgatctggtggaacttggtacactgtaagttttgggtggagtttctggttgctttttttaatcatttattacctcaatcaaccaatgtctttcctggctgtccatttcacatcagactgatctcccctgtctgattagttcaatctatgcatcagaaacgtaccatttcactgaaacaatcaacacaaaagttctgatataaaaattaagtgcactggattgcaaatgaattcgtttgtcaatttagaggattactcatatttctggaatatgtttttccccttcagggacttatccagcaatacgttgagcggatcgattccaccctctcttgataagctgggccaagcttacatcattgtgagtgttttttatcttgataaatccattgaatttttatgctaactttgtgcggcaaattaaataagaaatttcacctgtgcagcaatgtttccatgaatttcctgacaggagcaataccatctgatggttcacttgtgaattttaatgaaacttcgtgagttatcttctctatgttgtttattcttgtctaattcaatatgtatatttgagcaagtagagtgggggatgtcatgtgatagagtgcttttgtttacctcttcatgatgcgctacactacatcacacttgtaatatatcatatgattttgcatgttgcaatgcagcttcatcgggaaccgtggtttatgtgggaagcagattaactcggtgtgcaaagatgcacttcagtcaccatcaaatggccctctgccaccttccgcaggtaccagatgtttctaaaactgtctacatacctttttttcatgcttcaaacattttttgtaaatagttaaatggttagcaagatttcaatgtttgtatttaatatttatccatcaatatcaatcatcagtatcagttgcttttatatttgactaggaaatatacttctggcagtttggggttctgtaaagtgtaaattgatccctttcttttcagttcctttcatgaacctatgacttatgttcttctgattatcatatggcagacgacttcatcaatagaagaaacgggaagaattctaccagacttgttataagtgcagtagcaacagtaggagctcttctgttggtcgctttgatgtgtttctggggttgctttctgtacaaaaattttggaaagaaagatattcatggtttcagggtggagctatgtggaggtaaccatgtcattgaatatgctatgtgaatcatcttcaatttatgcggtccttataatcttgcttgttttcttttaggctcttccattgtgatgttccacggggacctcccttactccactaaagaaatcctcaagaaactagagaccatggatgatgagaatatcattggagtagggggcttcgggacggtttataaacttgcaatggatgacggtaatgtttttgcattgaaaaggataatgaaaacaaatgaagggcttggtcagttctttgatagagaacttgagatactgggaagtgttaagcatcgttatttggtcaatctccgtggctattgcaattctccctcatcaaagctattgatatatgactatcttccaggtggaaacctagatgaggtgctacatggtgagcatgttcagttttctacttcctatttattttatttgtattgcattcttccaattgttaacagttttagtttgtcttcctcagtaaggagttaagtatgtgttcaaagcccaacattaaattaaggtttgaggtgattcagttaatggatatgaaagaacctagtggtgatggtggagtctgccattccaccaccacctctagggttggtgttatcttctaagggtgcatagatacttttatatgtgtggcttggctatcagtgtggattgatgctctcttgcaaattacatattcttccatgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagtgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggtttaaccgttttacatagcggagtagttcgagcggcaacaacacacttgaaaggaaccagagcacaccaaaaacaccagtaattacacctcacataagtgatcgatacacttgaagccacagataaatcgtttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctccacctccaccttgacctcctccttcttcagccccggcacgtccgccttgaacacgtgcgcctccggcgtctccttccagtcgatgcgcgcgccggcgaaggccgcggtctcggaggaggtgccgcgggggaaggacgggaagatgctgccgctgcttctgctgccggagccgaaggggaagccgtcgaaggggtcccagaggtcgagggagaaggggtcgaacacgttgctgcggcggatcagcgacattgtgtattgtgtcttgctgttttttggttgtctggtttgtgttctagatggaaagagggtgatctcaattctccagaaaggctggtgatttttcgatcgaagaactgaattccttggcaccctggcggtgggtggtggcaacaatttatatagcagttcgtgatggtccatgggttctactggaagttttgcttccggatagttctcgtttgttcgttaatttgggccgaaattggaagtggtcttctggattgttctaggcctgcttatggcctagattattctggagagtcctggacgctatgggctacagcccaccccgctaccggtggtgtaaacttctagcccaagctatctcgtactaggttctagcccatgcgggggcaaactggaagtttctagaagcttattccaagctccacgatgccctctcgctgccctctataaaaccgcgctccccttcaccggcagaaccacgaagaaaacgcaaagcaaaccaagcaaacatcagagtaagaactcagagaagtccgatcgttccacctccaaattcgcagctattccgacgatgtcgatgatccgccgcagcaacgtgttcgaccccttctccctcgacctctgggaccccttcgacggcttccccttcggctccggcagcggcagcctcttccctcgcgccaactccgacgcggcggccttcgccggcgcgcggatcgactggaaggagacgcccgaggcgcacgtgttcaaggcggacgtgccggggctgaagaaggaggaggtcaaggtggaggttgaggacggcaacgtcctccagatcagcggcgagcgcatcaaggagcaggaggagaagacggacaagtggcaccgcgtggagcgcagcaacggcaagttcctccgcaggttccgcgtgcgggagacaacaaagccggagcagaacagggcgtcatgggagaacggcgtgctcaacgtccccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactg

SEQ ID NO: 13200 - DNA, 13923 bp, Oryza sativa
  unsure (1)..(13923): unsure at all n locations
ccagccggcgaggccgggctgcagggcggtggcgacggaaagcatcgagcgagcgggtgattcaatcatgtctggtgaccctagaatgaaaaaggaagaaaagaagggccgggtaaggtttaaggatgtatgccccaatctatacctatacttattataaaaattgaagatgtttccgcggtttgtcatccgggtttgtgtcggttataaaaattgaagaaggcatcatccgtgtttgagtcggttttaattttaaggtttggtttaaaccaatataaaaaatggagatggtttcccgggccgttatccggggttgaagcggttaataaaattagagaaggttcccgcggtcggtcacccgggttgaagccggtttaaatttaaggtttggggtttaatcggaaatcttctcaactatataaaaattgaagatgttttcgccggtatttttgtacgtcaccggggtatgagtcagtttttaagttcgttggctttcagtaatacagaaggaatcatataagaaatctgtttaaaaaaactcgcatgctaacttgagacgattagactgctaactgcagctcatgattttctaaaaatatatatatccaagggaattcccacagtaaatttcatcttaactaaaccatataacaataataagattaaaatagacttcacccgttgcaacgcacgagcatttttttttctagtcttaaagaaattcaactgttcaaaattcgacagttccctttatatattgtaacgtcttacatatgcgatttttatggttcagagtttctgacatgagtttcttatgtatgtctcacatgaattgtctgttctgatcgatacatgtaagttttcatcctaagggcacccgtaatggttatctataggctctctacaagatatctatgtcagcatattttcctacttgaaagagattaaatgaagagatagagcaaagctatctactaacctggagatagtctatagagaaaaacgaggcaatgaattagagagctatagatacccatgtagacatactattggggtagtttactattaatctagtctattgctgagatgtacatgttttatagagagcaccttactttactattgcgggtgctctaacagttccattttcaatttccaatattatctttgttttggcctctaccgtttccgtgaaaaataaatggctacagaaatgctttaggctgtttgtcgactgttttcaggactagtgagaaggagcctcgacctatcaacagtagggatgaaatccttcacaatgggtttaattaattcgccatcagaaaagaaaatttctacaaatatattataatttagttacaatacttttttttttagaaacacccccgtatatgaaacttgcagtcaagccaagaacttctcgaccttctccacttcctccacgctcccgatgtacagcggcactctctgatggatctgcacggcacattcacaaacgaatcaattatatagacacatttcgatttctaagtctactcgtagattaatccattaataacactgcgcatataatgtgtgcgcatattttacctccgtaggcatgatgtcaagtatcctctggtggccatcggagcccttgccgccggcctgctcgacgatgaagctcatcggcgcgcactcgtacagcagccgcagcttgccgttcttgctcttctggtccctggggtagccgtagatgccgccgtagagcagcgtgcggtggaagtcgccgacgaggctgccgatgtagcgcgcggagtatggcttcccggacggcccgggctccttgaggctgtccatgtagctcttgagcttgtcgtcccagagcgcgtagttgccctcgttgaaggcatagatcttgcctgccttggggatctgcaccttctcctgcgtcagcacgaactcgccgtacatcgggtccagcgtgaacacgtacacccctgtcccgatggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgacgtcgagttttttctggtcctcgccctgcacgttgacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggtttgccagtagaggctcaagcatcagtgacgtgcgtggcccaatgagagagatggtgtcagaccactcccctaccgggatcacggacggcaaggtaggcagcgactgtgaaggactgaagcaggcgaggatggggaagatgtctgaaggggaagatgaggaggggcggctttctctgccgtcatcatcgcgccattgcctactattgtccccactcgagctcgtgtggcggtgtggaaaaggagaggggggtgagaaagagaggggttgctcgcaacattggtagcgatggcgatgggaggggaggctcatgtcgtagtgttagagggtcctgccaacaggatgaggccacagagtcgtcacctccatccctagtgagttccacaacctcctcgagctgttgttacctatcggcctactgatacatactcactgacatgtgacccccacatccggttggaccaacttgccacgttggtgaaaaccatttttaaaatgggacaattgcatatatgcccccaatttcaaacccaattgttgttttaccctcactttttagggtttgcggttttagccccactttttgaatctgaaccggccgtctacccctacttgtaacaatcgtttggtgggtcccacgttttgtgttaaaggaatacaaaaggaaataaaaaaaggttttaggaaatatgaatttacgtttgtacccctgagagaatgggtagggactaaatcctctcaacctgtgcgtgcgtgaatcagggactcgagggcgggcggctgcgagggcgtacgcgcggcggcggcaaccgtggagagggcgggcgtgcggtagccaggcggccgtggggctttgacacggggattcgcagttctagttgccacaccaattcatgctctccccgatcgccgccctctcccttgccgcgaggtatgccgccatcgagaggtctgtacgaccgcttccccctaccgcacccttctcgcactattacgcagccggcgacgaccccatcctgctcgacgtcgatggcaatggcaacgccgctttcatggcggtcntcggccccacccacccnagcatactctccccggtgccctccgcgctgccccccaggcatcgtcaccgtcgaggctcttctccccgctcgaccaggcctccgtttcctagctcagcgacctcagccccttcgtccactccgccggcgcaacccctcccccccaacccatgccgccgttcgcgccgagcacgcatagcctgctgctgtccacgcccaccgtcgccgatgaccttctccatcaaggaattcttcagtagcaacttcccggacctgtcgaaatgctgtctaaattttgttcaaagtttggtcagattatgtacttggctagtatttgtgatttttttattaaagtacaaaaacatcacaagagatgctcatatttgaattatttataacaatcacacaataggggcaaaatcacacaagctgaaaaaaataggagcaaaaatgcaataatcactaagggtataaatgtccttttgctgtacaactaacaccgttaaaccggatgttagaagtggaggtagtcggatggttcaaattcaaaaagtgggggtaaaactacaaaccctaaaaagtgaggataaaacaacaattaggtttgatagtgggggcatagatgcaattgtctcatttaaaatagtcaagataattaagttacatcaattttaatagttggggggttagaacatcctctttcacgaatgaggaatagaatcagaaggactttaaaggaaaggagtgccatccaacagaaggccctataactacttacgttcagcaaatcctgatatgtagcctgagccgagctgctctttcttgggcttcttacttgttatactctgtgggccgtggcccaatttgacaactccttaccgttttacttttgcttttctatttctctaggggtataaaacagctgtaccaaatcaatagaaaaccaatgctgcatttcttgtgtactagaaacaaaatgtccatgcgttgcaacatttttttctttctgtggtacgacggctaataggagctaagcaatatattgaaacattggaatcactatacattgccccattcctttattttcagccccagcccaatccacgcctcatatctccctccgctcggcctgcctctctccagcgcaccctacaaatggagttgcaagagcccagctagcacaatcggttgcctcctccaaacactacagagcgtcttcaaacctctagatgacagtcatgtgcccgtatcatgccggagctaatcatccccatcaagtccggtggaatctttctcgatctctcaaaattggctgagggttttaatccactcgatctcgatcctctttccatttctcccaaaatcagagcgtcgcatccaattcgtcgtagccccaattttgtaaaacttgggataaaaacacgcgcacggtagcgctacggacattgacgagcccaaaaaactacaaaagccttacgtatttttaattaagatatataaaaaaggaatcttggtctcgattagactcttgatcgtgtcgcaggtgcagcgatgatgaaacgaagcggagggacgaacggaagccgaatctcaaagggatttaagggaatcattgatggatgaaaatttcaacagaagctttacgcattttttaaataggtatatatagatatatgaactacttgtacaatacttttgtatcatctaacattttatgcaagatggacatgacgcagacatcagaacatattcttaaaagaacatatcagaatactaacaaattaagcaataatcacctcctccagcttaatccttttttttgctctttccacgacaccaaccttttgaacaagaaatacaatatttttgtagaccaaataatataattctcttgcagagtccaatcctcgtattgtttaagctttgagtttagcaaactctactcttaatttgtaccattgcgtggcaggattccaatcaaatactagtagaaaacaactcctatgcttacaaaaaacaggacattccaaggcaacctacctattcaggggcgcacgtcgatgtgctatgctttacattgacatgtccagcaatcttgtcctatcctgttccaagacggtggcaatttttgtcagctaccgattgggcaggggagcacagctacctcctgcctcatcggagacagaaacagagtcgtaacccatcaaaagcaaagacaaaatacacttgtcgagaactcttggtttgtttggtttctcttcacgggcaacggaatcttcaaggtgtcattggcagaatggcaggcatgctaatttgttcagaaggtctctaattcatttgacgagttagcgtgtatactagcaatcaccctcttgattatctcatgctgtgctcgtcgtcttaggaaatgccatgtctggtagggtcaaagccaaaccgagtcaggtcagtatgaaaccaaatgcatttcggttagtggcgggagaaaaatatcgatgtcacaattagtcaacgagcaagcctactctgttctatctagcacatggaagaaatgggacctaacagtagacttctgattgttcttctagctctttgtgttttataatacatatctgaacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcagtggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccgaagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccggttcgtttgtccatcgccgcgcgctgattggctcatccatttatggggtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacaacagcgacgccacggcggcggcggcggcggcggaaggcaccccggcgggaagaagagcagcaagaacggcggcgaggttggcgggttcgtgctgtggcagaagaagccggaagctgtggtccctggagctcgtggtgtccggctgcaagatcagcgccggcagcgacggcaaggtcgcctggcgccagacgccgtggcatcagtcgcacgcctcccgcgtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactgggctgcagga

SEQ ID NO: 13201 - DNA, 1425 bp, Oryza sativa
  unsure (1)..(1425): unsure at all n locations
nnnnnnnnnnnnnnnnnnnnnnnnnnnnnnnnnnnnnnnnnnntctgtggcctgaagatcctcctcctcaagagatgcatcatgcaagaacatagttgtttcttgatgataaacaagaacaatgttctgtaggctagaaggacaaggcttacgcttgatcgacggtgatgagagtcgttcagtttcatgaagatggacaatagattcggaagaaatgaatgaaaaaacaaacatcgcctgctcgaacggctcatacttgggatgaggcttctttttgttgaaataattcagggtgtttccattatcttcataacgattatccctgaattggaatggaatttctggaggatgaatttttttcttcctccggctccagcacctagaatgaggattcggcagttgagtcgggtttcgactccacgtgcagaggtttctcacagataatctagacctcccggatggcttcgcttcggcagaaagaatcgttctctaagatgagatctaagagttctctttgttctgcagttgtcttgtgtgcgaacgatcctccagcggaaatatcgagatttgcaacagactccttgtctaatccatactgaaaatgttgtaacaacaaatggtcaggcaaagacaagtctgggctagactaagttaacaatgacaacctggcccaggctgcactgagagattccttcttgttctatcggaaagaaatgatgtctaatcgaagattaattatacgagttaatggaaagaaagcaaggcaaaatttgcactttagctcctcccattgaccgtggaatttcttgacagacatagtgtaccattgcttcacttcatctctaagagaaaaaggaaacaattttcacttcaaagtttcatgtgccattcctacgatcgataggcatgaacacactagctcaaagtcccgaagatggaggtatgggctttcactaataccaccagagaaggtttgctcttgaatcatggctataaagccaggactgatttcgtagccttatgaaaggattggttttgaagaacgagatggctcacaaagatcagcctgaggagcagaaaggttttgaattgtgggttgctccatcaaggaaagggataaaagaagaagaaataaaaaaagatacgaggatgacctagactcggaaaaattagcaaccgttccccggcaacgacgccagaaatgcttgttggtattccttaagaccatagataaatctgcaagcacacggaataccgctgtagtacttcatcttcgggtgacccctaaaggatatcgaacacagggaacgtgtgtaatctacataaatctaagactatctaaggacaacaactaatggtaagcaagctaggctaggctagagaggactttctaagtgttttagttatctagactcagttgaaggt

SEQ ID NO: 13202 - DNA, 25401 bp, Oryza sativa
tgacaaatccatgggatacacaacaaacaaaggtaatatctaaactagacaccacgtctaagttataataaaataaagtccactattgcttggtttactaacctcttgcagagaatgagcaataaatggagaagaatcggcatcaaaaccatcgatcaatcaatcggacgatgccgagaaatagacttatagaaagatgggccaagaaaccataattgacacgatcaaattggaccaaaattcataagtctgggtgaaggagagcaagaggaggccactgaccgagtttgggctgggttcggcagaaccaaccgaagcaccattggatccaggttttggatagacggtgtggatggcttccctatggcggttggaggatattaccgacatttccaaccatcattgttcagctataaaaggccttcactccctccatttccaacacacctcaagcaagcaagcttctcatactctctcaagtttagtttagtgctctcaagctagtggagtaagaacagaatagtagtcggagtccggaagtcttcggaagagttcgggtatggctctagttactttcctttgttcttttgtaagactagtatttaatttagaatattcttctgtatacgactatggaattgtaatactttccgattatataaataccagctttacactatgtccgagatattatgattatactgctagcttatctgggagatgcattggtacgggtataatgtttgcatatgcaaatactctatgtcacgatggtgatattagagtaatatttggtagtttaggcgtggtgcttagattactgggtatcattatttggggttatatgctgcggatgagatgtgggccgctgatggtgacagctcagtgcgggtattcctccgcgcgtgtataaaatcctaagttcattccctggggagggtactcctccgtatttagccccggttgtatggtcatgaggggctgtccaaaggaactcggcagtcaggggtggcttctcgaactaccaggatggcatcggaaagggggtattagctagttaatcatatacttaggatgtatgtacactatgtatactagaagtataggaatagattcttttcaatactctttccacttagcttagagatttaatataagagtgagtagcttccggtcctcatggaaagctacactcgttgaggtagaaatcgaagagagcgccaaacttccaggcacacttgcagagcttccgctcattctctacctattctctaatgtacaaaagatataatagagcctcttgtatttcacctcaaagttgtgtgtgctggaatgaagtgagctcctccttttataggctccaaatgaaggttactgctatgggaaatacccaaactaccctccaaccatcattgggatgaaatcaggagcatcgacaaggaagatggcgatcaacggtgacagacatggattagccaaactggtggttcggttgaagcaaaaaaacccacctcctggactctcctttggccaataggttgcttaatgggctcccaacatcctgtactatgagtttgcccaattctaagtggttttgattgacttatggagcttccaatccatgtaaacgcatcctgattgtccgaaggtgtactttgtcgcatgacgggtatgttttctccttaaaatacctacatacacatatttcaccaacagtagtggaaatgattagtaataaaccctaccactaagttgaataccatattttatttcattatatgcaggtgttgatgatcaaatatgatgatttaaggaccgtcatcaatctgctatttgtatatcttgtcagttgcaggatcaaactgactgcgatgcccgcatatcaccaagatttggaactgcactagagctaagcagatctctcaggcagttgtgttcgtcgacttagttcgcgccaacacagacttggcaccattagcaatacgtaatttgttgtgttttgtggaatttttttaacagtagatatttttttatctgaaataaatattaaagtggttgctccggtcattttgatgtcaacaataaaaatattaataaaagaaaattgcaattaattcaagtgtcaagctatattttggatcgctatgcattatactctttggatttctgccaaaagctcattgctttctttctttttagttccaacccaacccgctacctccctctggttggcctatctctctttgaacccacaagtgtagctgtagcccagctcgtatagccagctatcattttcaacccctggaaaactgtcccgtgttcgtacgataccagaaccgatcctccccatcaaattcggtcgaatctttctcaatctcctaaaattggttgagggttttgatgcactcgatctcctctttccgtttttatcaaaattggagcgaatctgcaaatctcgggataaaaatgatgacttttaaatggagattaaatctagtgattaaagggaaattgaaagggaaaatgatggagaatagtttgagggagtagtgcagaattgatttttgtaatcaattggagaagggaacgcatggagagacagatcgacatgctagcgatgctagggtttggcccgacgaccaaaaaaccggctagcaacgaaaataacttatggaaaaaacccggaaaaaagaagacaagaaaaaagtggatgggaaaaaaagggaaaacggagaaaaaagatggacggaaaaaaaagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctacatgtgcgggatgtgaatgatgcctttgacatgttgtctggatggttgcagcgttggaagaacgttcggaagaacaatgcgattgtgtttgcacagaaggcgacggatggaaattttatgtgatgaacggaaatattgatatcttttaagtaggtaagtctaaaaaaaataaatggaattttgtggtaatttatccactttaactatgagaatatagtatgtgttgatacctgaagaaaatacgtggagttaaaccgacgacacacgtcagaattgtgaaaattggtgttattcgtttgcattttatttttcttttttgaaacctttataactttttttgttaaaatttatggtttttttctcattaaatattgaagttaagaattgatggtttttatgttaatattaaaaaagtaaaatagcaaggagatcataccaaattctgttgcacacagggtttcccaaaccgccggggacggggttaccgtgccccgacggtaagcacggttaccgcgcggtaaccgtggcaaaccatacgaaaccatgcaaaatttatcaaaatttcaaattattttttaaatttatttgaatttaaggagattaccgtggtttttctattaccactgtaaccatggtcactggtggttttgcaaacccttgttgcacactaccagcctgaccaggtgccagctctcattttcttgacagccactctctctttctccatgtcttcctctgtctctctctccctcatctatatctatagagcaaccaaatattcagttagcaatttatgttgagcaaccgaataatcagacattatacccgcaccaatgcaattcccagaagatttagctacacagattatactattcatgaatactataaagtcggtacgcatattctaagattggaataaagcacctgaattatataaagaagattattctattgaaagtagaagtcttacaaaagaagaggaaaagatacaagagactttaccgaactccttctgaaggctccgaggactagcagagctattccaattctactccactagcactatactaacactaaacttgtagagaagctttgatctttgctgggaatgaatgagaggaggagctatttataggccatgagttgcatttgggagagtggagatgctccaagcatccaaggagcatattctccttagcttcatctccttgtgacatgtgtccagcgatggtttcttcagtttaactggtcataaccgccttgggacatggataactaccagctggtgaagaattaggctaattgggctagctactggttcagccgaaccaggcccaatcagcccacaactttgcaggtggacttcttgttgattcatcaatccagtgatgtgaattattgggcttgtttactcgtgcgtattttgtgttattggcccatcttttcacaagtttgcttctcgatagctttcgagtgatcgttcgtttgctttctgtcgattctcctctatttatatgtgcttctcctgcgtatatgttagtagcatagtacatagtggaaatagacattttatttggaatttatgcattgcaagcatagctagtcttcagtaattgggaaatattgacggtcgaaattggttgataacgactgtcaacaaaccccccaagcttaaacctttgctcgtcccgagtaaaggacgaaaggaaacaaagacttggttgttgatcaggagttgctactatggtgtatatctagaatgtagaagtgcacagtttgagtactctctctcatgttaagtaaatatgcatagtggcttacccttatgcctaacatttgtggaacacatgcttctcaccaccttaggcaattgagagacagaacagatcatagagcaccattttctttttccttgctcagttttcatcccggatggttttcaaggatttttgcaaataaaaactatgttcctcaaatgattctcttgatcactcaaagtgtatagatattttattcctcacgaaagataatgccctatttgaatcctactctaaggttgaatatgtggagcttggtagggatcaaatgaggcatacttgtattctcataaattactaagtcaaaaatctagactaaagcagatagcaaatcatacttagatcaagatcatgcaaagtgtgtggaatgtgtggtggaaaataaaatttggataaagaaaatgcttctcctttgtgcttatacttctcctccaaattatcctttgtttttcatggagagggtatggctatatattttcatcacgctccatattttgatagagcaagactttattcatcatttttttatagccacacctttctctccctttttcttttctttttgcaaaagatttttctttggagaagaatgcatgaatggagagctttatttgtcgatgatgacatggatatgagtgagatgaatgctaacttccagtgtagaagcttagcatgtgtgcatatgtgggtgtatgatcttgttcataaagtatgaaagatatctacacaagtcacaaaatttgacaaagttcaatggaactacaagtaaccaaatattatataaggttttcaagtgcaaattatatttggctgtggtaggaataaatatatcaaatgaggaactttgaaatttatcattttgaaaaacaaatcatccaaaatttaaatcaagcttggatcaagatttaagcaactctatttcactatatcatatctcacaacagcttaggcttaaatcacgcagtgtgcaactcacatctcttaggttcccggataatggttggctaatcattatttaaaacttgagagagtacttaactatgtacagatacattagagatataaagcagagcaaatattcatcatttcaatgtggagaactaggttttcttacctagcatggtaaaatctatcctatatttttggtattttctattttgcaaatttttatgtttttgagttataaatgcaaatgcaagaattgaaacatgcaagaaaggaaatatgcaagataaatgcagatacaagtcacctttgcgggggagagacttctccccccaagcttgctccttgctcatggtccagagtaagcattgaatccttgatggcggaagtaggcttgcagatcagcttgttgttgttgcatcatattgttgatatttgagaactgtgcatcaacactttgctgctactcctgcgcctggatcacgtgtccttcgagggactgttgtcccagcgagaggaactcgagcaccaccagctggaggttggaggcacgccacttgagcctgctgagttggtgtgcccccagcgcacctcatgaggcatctgccactaggaactgccggcactcggctaggcagatcctccagtgctatgacgtagggcttgggcccagccggaggcatctctagctgatttccagccactctcataagcatgaccgggtggtgagtacgttgaatcctcctgttcatctgctgccattctgcggttactcctatgtgtcgcacctgcacgggattcctctatcgtctgcaggggaatggttagtgcataacagttatacaaatgataccccgggttaggtaacaggatttcatttctacaaccgggttggaagaatactaaggtcacatctgctccatgtttcaaagtatgaccttgcactagatatgattcatttatataaacacgagagactgagatataagcaatttgatcatttgtaataaccccaagccctcttgctatacaagtgatcaaagaagtgcattttataggagcggagacctctatgctctctacccactgcctaatcatgggttgcacaggagaaactctaatcttatgaaccatggcatatataataatcatctcattatcatgaacaggtctaggatctcctctaggaaacaaagtcatggcaatccatttatgtataagtctaagagttggattatggatgtcattggttctgggtttcaacccattgttttccagataacaccaaaatccacatccatacctgttttccggagtagctcaggatcgtatgctcgggtgtgagcgaacgatcggttcttcaacatctggtaggtttgcttctctcgtctgtcgacgaggtcgaggtcgtcatctgtcaggagctgtggaacatcgtccgtgtcctccatcgacatgtcggcggacgaacgatcactcgcattatcggatcgggagccagatcccttaagcaagcgagagagccgtctcctcatgactgcacaaaagcaaggatacaaagcgaactcgagcgggggttagtacgagataaaatacccgccggttagctttgtaccaacagcgacttgcaaatgtagcgaataaaggattttaaatataagacgagcttgcaccagcctggaatgaatttgagagcaaaatagaaattgagaaggagttaaaaattgagttggcaatgagatgaactccttctaccggccatcccctttttatagtgcacctccaacggctataattgtgacagggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaggtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgctcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctggtagtttagacgtggtgtctagattactaggtatcattatttggggttatatgctgcggatgagaggtgggccactgatggtgacagctcggtacgggtattcctccttgcgtgtatataatcctaagttaattccctggggagggtactcctccgtatttagccctggttgtatggtcatgacgggctgtcgtaaggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttccgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacatacactgtgaagggcgtcagtcctgatatcgtcaggctgaggctgttcccattttccctcctcgggaaagcgaagaagtggttctatgccaatcgtgctgtgataaactcttgggaaaaatgttcgacagcattcttgtcaaagttcttcccgatgggcaagattaatgcccttcgtgggtgaatttcgggcttctagcagatgcgggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacaacaataacaacaacaacgggtaccacccgcaaggaggtcaggggtggaaccagccccgtccgtatttccaagaaggcaataaccaagctaatttctctaaccagccttccttgaaggatcttgttttcgcgcaagccaaaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagagaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaagattcggggtgtcccacaatcacttgctcaatctagacacaaaaattcgaccaggcactctgcgaccttggggcaagtgtaagcgtcatgcccaaggacgtcttcgacaaactcaactttacggtgttggcaccaacaccgatgcgccttcagctggctgactcgtcggtccgctacctagccgggatagcagaagacgtgccggtaaagatacgggattgctttatcccggtcgatttcgtggtgctggacatggacaccggtaaggagactccgctcatcctgggcgtccattcctgagtaccgcagaggcaaacattgatgtcggaacaagaagcatccgtttccacatcaatggaaaggaggagaagttcgagttccagccgaggacgaaacaatgctccatggtccggttaaagtacgggccagccccgtagaatattcagacggtcaaagtggagccacccaaaatggacagcctcatcgctttcatgaagaaatctctggagatacaaccttccaggatgaggtcccgttattggaagacaccggcctagaaggaagagaaaccggctcaaaagaagccgccgcccataccaaggacaaataaggtatggtggctgaaacagaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccgtttttataacaggaatcaatcgtgtaaacagtaccatttccctggatcaagtagtctggtacacacgaattcatagctgaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtactaaccgtactcagcaagccatcatagcaatgatgcacatgacagaggaattcaaaggatggctatggttctttttgcataaagcaagttttgtaattcttttcacaagcctaagacctagcatagactgttcaagttttaataccagtgttcatattaaataatgacggttctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgtatattaaattatggttcaagttaagttctctctctcacacactcatggcagtcctaccaatggcaacaccgatgtagggtacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactggggacggtactagccttttccagataccacccaaatcctccgtccgccccagtcgaaaatagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcgggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcagaaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaatccgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccagcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggcatggcttaccggcggcaacggcaatggcgcggcgcacggtggctgcgacggcggcggcgcacggcgactgcgatggcggcggggaacgcggcacggccaaggcgcggcgcggcggctctatgcgacgacgcggcggcgtggaggcggcgtggtggggtgggtagaggagaggaggtgaggatggagggaaagagtgggagtagggggggattatataagggaaggggaaagagataatagggaagagggaagaggggccgcccctcatggctgccgcagcgtggcgctgcacgcggctcgacgcggcgatgggacgacgacgcggcgcggcagggcgcgggacgcgaggagcggcagcggcgacgcgacggccgaacggcgacggcgcgaggcgatggaacgggcggcgcggcgcggtagcagcggcggcacggggctcggggaagcagcgcggcacggggcgcgaggcggcgggctcgcggcgcgaggcgacgagacggcacgcagcgcggcaatggcacggctcgaggcggcgatggaacgcgcacgcggcgacgggatggcgacggcgacggcgcggcaaaggtggcgcgcggcacgaggcagcgatgggatgcacgcgcagcgcggggcgggacgcgacggcgacggcgcggccgcggccatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgagatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaattgattatcatgtttgccatggttagaaaaattaaaattgctcctgttaaatgtatgattaggcaatggttagtgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcaacaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgtgacatagtttccaacccatcctagccatagagaagagtaccgacccaatcccacctacggccggaacctccgggacaggcaggcaggactgagcccccagcagcagggcaccaaccctgtaccatgacatctcgactaccgggccgcagctcgtgtagccttcatttgccctggagaatgtccatcgacccccgacttcatccacctccaatccgtgtacttttgtttataacttgactgagccacaaactaagccttacccactagacatgtggaagtacggtagtgctttgcaacagaggcccgaagaccggtctttatatggccgaggtgctactatcaaaaccatgcaccccgagcccagcctaaaaccattttggggattttgaatagagggggcggtgtgaatccaattccacaataaaccaacaattccaaagtgtccaagtgatatgagaattccccaagtctaaagttataaaaccacctaatgttgtctaattaaacagcgaagcatctacctaaaatcatactagtggtaccatgagtagagtatccactagttggggttttgtttaatctagggtggacaaggtaataataacaataacaacaataatacggtcataacaaaggtaaataggcatggctaagtaaaaccgtgataacgcgggaatttaaataaagcgataatgcaataatttaaatcaaaataattttataaactgggattcaatatgttcaaggatgatgtgacttgccttgctcactttcccaaacgccggcttcaacttccacgaagagcggatcttccgaagctgcagcgtctacacgaccaacggaaaagaaaaggcttttacgctaataaattccacataacagcagaaacaaagcacaaaaatgggttcttgacttcttaaggaaaaattagagacttgaacggtccaattccgagttcaaatggccaagttatggccatttgaagtttatatgttctttaaatggatatttgcgaatttcttcatttaaattttaatttaaaatcgaattattgcgtcagccgggagagagggcgcgcggaccgggtccacgggagtgggacccacgcggcagcctctcggtccacggtggaccgggtgcacgcggctggcgccgtgggtcccacgcgtcagccgcacccgcgggcgcgggcggctgacggccgggccccacctggcagccgcggggcgcgcccgaaggcggcctcgccggcacggccgacgggaggcggcgcgcccgtgccccgatggtcaccgccggcgaccaccggcgcggcggagcggcgcccgagagagaggagagaagagggaagcgaagcggcggtcttcggctcaccccgggtcgacggcggcgacggaaacggcgaccgaagcggaggaaggcggcggcgcggttcgggtcaacgaggacggcggtgctccggcggtcggcgggcgaaacggaggagcggacgaggtcgacgaggacgcggcgaagccaaaggaggtgacgccgagacgagaggaggtccggggcgacgacagcggcgaaccggagctcggcggcgacggcggagagagaggacgacggcgcgggctcgattccgaaggggagagtgagcggcgagcggcggaaacggaggagggaggcacggggaacgattaaatagcgtcgggagggggagagagcggccgggcgagggggaaacggccgcgaaaggtgcggccgccattgatgccggcgaggtttaggggaaagattccgagcgaatccgagggagagagagagggaaaagtgggggaaaagggagagggaatcacggggaatgattccccccactttattgcgcgcggggacggcgggatgcggcggaatccgcggcggcggcggcgctagggcacgggcgggcggcgggagcggcgcgaggatagggatgacaggcgggccccacctgtcagcgagggtggcgggcgggcccgcccgtcagcggcgcgcgcgcggggagaggccgagtgggccgcggggagaggagagggagggggagggagatgggccgagccggcccaagaggggaaggggggaaaaagaagactttttaggatttttctttttataaaatcattttaactttgtttatttcttaataattattatttgtgctctgagaattccactaaaatttgagggctccttttagaccaaggagaatttaacaaaaaatctccgggccacatttgaatttttcttatacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcgtcttctataacgaacttgcctagcaaaacttctccactctggactgcttggctcgatctcctgttgcggatggaatcttctcttctcctgacttgaaccagggtgcaccttttagctgactcagactaggttgcggtagtttaatgatgcttccgttccagaacttctcatgattcatatcttcggagtcaacctcatacaagttaccacttcatctcatgcgtcaacactagcttgtcattactaggataccatgcttgtcatcatgagaataccatgcttggcgtttccttccagcttaccaccatatgctttagactatgatatcccgcttactaaggataccatgattgacaacttgccattaactatctcatattagctttcctggtctccggtgctaggtacttctgctattcgatgcaagggtcaaccactttaactataagttatgcttcccaagagaaccaatttatcccccttgacatgctttgacgtcttcccgaatgactttgctgctggacttgttattgtctgatcgtgatcctgccagatctgaagcttcgttgttagaggtgattttaatctgacctctgtagactatcttcgaacatatcacttggttcataactgggaatagctcccacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcactccatgtagcatctgatactgagttgaagatttcactccttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgaggacgcttctggggacgatgaggtcctttggcttgctgcctttcagtgaaaccttgatgtggttcgtcaaaagctgcactgactaccttcagggaaatacattgcttgctatctgtatctatgccactagggtttaattgccgatgatcatctttagtgcttcctcgagatggggagaatccaaattgttcttctgccatatcacctttgacccttttctgatacctgatagactaattaccaaccatcgactactatgctctcaaatattgatgtctcctgggtcttcttaactgtttgcaggtatatccgaacttatcaatgtagaggcatggcgggtacccttatgggtttcatccaacaatccttatcttaatctgtaaaaggcgtatccaaactcctatccccaactactgtctcattggccttttaacccaacacagtttaattgattttcttttccatcaacaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacaagaatacgaggcactgccttaaacaaaaagggaaggtgcttaacatcggtacattgtatcttcaacatgaatcatccataagcatagcaagctcactgtttatagacatgaatatatttatgtattacatgattgctgcaaactttcgattacacaatgataggtagcgaactgaaaaccacaaatatggctgctcattttgattctggagagatatagctggcattgttctagtgactgcatccttgattagttctgtgatgatgtgataggactgcatattgctatcattcacaggagaagcttccttctgattgtgggttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctaaaggtattattgctatgatttattgcagagctaggtggagcattggtgctgtggatgatatcgtcgatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcctagtgagtgcagagtgtgagacacatgctagcaacgtgtccaatttctccacaacgggtgcatgcctttgatccgaagaagacatatctgaaactcttagtccaaacaaatgtctctttggttgatcacttgattttcttcgccatcaatcgctaggttatttgattcataatagattatgagcttacggaaatgagaccctaggtccccctaatcaacaacaaaatgtacacaactcacagctcttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtactgcatttgctccagtgaccacttggcgattggcatgtctgtttccttaacaggtactacagttgtaaccgacaataactttcttacgctcgggttcttcatcttgtacttgatttcttggctgctgtgctggaacatccaaaggtacaatgccgatactggcctctgtcttgtcaactggtggctgcggctgaaattgagcattgacaccttgtggtaatgcactagctggagttggagctgttgcaccgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccagactcggcattttcttttctcattttgattcctctgtcctggcactggagttaggctgaaactgtaatcttggcgaggatttgtgtggccttgatgcttctctccgttggaactggcgggttggttggccatcttcttcgtcaacagaaaactgaattgacaatcttttggtacatgatcagttccttcacaaaagaaacaagtgatcctgctcgttggacacctgtcgggtggatggtcttcctcacaatgaatgcatgtagtggcacacgagctggcaacatgaccgatttctccacaacgagagcatgccttacgttccattttatcctggttgaaaccttggggagacttctcgtcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattggtgtttctcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgggtgcttggactgcctccaactgcacttgaggttgtatctgactcaggttcagaattggcgtctgatgctgctgcagtatctctataagcaatcggttctggttaatcaggtgttggaccagtgtcacacaactggtgtctggtgcttcgttcactcgggagcttgaggtaccaacgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcctgcttcacagctggcttcactgcttccttcactttactagcggatcctgcagtcttccggagcttcggcagacaattgacaacatcttcttctccacaaagccgaccatctagtactagttgaaatttgaagaaggaagaaagagtaaacgttttgcaaatagcacaggggaaggagaaaaaaggaactttcgcaaataattttatttataaaatatgtccttaggttttatcctcttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctgtattatatcgataatatttacattattacaaaggcacttaaggcctgacaatcaaaaataaacagcagcggactagcgggcctactgctccatcttcacaggcgctcaactggggtataagccaggactccacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattt

SEQ ID NO: 13203 - DNA, 5158 bp, Oryza sativa
cccgggccgcatttgaatttttcttatacgtattttagtggtttgccaatttctttttcaatttttaattaattctattattccttttaaaaaatgatttttatttcgggatgaatttatcaggacgtgacagttagaaagtattaagtatactgcccctgttgagtgtactttttgatcacccgtatagcgaacggccttggagttattaccaccgatcagatcgagtatatatccactgtccgtccctatgaggatgaaacatacttagtacaagggcatatacttaagcatggagccgatggctcattgatatactttttccccggttgtacaaatgaaatcccattacccaatgcggggtatcatttgtacaactgtcaggaactaaccattcccctacagaccatagaagaatcttgtgcaggtacatcttacaggaagacacgcaacagaccaaggcaagagcatgaggagtcatcctcatcgatacctgtgcagatgtacgaggcggactgggagccaacgggagatgcacccggttggacccaggcaccacggcacagcaccggtggttcttcctggcacagtgccaatgagaatcgctggcaagcaccgcacgacgtacactgggggaacgcgcacacccgttcctctggatcaagtgggatgcctcctgcttccaactggtggcgctcgagttcctctcgggacttgggttcctcacgatgaggctggacaccctttatatgcaggcgggtgagaatggcagcaaaatgctgatgctcagttcgtcaacatcaataacctgatgcaacaatagcaggctgatcttcaagcatactttcgcttccaagggttcaatccctacagggacctaagtgaagggctcaattcctttccaattgcatatttggatttccacattgcatcctataaactaaaaatgacataaaaaaatttgcaaaatagaaaataccaaaaatataggttagagtttattatgctaggtaagacaactagttctcttgttgagatgatgaatagtttctctgttttatatctcttatatatgggttcacggttaagtacgctctcaaagattgaataaatagtagccacatattatccgggaacctgaggtaagtgggctgcacttgccgaactaagtctaggttgtcgcgagatgatatagtgataagagttgctatgatcctgttctaagtttgacttaaattccggatgttttattttccaaaatgataaacttaaaagttcctcatttgataaaaattcctaccagagccaaaaattttcatatttgataaaccatatatattttgggcgcttgtacttccattgaactttgtcaaaatcttgagacttgtgtagatacttttcatactctatgatcaagatcatacacccacatatatgcacatgcaaacttctgcactagaagttagcattcattcattccatctatatccatcatgctatcacccaaaatcaagctctccaattatatgctttctccttccaatataatatcctttccaaaaagagataaaaagagggaaaggcatggttaggaaaataaagtcttgctcctcaaaatattgagcatgataaaaaaaatgagtagccatgccccttccaaaaaaagaaatgaatgatcttgggagaagaaagaaagcacaaaggagaagtatttcctttttttttccacattctatttccaccatatagcacacacactttatgcacgatcttgatcttgagtatgtctagtcatctgctctagtctaagttttgacttagtaataaatgcaagtatgctatgtttgatacctaccaagctccacatactaaaccttagagtaggaatcaactaggctacttggtgaggaattcatttatatacactctgagtgatcgagagggtcatttgaggaacttggatttcttttgaaagatcatttgaaaacttccggaataaaaggttgaataaataatgggtgactagtgcttgattgctgttctatcttccaaccgcacaagacaaggtaaagcaatgtctcgcgggaatcagttgtaagggtaagacacgtgtcaaaattatttgatttgagagagtatatctaccttgcacttgtacatttgagaatatacagcatagtagcaactcctgatcaacaatcaagttttgtttccttttgtcctttactcgagacgagcaaaggttcaagcttggggggttttgttgacggtcgttatcgatcagttacgtccgtcaatattactagaataaaagaactagttatgcttgcaatgcatatagtgtaataataaaataaaaactactagtacttggttcactaaccctctgcagagaatgggccataaatggagaaaaatcggcatcaaaaccgtacctctggtgtcttagctttatgaggtgcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcaacggatcctcatttcttcttgatctttaggaaattcatcatgaaattgctgaaactgtcacgcccggaaaatctatctaaaattccgaacgcttacatgtgtgttaaaccctcgtccaggaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcaccccccttataaacaaggcatggactccccagcgacccccgtggacttctcgccacttctcagtctgacgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaacattaatataacatagtttataattaatccctttaattagctatgtttctaggcatggctaagcaaacttacatatagcatttagctgaaccaatccaatatataaggttcatgctaatcaaattataacccataggaaaataaagtcatcttcggccattatttaattgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaaaggaaacgctctcctccggaacgtcggaaactaaagcaattaaacaaaaatcaacaaaacagtacaaaaacaagcataaacagtacatgtggatatttttaacatgtaaatcttgattttagaaaaatttaacaacttgaaccacctaaaacggatctacggttatttagttatgattttccgaagatttaatctattagaaaatcgggaaaaagaaaaaccgatgacgtcatgctgacatcacccaaggcggccgaaccacgatggcgacctcgccggagatagagcggccggctgcggaattggagggcaagaacacgtagaggacgacgagacgaacccaacggtactcaccacaacgacaaacgacgtcggacgacttccggcgacgacggggaacgagcggcggctcgggttgaccgacggcggcgagctacggcggccggcgacgaaggggaaagggcggccgagctactccttgctcctatgcacctaatggcggcgagaaaaggcggcggcgatgacgcaagcggcggcgcggcgcggctgagctccggccggcggcggcggcgtcttgtcacgcgcggcggcggcgctacggagcactagagaccacgagagagggggcaaacgaaagagggcgacgaggtggtcctatttatagccttggattgaagagatcggactcctcccgcaagaaatcggtccgagaaatcaaaaactcggttttggagataaactcgaaaacgagtttgattcagataaaatacccaacgatttgctccgattcttgaggggaaagatagaagagaacgagaggatcaaaacccctcaaaaatccggaagaaatggggccggattgggtgcggatttgaggcggcaaggcggcggctcgggcggctcgggctcggcctgtgccggccggaggttagggacacacccgacaggtgggtcccacctgtcggcggctgaggggaggaggggcgggcggcgtcagctgggccggcttgggccggttc

SEQ ID NO: 13204 - DNA, 6941 bp, Oryza sativa
gtttttgaactttttaaataaaataatttgtgaaatgttgtttcaattattaaaaaaatacttcccttgctcaaataattcccagaaaattctagaaaatagaagagcaagcatagtatttaataaattttatctagctcacttttatgttgaaaattttcctagataattaggttttagcttgtaggcttttaaaatattttctaaaaatcatttaaacaatgcatttttaatttaggcgatttttagggcgtgacagcccagtttcaaaggtacaggaacaggtgtcttctctttaacctgccatacctcctttgtttttggtgcggtcaatggcttcttcgaaactgggaacgcaggttgaccgacctgtgttcctggcttcttgggtgccagcctaaggtatcgacggatcctcatttcttcttgatctttaggaaattcatcatgaaattgctgaaactgtccgtctttcggggtagaccttgacctccttgtgggtttggtccgtacttgatcttccccatggagcaatgctccatccttgatctccttatggacgatacccgttgttgctctcgtgagcatgagtccttacgggttttcggatgatccatcccagtgtgactggcattgccacggacctcacatgtcatgtgagtccagggccttaacagcaccctgcttggcgtccttctcattgttgtccagtctcttaataagaagatccaactgagtggccagcatttccgtcctcttgacggtgtgcataccgtattgacggattcggagtcgttcctcgctccaacccatatttgagaccatcttctcaatcagctcggtggtacctctgaccgtctttaagaagaatgtctttccaatagcagtgtctaggtgatcccaagatgagggggttaatccattgaaaaaactctacaggatgagccactcgtccatcccatgatgaggatgggcggtgacatattcctgcagcctttcccaagcttcaggagttgtttcatccttcggctgctgaaagctggatattcttccacgaagagcgttggtctttacccatcgggaagaattttgagaggaatgccgttgagcaattattccggatattcacaattgcatagttggcgtagaaccactgtttcgctttcccgaggagggagaacaggaacagtcggagcctgatagtatctggagtgactccgtgctacagattttcagcaattcctgcatatgagcacttgcatcctcgttaggattgccacagaaccggtaaacctgcgccatcgtgattaggctggtcttcaaagttaccatctcccatgctgacttagggtccaacgggcacattgtcggcggagggagctgcgaacttgcggaggatcttcccagccatatcgttaaactctagtggcacgaaaatggatggtctggttgctgatagagtaacttgaggagggacaacacggggtcgaggctcgctccacaagtgactcaagattgaaattagttggcagatcagaactagtcttgtactaccctgttttcacataaaagagaaaacatacaaggtttgcctacataggatagtgattatacagaggtaaatataaaattattagcaagtagtaaactctgaatgatttatcttccccgacaacagcgctagaaatgcttgttggtatttcttagcgacagtactggaaatataattctcagcaatagcactagaaataatcccggtatactatggttacagatatgatccgcaagcgcacgaatgtaccattgtagcatttcacccggaagtattctaaggtatcgtatttaatcccaatggaagatatgataagagagaattatactaataatttatatattagttgtgtacattaaaataatccaagagtagagtaacacacagcaaaagacctagcattcttaataatcatcaagtatcacattattcacattagtgagtagtgtgggactaatcacgaaaaacattgctcaacccgcccataaccgcgggcacggctattcgaataattttactctggacagagatgtaccaccgtacccaccatgtgcgtcaataccatcatggtacctaggaaaggagctgtgacaatacaccccatacaacacaactcaccacagcgcaccgttcctggatcgtagtcacccctttataaaacaaggcatggactcctcagtgacccccgtgggcttatctccaccacttctcagtctcttgccccgtaataaactatgctatacaaaaggtaaagctgttgcccacgctggcttgtggttggcatggttaatgtttcacaacagtagctcgcgaaccggtccttaattgtcatgagcacgaccaccaaaaccatgtgctcacaacccaccattaatcaagttttaattggcaattaattaattaaccaaacacgattgaccaccgtgtgcaaacattaaatagcaatcattaagtaataatgaagcattagttatccccaatagttaactaatacttctaagcatggctaagcaattatatctaatatctagctgaaccaatatataaggcccaagctagtcaaattataacacataggaaaataaatcttcggccataatatagggaaaaggctcaccacccaatgacattcgaaaataaatgcatatttgaaataaaaagagaatttaattatatgttcaacatgctcaaaggattgtgtttagtatctgtgtgacttgccttgcaataatttcaattagtcttctggatcacttccgatgcactcatgatccttccaaacgacgaaaacgacaaactaatacgcaaaacgaggaaaaaaactaaggaactccaaataaacagtacgtaaaaagtaaataaacatgtagaccatgattttagatgaattatgagacttgaacggcctcattctgacttccaatggattaattatgaattttacaagatttaatacaattaaaacctatttaaaaggattaaacagattaacaacacaatttataagtaattttaatatagatctctattttatacaaatttagcgacttgaaacacattaatccgagttataatgaattagatatgatttttctaagtttaatatgatttttgcctaatacagaaaagactttactaatttattaatgtattaaataaaaggaaaaagaggatgaaggacggtggctcgggaaacgaagttcgccagcgatctagggcataagggcccgaacggagggcactaatgcgaaaagtacaacgcggcgaactcaccggtggctagaacggccgagattgacgacgaacggcgacggcggcgaggttttggcggcggcggccttcgggtagtcggcggcgatggtgctccggcgggttgcggcacaaacggagggcgggacgatgtcggcgacggtcacgcgaacccgtggacgtgaaccccgtgcgactgcggcgaccgaggctacggcggcgctcagctgaagcagctccggcggcggcggcgcaaaagacgacgcgggaacggcgctagagggggcggcgggcgaaggtggaggtgatgaggggtagaggagtcccagggggtccttttatatgggtcaagaggcaccggggagggctatggcaagccggcggcgacatggaaggattagcgtttgattaggaaagagaaattcgaatccgatttgatttgattaatccatgcaaaattggactccaaatcttggggaatgaaggaggaggatatgggaaatatttcccctcaaccaattttggaaacaaagcacgggagagatcggatttggcgagggggcggcggctgctcgagctcggctgggcggctggaggttgaagaaggcactgtagcgatagggagtcacactagactttttctgcggtttccttcactaggcccgattgaagaagggacacgaatcagactacgacagagagagggagagggctgctggatcggcagggctgaaggagagagatcggccagattcagcccaaggcatagaagaggattttgattttttttttcaatttaaataaatgctgaaatgatctttcatttattaactatacttccaacgctcacataattccaagaaaaatcctgaaaataattggacactcaaagtattcaacaaaattataatcagaccatttaatgattaaaattaggatttagtatttatataattgctaaaatgctctttgtattattaaaattaggatttgagctccgaaaaatacgagaaaattccagagagtataattaatcgtagagaatttaataaaaattaaatctagccattcttaacatttaggaaattttatttcccacatttaactttacttgtaaattaatgaatatttaatataaattgtagaaataatttattaaataatttataaatcctgaaacgaaaatcagggtgtgtgttgatgcgaaaaacacacactggcctgagatatgcttaactctagtgcaggtccaaatcttggtttcgagttcgagggtatgccagttggtttgatcctgcaaccaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaactaagtgattgggatagatcggacagcttgccgagatagtataaatcacttatgtttaaaagtaacttgaatcagatattatatatgttcatagcatagccggtgttttagatctaacatgtatcggctaatactccgataccactttatactaagataacaatataaacaaaatatattaaacagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacagcattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttttactataataaccggaatgccgagtagtgactgtgagagataaccataagatagcttgccagtccaatccgtcatatgctggtcaatccacatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcgagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagcaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatataatcccatccataataatccatatttggtgctaacataactgactaacacatcaagcattgtccataaccgaggacgcggctattcaaatagattatactctgattagaggtgtacaactggacccacatgaaatgaacaaagatcaaatgctacacaccccgtcgagtgtggtacacaagtgattcaagctcattacatgcccattcttagccccaccccaaccacctataacatgctggggttcccgacgacttagtcacgtgcgtgcatgatgtgaccagtggcagtagggtataaggacagcaatatcacaagaactaaatgcataaataggttctacccatacaccataaaccgataatattaatatctaggcaatgcatgcatatatatacgtatagattgcaaccaaatcatttttagagaaagtataggttctatatgcttaggtgcttgccttgctgctgagggtagtcactatcatcctctggatatggctcgttactctccagaatctccgaatctatcgaaaagaagcaatat

SEQ ID NO: 13205 - DNA, 8501 bp, Oryza sativa
acggtgccaaacatttcgaaacggagggagtacattacaattaacatgcatttcaaaccaagatttcataataatgattatttttagagtaaagtacatcactcacaggtcctaagaaaaattatttcacaaccataagtgttgtcattatttatttatggattttacaagttaaatcataggaatgctaaataaacttctaagcatgatttaagaggtagttttgtcaagatcttttccacagaagtgaagagtaccattttacaagttcaacaaaattattttatatttttatcatattccaatatttacttatgcattgtccaagatctagactactaaaaggatacctagatctattcacaattttagaggaaaaaccagtacataagttagccatttttattttacaacattgtagatcacgtttttattaatccatagaaatttggttcagctcaaacggagttcagatgaattttctacacatttttgaagttagtacaatttcagcacatgttgaaaacagttttccattaagagtcctcgaactttctggatattacagagtggtcaaggctacagtgttatgtgtcttggtctgttttttgggaaaaaaccctcaagtttatctaattcaccgatgaggtccctggctcgagctcacggggaggcagccatggctgggctcagtctagagcttgccgacggcgaacggaggctcggatggggtcgagttcaacagagaaactgtagaggaggaccatgcgaacacgtaggtgtccgcgctgatgaacaagctacagctacagcggtggtctgtagctcgcgaaaaacaagctacagcggcggtggttcttggtatgtgcatgcgtgtcgagctacagctctgaatgggctatatgggtgcatgcatggggtgttcaggggtatgcagtgtctcaccgtgcagctgaaaggggtcggagaggtccaggaagcatcgacggcgttggagatgcccggcaacacaatgaacacgatgaggacccgagaacgactagatctggccataaaaaccccaaataaacgcttgaatgagctagaacattgcatgcagagtctttttggccaaggtaaaggatctggagctcaccggacagggaggaacaaagccaacgtgtctagatcggggctgaggaaagaaggcgagcgttctccacgcctggagctcggcttgggctgattcttgacggtgttacatctgggaggaagatgaattagaatgagcagcaccaccctgtatctcggcctggaacgtcgggaacactggaagcttgggtgacgcgacgacaccggccgcgctccggggctccaaaaagagatgtgcgttcccggagattcactgcatgaaaatcgatgaaattttgaggggagttagggcatgcataggagagcagggaacgagggttggacggcgaagaagacgaccagaaacacggcggcgacgacgaagttctctcggccagcaaggaggaagaaggaagatgggggcgaaatgaggtgctctcaccttgcgtttatttctctggaagggagtgggaggagtggagaaagtggccagaagcttagaggagaagggagagtaaagagagaggtgtcacacttgtctctctcccttgcatggccaaaacgtggcatggctattcttctgcttgtcccctgagtatgagagggttgggccactgccatgtgggccagggactgctggtgggatccacatgtcaaagagagaggggttggagaggaagagacaagaagaaaagacaaaactaagatttattccctcttctcactcatgacctgctaattcgaattgcttaggaggggattcaaattttggcctctggtccagagatgggtcttggaacatgctttctaatccaattggtttcactaaaaaatgttgagttaaataattctagtgaaaaagtgaattcagttaatctgaaagttagtttgaatttttaggaggtctaaaaagagaggaaaaattccacaaaatttatatttgttggtgataaataaactagtatttgaataaattattaaacatgtacacttctgttcaagttattgttcaaatagaagtggtttcaattttaccgattagagttaattttgttatcgcatatgatcaaattgcaatatagtaaatatgcaatctaaaagacaacaaatgcacttctaaatacctggttatgagctagggctattacaagattagagtatcatgaagatagaaccactaatcccgagaacacaaaccgccataacaagttttaccttgtcgtcggagatcaaactgatgcagcccaactcgaaagcaagaactcatcgaaagtaaacgaaagtgaaaggttggcgatgcgtcgaaagtgttattgaactgattgttactttgttacactggttttgggctacttttatacccaaaatacatgatatgcccttgtcggacacgactcctaactctattacaacttaggaaacaaacaagtccttaaggtggactcttaccgactcaaagtacaagaaaattatataaaatatcctaattaatagatacaaattaccttcttaggactcaatccgtgcgtggcaattgatatgaagcatatcaacccaatccgacaatgtttctatcgccatattgtcggaatcgacttcatcggctaccctgtccgacttaaactctaccaatgtagattgtagccgattcggaccccagccgatgtgtactctatttccgaaactgttaattccctttgattctgcttcggttttatctccaattccgatacttgatttaccaaatttggtcgttaacagtgtgacatgagttgccttgggagagtggatatgctccaagcatccaaggagcatattctccttagcttcatctctttgtgacatgtgtccagtgacgtttcttcagtttaaccggtcataaccgccttgggacaaggataactaccagctgatgaagaattgggctaattgggctagctactggttcggccgaaccaggccgaaccctggccaagcccaatcagcccacaactttgtaggtggacttcttgttgattcctcaatccactgatgtgaattattaggcttgtttactcatgtgaattctgtattattagcccatctgtccacaagtttgcttctcgatggcttccgattgatcgttcgtttgctttccgtcgattctcctccatttatatgtgcttctcctgcatacatgttagtagcatagtacatagtggaaatagacattttaattggaatttatgcattgcaagcatagctagtcttcattaattgggtaatatggacggtcgaaattgttcgataacgactgtcaacagtgcctagtcctcactgtagccgatatgaatagagatgagcctgtgctatcggctgcagcttatttctagtccaatactttgaatgcttttttattcaaccaaggaccaataacatcaactctcctggatatagtcatgatcatggacttagacatcacatcatcggctaacccagttagtatgaataccaagggcaaattctcttacaaaactaggagcatcggaggttggactggcttcatcacccagaacatgggaactggttctgtaacccctaaggaacacacagcctttctaatgatgtggttggaaaagttcttgttctgtggtccaagttgtggccctactaccaactggcagcacatagccaaagcccttgtagacaagaagcaattccccttgggcaaatatctgctaggctcattgtatcaaactctgaattctgcatcggctaagattgctgtagattctgtcattggcactggtggcccttggtggcttttgcaagtatggctcaaccttcataccatcaaggtggctaaatgtcacaccccgaagttctcctcccaagcctaaatttaatttataaatgaccctaagaaaataccggtgcaaagcaagagtaaaccccttttaaatcaatgcaaataataatcggaattggcatgtggaatttttcttgagttctaaatgtcgaaattcactaacaggatttttagtggaattttcagagctcttgaaataattttaaccaattaaaatggagcaagcaatattttaattccagggaaaatccttttctccttttttatttttctttttccctccctttttcgaatgggccgctggcccatcctctcctttcctccccctcctccctgctgggccggccgcaggccgaggcccagccaagccgcccctccctcctctcccggggtcgcgacaggtggggcccacctgtcgggtccttccccaacctcccgccgctcccgccgcgccgccgcgcccacgtctccgcctcctccgggccacgtcgaccacgcccgcgcgtgcgccgcgttccccgcgcccactcccctctctctcccgttcgcgcccgcgcccgagatggccgggattcgattttcgaatcctgcctctctctcctcccccacttcccccacgttggccggcgaaatcccgcctctcccggccacgtccggccccctctctccctatttaagctctgccgtcgccccctctcgctttttccccatttcgccgaactctcccgagcctcccatcgctcccgcgccgtgcaacctcttgccgccgctgtttccgctactccggccgccgctagccgccgctaggctcgccgccgcaccgcgccgtcgccgccgtcgggttcgcgtggccgagatccaccccgtccacccctccttcgtcgaggtccgccgccggagcgccattcccatcgtgcgacggtgagggttgccatgtccgccgccttcggccgacattcccgtctcctatggcccctctcttcctctcttatctctttcctttcgttctttaggtcgtcccggtcgccgttcgccgcgtgtcgacttccctccatcgctcctcgtcgccggtcgccgccgtcccctccggtgaggactccctcccctttcctttccttccccgattccccgtgcgtcgccgccgctcgcgctcgccgtcgccttcggtcgttgccgccgtccgctgccgccgctttcgcatcgcttttgcgccgtcgcctccgccgccggatgccgtcgccggcaacgcgttcgcgcgcgcgtgccgtcgccgctagccctggccggccggtcggctttgatgccgagccgagcccggcggccgcctttatcgccgcccgtccaatcggcctgagggcgatctgggccgtcggtcccgtggaccggcggtggaccacctgcgtggtcccggtccacggtgaaccgcccccctgagccgctgaccagtgggccccgcttgccggcaccacacccccctccgtgctgacgtcagccctgggaattattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagtctgtttgcaatgtttgccttgtatgtcgctagattccggttcccccgacgcttcggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggatgtttacctattgtcatagccatgctattgttgtaccatgtccctttgtcagcttggggttataacatgactagagattggactagggattgcttagccatgcttagttcaactagttcacaaatggggaagatcctattaatgtttagactgtcggttctaatggtattgttggattagtgccaccgctttggtgttggttaattaaaataaatcacatggtgggctgtgggtgcatggttttgctggtcgcacccatggcagctaaggaccggttcgcgggatgccctggaagaacttatcgtacatactacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgctaatagtcctgtcacgacctctttccggtatgtcatggtggcatgtcagcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagtgtaatcttttgaatttggatagcttaggtggatggttgggcctgttgcaacgtgggatagcgttggacagtggatagttaatattaattaattattacaactgtttaatctttcaacttctgtttataaatgctcactatatgcaaataaaccactttagctcttctttgatgattccctgcatcatgcctctattccagatgacttgctgagaacagtgggtagtactcagtcttgctctaatttttcccaaccccagagcacgagtatgtgtcatatgaaggtttctccaagaagtaggcttcgtccgtgccgtcgaggatgcctgtggagtggtgttcccgctgcagttctagtcaaggcttagctcctgttgtctttcttctttccgctgcatttatgtaagactttcatgatgtttgtaagacgtggatctgaatgtcaacattgtcgtttgtgtaccccggccggtcctggacggggattttaatgcacattctgcttggaattctattcgcaaatttctgggcgtgacactaaaagaccaactttatctgaagccgatttcccatctatcaatgagccaactgtagttggcgagggtaatgagatcacaagccgtcgatgcatgtcttttggagaagcaacatctacctacaatggatcagagctgtgggttgacctcttcttaaatcggtatggctacttttatgatggattttccaaagaattccaaaatttggttggctaatgaacatgctgaaaattttgaattccaagccaatttcagatttgatgagatcagccatgaaagatttgaaaaatccagagaagtatttacagctgccatatccccttgcatacttcctgtcggcatccaccaagacagaaatattcaagtttcatatgagttttaccatccgatgagcacggctagacaacttggaataggtcagctatcaatcggcttatatttcgtggacaagatccagaccaggggagaaatcacatcagccctcatgatggatagactcctgaacatcccagggcccccactaggcagtatggataatattgtgctagccttgatgaggagttcaacttttaaccgatggtgggcagagtggaaaaaacatttttttcaccaatcagcttccatatacctgactaacatgttctgagagatggttccgcaagtaagtattcttccttttgtcaaattctttattgctaaccgatatctcttgatatttggccacttcaattgtttgcagaccacggaatcttcacctcctcatactagccaaagtggagaaaccatctgctatgtcgttattccaattttaagctcattcaacctaagtcattttgtgatttagaagtatcttctttaaaattcaatgaagaatacaattcttagtaattaaatccgattatttaccgcgaattaattacttatagagattacccaaaataatctataattatataaaattttgcaattctacaactaaaagaaatctacaactaaccccaattattttaattttctaaacctccttaatctctccctaatttcaatttacctttcctttttcttttttctccttcatttctttctttttctctctttttctctctctcccggcttcttcttccctctcggccctctgcctacccgggcggcgacgacgaccgaacaaggggagggggcggcggcttaccgacgacggcggcggcgacggcggcggcgacggcggcgcaaggcggggtgacacatggcgcggcggcacgaagggcgcggcgcggtggagaggaagagaggagaaaagaggggaaaagggggtggggtggtgtgggatggaagggcgaccgggggggagggttatagcgcgcggggaggggcggccggcttaatggcgacgcgacggcgcggcacgtggggctcgagacg

SEQ ID NO: 13206 - DNA, 7060 bp, Oryza sativa
gaatgatgttctctcgaggtcttaagacgtttcattatgttcattgatgatttgaaatataatcacttcatcttttcgaatataatggaaggtcaggacagcctacgacagcattggtatcagagcaagtaccgaccataggaaacccttaagttggtcgtttagaatggattcttaaaattattttgtgggctttgctctcagttacaaattatttgcgaaaaccatattcaaccttatatctcacccttctccagagattactttcccttatgtttctactttgaaattttgaaaattcttatcttgtctttaggatcgaaaccttttaaaagtttgcatctctataaaattgagtttgaaatcacctgttaatctcaactaatcagtcaaaatgtttcgaaaagctttgaaatctatttgcaaactactcctatgtactagcgcggatttgcaaaaaaaattctggaatttgtcaacagttgcattcaacattttgtgtagcccaaaccttaattgataaaatgtgcatcttttcacagtagattgcatatcatggcataaaaattcatatagtaatgcgcagtcccaatatgaaaacagtcggtaacccggttgaaaaatttgtgtagcccaaattataagtgataaaatcttggtttctttaaggtaacttacaatcttgcatacccatcaccccgatttttacccaaagttttgagccttcagaaccttactcaaatattagacgaagacagtaggccgacacattacagcactgcatcattcatccaaaacactgcccgtaagataaaccacctcaccaaaaatcaccatttcttcttgaaccatagacaaatttgttaggatgtcaaaggtaaaatttttcatagcttgtcaaccctaaaacgtagcctttagcttcagcttgcaacactaatctatgaaggactgcatctagcacaaaagttggtttacctcccatctatatgttttgttaataagacctagaacaaacctttattctattttaagggggatagtgtaccttgttcatgtaaacctagaaattaacatgaaaccatttaaaagtaataataggccaggagataaaatcttgaaattggtaaaatgggaatttaattctgactagctagccttaaagaaatggcaaagtatgtaaacacctaggttctttcactaatcctcgttctttatttgttcttgtagatgcctaccatgtatacgccattctactactgcagcgggttcacctggaaactcaacttagcacatgctctggcttatgctgcaatatgcccgtttcacctatccacttgagtaccacatagtactcaacaagtccattggtacctcccaaactgcagtcatggctcgcgtaagcattcggggtagaacacctttagaaagggatcgccaatacactggttatggttgggatagtaagtctgctatgcaaaactgtgcttatgttgctattacccaccttcgctgtgaattatctgagtgggaggaatgaagtcttgtgattttttctctggaagcttcactttctctattgccattctcacttacatatacatgggatgggccctcttcaatagatgggccagcacacaagccacacacacataactagtatatttacgagcccaacactccccctcaagatgggtgatagatatctatcatacccatcttgtcacatgaacaattacactctttaacacttaagccctttgttaaacaatcagcaacttgtccaccagacgttacaaatcctaattccaacactccctagtctagtttttccttgataaagaaacgatctatctccacatgctttgttctatcatattggactggattattagcaatgttaatagctgacttattatcacacaatagcttcatgggagtgttctccaaaattttcagctcaactagaagatttcttaaccacaacaactcacttaaactcactaccattgccctgtattctgttcagcagttgagcgagacacgcggattgtttcttgcttctccaagataccaagttgccaccaacataaacacaatagcctgaagttgaccttctatcatcaagacagctagcccaatctgcatcacaatacccttctatcttaagatgtccatttttcttaaaccataagcctttgcttggacttcccttcagatatctcaagattttataccccgcctccatatgaccacttcttggatcatgcatatatcgactccccatactgacagcatatgctatgtcaggtcgtgtatgacatagatatatcagtcttcccaccaatctttggtatcttttcctattcactggatctccagactccgcacataacttatgattttgatcaattggtgtagagactgggcgacatccaagcatacctgtttcactaagcaagtccaatacatattttcgctgtgaaataactatccctctaggagatcttgcaatttcaatacccagaaaatatctcaactggcctaggtccttgacctcaaattctttgcttagattccgtttcaacctagttatctccaagcaatcatttccagtgataaccatatcatcaacatagacagcaagaatggttatatgatctccactatgatgatagaaaactatatgatctccattacattgcttatagtccatagcacacattgcatgcctaaaccgatcaaaccatgctcttggtgactgtttaacaccatacaaagatttcttcaatctcaacacctttcctttagtttgtgaagtggcaaatccaggtgggacatccatatacacctctttttgaagatctccatgtaagaatgcattcttgacatctaactgatgcaatggccaatcaaaattagctgcacaagatataagagttcttaccatgctcatctttgctactggtgcaaaagtttcatcataatcaatccatatgttagactatatctcttagccaccaaccttactttgtatctttccacctttccatcaggattttgctttactgtataaacccacttacagtcgacaattttcttcccttcaggaaatggtacaagatcccatgttttgttcttttcaggagcctctagttcatctagcatagcttgatgccacctgggatcttgctttgcttctctccaatcctttgggatttgcactgaatctagtgatgctacaaaggccttatatgtggatgacaaggagtcataggaaacatagtggatatattattttcatatcaccctcatcttgagcttcaaaaccataccttagtggaggtttacctgcattgcttctcacactctttctaatggcaattggtaagtcagattcttctctaacttcctcttcttctccccctgactccaaagatccttgctcacggcttacatcttcctctacctgattatcctcttcaacttgttggattactggacaccttgttctccttgtgtatacttgaagatttttctcttcatgtggcttcctccattcttgctcctgtgcaacaggaccacccaagggacatggaattcaaccaaccacaagcttttccttctttggttgttcatctccctttggacccaatatttcatctttcatttagtgaccatcatgaccactagttgaatcatcaagatcaatgaataaagaacttaaatctgtcttctcaccatagaatgggacagattctctaaaagtaacatccatacttacaaaggttcgtcgttctaatggactccaacacttataccccttctggccagatgaatagcctacaaagatgcatttgacagcccgaggatcaagttttccaatggaaggtctatgatctctaacaaaacaagtgcaaccaaacacttttggtggaacaacaaattcattctttccaaatatcatctcacatggtgtcttcattccaagtattcttgatggtgtgcggttgataagataagttgctgtcattactgcctcactccacaagaatttaggtacattcatagtatacatcaatgagcgggctgtctctaagagatgacggtttttcctctcagccaccccattttgtggaggagtatcaggacaagaagtttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaggccatccttcttccctggtggcctttggatccaaataccaaggtccttaaggccggaggtcaatcccaggttttttcccggtttccttttcttgaattaaccaattttcacgatcaaggaagaccggccaattcatatgatccccaagagaacttatggaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtttagatgcacccgagtcaagtatccaatttgaatgagaactattgatagacataaatgtttggtttggttacctgaggaagaatgaacaagattggcaacatcaacatttgtagatccagaacaaccctcttcaagagtgaccacattagctctgtgatcacttctatactcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtaggaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttacctccccagtaacatatgcttctaacccctttgtcttcaaaatcaataaagctcttcttgaccaactcaaataattttttacaccctccaacttaatgtcattttgcatcaactcaattttttgcaccgattcagtatgaggaaccactgcactactcgtagttggagcctcattaaacttctttgtaagcatctctaccaatttacccattacttgttccagtccctgattttcccccattttaatcaagcaatacttgcagtagaaagttccttattctcaccttctataagttgtagcaactccagcaagcagcagctacacaggcaccaaatcctcccttttcctttcaacagcaacagcacaagcacctcacctcctctctgtctcctccctttttttcctttcaacagcacaagcacctccgtcgcacagctcttctctgtctcctctcacagcacaagtaccaaatccaagcagcagcaacagcgccaagcacactaccaacgcacagctcttctctgtctcctctcacagaacaagtaccaaatccaaacagcagcaacagcacaagtacactaccaaatccaagcagcagcaacagcacaagcacacttactcactccttccttcacaagcacaagcacacctagcactgcagccctgctccctccttcacaccggccgcgctgcagcagccgtcgccgtctccggcgtcgacgtggcctctccgcctcaaccgtcgacgctgccgctccacctcagcagtcgacgggtgcagcactcctccgctcacagcgccgccgctacacgtcctccccaacaccagcgtctccctcctcgacgagctccggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacagataactagtctatttacagcccaacaaggaattctatacctaccttccatctttagctgagggggctgaacacactacctacccagggctgaatgagataggcatacgtttgcacaccccaccccttcaagtaagcaggctttgttcgtgcgctagatatgctttatcgctcca

SEQ ID NO: 13207 - DNA, 9200 bp, Oryza sativa
agggaacatgtgtgctatctccggttcaggttcaaccaaggacacgaagctattaataggcaaaggatagagaggtttctctaatgaagaacaatgtacaaggaaatgttagctttaatcataatgcggtacttcggacactggccagctcgctgctcccagatatcgctctactgcgcacccggacagggaggacttcagtgatcttgaaatgttagctttaatcataatgcggtacttcgggcactagccagctcgctgctcccagatatcgctctactgcgcatccggacagggaggactttagtgatcttgagggctatcatcacctctacacacacctcacacctactgtgggatgcggagaaaacactctgcgtctaagcagattaattacttactttaacgctagctacacactaaagcaaatcactatattttaattgagtataatgaatgatgatcccgtactctaattaggaaataacaagaaataattctcaccgaacaaaactatattactcaaaagatatttctattatagccagagtaataagcagagcagaaagtaaagggacaggattaccgacaactccggaagtcctccaacttcttctactttattctcttcctattctaagtatacaatatagtacaatagagtctcttataattcagctcaagcttagagtatgtgagtgaagtgaagagcagtttacaatttcacatactaaatcgaagagcagtttagtttcgtcacaaccagttttgggcttatgtacatcaccaaactgacaacagcgcatcatagccaacttgaaaatctacgtaagcttgtagcatatattacaaataaaacatgaaatgggttttaaaacttcacatgaaccacacgttttgttctttttatttacgggaaagtgttgcctgaaattctgaaatcacaagcgatgccagcatagcacggtaaaaaaccctaaccactaagtattgcacaagctttaaaatgtaacatcaccttctgcaagcagaaaacctgaaaaggctgaatcttgcttagagattcatgagaaacaatcaattgttttgctttttgcaaggcttgtatctgaacaattcatatcaacactgcaaaatacaaccaaaaattgatgtccttctcacagtgaggatttcaaccagcagcagcactagcccagcagcaggaggccagaacggtagcagcagcagcaaaacggcagaacaaaaagtccagaaatcccaggctcaactgaatttccaatacatcatactattttcagcaggctctggacatgcacaaaaatgacaacggctagtgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaactcaaggaatttcaacttaaatctgggataaaaaataacaggaacacaaatctgcaggaactgcagatcccaatatttctgaaattttgtatccattttaaaaaccatgctagcgacaagaacatcctcactgttggactcatttagaagcatcaccttcactttccaaaattcatgaaagtagcgagaaacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgacttgtgcaatgatttcttcaaatttttgctcacatgcttctgatgcttttatatactttacactttcccttatcctagatatggcaccactgacagtactcaatccatcttgaacaataagattaaggatgtgagctgcgcaccggaaatgaaatagctcccctttgcaagacatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttcttgcaaaacaagcatccttaaaagttctgcacgtgctacatcaggatcaaatttccagtcctttagaacagatgcattaggagatagactggaatgcaaactttcaaccaattgttgcactctaattctcagtggacacttaagtaaatgtctatggcattgacttgtccccgaaccacggttagctttaattaccttactgcaatgaatgcatttcccatagagcacctttccagtagaagaataaaatggtttaaattctttccagattaaagatttgagtgttcttttccctgaatcattaaatcatatctaaaattaatctattgagcacaaacaagaacaggatttgtgctgggactgaactaaaagtttctgctaaaattatactaaaaatttgagctgaaactgaactaagagttgtactgaaactgaactagaaacttatgctgaaaccttaactgaactaaaatgtgttctgaaactgagataaaaatttctgctgaaactgagatgaaaattttcttatgaaactgaaccctaattttctgttgaaactgaactaaaaatctctacagaaactgaactaaacttctactagtaaagattcctgatgaaagtgaactaaaaacttctgctgaaactgaattatcttagctacatgaataaacaggggctaaatgaccaaatctccaaattcagaattagaattgcaggtgcacaaacctactaaaactaaccacagaatgtaagtttaatttgtttgggtggaagataaactacagaattatatatgcaatacatcaagagtaaagaactaaccagaacgatgagtcacaacatgaggtgttgattgagttgactcccttggctgagtttcaacatccagctcaattgggatagcagacggacttgatacgaaccttgccactggagacatagatctagctcttggagactctgcacttggggacatctgaccagcaacttgtgatctctccatgatgacttcattttgggaaataatttgtcgcactcctggagacctgactattggcaatgcaataggtgatcgtcttcgctttgctgttggaggattcgatgctgctaactttcgttttgtagccaataactgtgttgacgatgataggcctcccgaagagccctctgcaatgacctctttgatatgtcctccttgcggaacttcagctaatgatgtcgacatgggagaaaaccaaagtactgcatgtagaacaagatggacaaaattttaaataataaattaccaaaatacttgcataatatatgaacctcagcccatccactcggaaatcaaaaacttcatgacaaactagaatgtgccaaactgaagaccgattataaactaaaagatatgccaaactgtgcgctagtactccctccgtcccaaattataaggccaatatttttttacacggtcttcaatgacatactttgaccattaatttattttatgttatgttcccaacaaatatgaaattagcttcacataaaagtactttaaaagatgaatcttgtaatataacatgcataatacttaacatatatatggttagtacgattattagtcaaaagttaccgagtttgattttccttaaaaagatggcgccctataatttgggacggagggagtaatatttaggacttcacaaaactgaaccgtgcaagcatatatgactacaaaactgaattcattcttcacaaactaatgcaatgagtaagaaccaaaaattaacataaccaatagtctcaactcctcaagataaaatcatgtaacatttgcagccaaaacactaatcaaaacacaagaaaaggcaaagactgatacgctctgttaaagctagcagcttgaaatgagatacagatacacgacagcttcagtagcaatcaacttggattgctcatatattctatatatgcctgcggtgtcaaaaaaccatgtagcagtgaaatccaagctttatttctcccagttgcaaatattgcaatcctaaactttagggtacgaagaacaggattaaggatcttttagtttgtaaactgtgtgctatatatctaccaatcatggggacagagatacacatctgtgcatgttcttgaccaggcaccaaaccaagcggatcggataatatccatgagaaatcaaaccaaaaacaaacaagtggattggattgttgccacgagagaatcacacctaaaagttggagatacaaatctcaactatacaaatcacacctaaaatgaagaggcaagaactcacctgagccgagagaggggatagacgaggcgtgccggcgccgcggcggcggaggacgacgagcaaggcagcggcggaggacggcgagcgagcgagcgaggcggcggcagagatggcgagccgctcgatctcgtgtgtggaaacggcgacctagggttggggacatgcagacgagaaatttcagaatattccatccgattcgtagcacgttcaggattaaccatccaattcgcatgtctttcagaatccaccatcacaagagctaatttcttcatttcacgccactccgtccatccgaagcagcaccgtctatccatcagttgccgcgtcctccgtccctcgccattcctcgtcgtcacctccagctccggtcagccaacctcgtcgcacaccagtggtcctgccacataagaggggacggttcctggtgcacatgtcggaggagctcagctatcgccgcgcaggatcgccgccaccgtgtggaccacgcgactagtgcgctatgtcggacgagctctcagtgaggctgagcttgtggatgaccaatagaattgcttcactaatagagcttgtggcagttggggatgacggccgagcatggggatgggcggacggcaccaatggcgatggcggtggacgaactcgggtacgatctagcgacgacggcggacgagctgtcagatcccggggtcaaatgtcaccaaaaatctgcagattcgagcaaatttgggctaagtagctacctaataggattcctaagacagaaattaagctaagaaaattaaaggatgccgcaagataagcaagtaggaactagagtttatatttcttgatccccttttcatccacccagatcgccttttatggagtacggcatctgagtgaggaggctggacaactcagtaggctgtgattacattaagttttggagttttaggacaaagcagtacagacacagtaattactgaaatgaaacagctccctcagatttacatcattgaactggtatcttagcatctgggctgcccattcccgcaactcctatttctctttctgataaacaacttcttcagataagcagggcctgacaatgcctcccccattaagacccaggtcctcatgggttaaaccagggaaaagtcttggatataaaggatgcatcctcccaggtagcagcttctattggtagattctcccaaagtatcttccactgcacaactggagcattgtgtcgagggatcagtcgccgctccaaaacagcaagaggggctgttaatatgttgccatcagaatcaatcagaggaagcccaggttctggaactgccttaggaccaatatggtgtttaagttgactgacatgaaacataggatgtatttgaaaatttggagggagcaataatttataagccacggagccaattttgttcagcactcgaaatggaccataatagcaagagtaaagcttgagagaactatgcaatccaagagcattgtggcgatagggttgcatctttaagtaagccatatcaccaacttgaaatgtcctttcagaacgtttagtatcagcatattgtttcatacgagattgagctttgtccaagcttgccttaacagagtccagcaaagctgcttttgcttgcttcctgtttctgcatccagttaacagtgacgcaggtaaaagagcttcaccaaccataggtggttgctgtccataaagtgcttgataaggagtcatattcagagatgtatggaaattagtattgtaccaccattcagcttgatctagcagagaatgccacttctttggtcgagagaaagtgagacagcgcaagtatgtttccaggcattggttcactcgctcagactgaccatctgactgagggtgatgggttgtgctcaagtgcaactttactccagcatcctcaaagagcttcttccaaacatgtgaagtgaagattctatcacgatcactaactatcacagagggtaatccatggagtcaataaaaatgagtcttaaacaggtcgaccatatgctcggaagtgaaggggtggctcaaagcaacaaagtgagcgtatttagtaatctgtcaacgatcacccatatgacgtccttgttgtcagatttagggagaccctcaatgaaatccatggtaatatgtgtccaggccgtttcaggcaatggaagtggttgcaacaaaccaggaggtaatttgttttcaaacttattcttttggcaggtagggcattctttaacaagggtggcaatgtctgatttcattccaggccagtaaaaaaggagcttgaggcactgataagtagctcgttctccagaatgtccacccaaaggagaagaatgaaatgactctttcaattgttgctgaagaagattggtatccttgcccacatatatcatgtccttataccgcaagattccactgtgcagtgtaaagggaggtcgtgcagtaggatgaatgcttaacttggttatcaatgatttacatttagggtcagctggataagtggccaaaacttgagtgatccattctggaacaatcactattatagcttggagagtctcttgctgtggggctcgagagagggcatcagctgccttgttttctttcccttttttgtactctatcttgtaatcaaaactcatcaatttgatcaataatttgtgttgggtgccatctgtaattttctgttcattaatgtatttgagactggcttgatcagttttgatcagtaaagaggaagccaagaagtaatgcttccacttcttgagtgcttctaatattgcaatggcctctttatcataagtggaaaatccagccgcttttgggcccaaagatttgcttaagtaagcgagaggacggccttgctgcataaggactgccccaatcccatagccactagcatccgtctccaaaatgaaatgaagggaaaagttaggtagtgccaacacaggtgcttgagacaatttatccttaattgtctgaaaggcaagttgctgatcagtctcccattggaactcatttttcttaagagcattgaaaaggggtctgcagataattccaaaatccttgataaatctcctataatatccagccaaaccaagaaagccacgtcgttgagtgacattaaggggtgaaggccactgctgaactgcaactatcttggcaggatcagttgctactccttgttcagaaattatataacccaaatattccacatgttgttggccaaatgtgcacttagagggcttagcaaagaggttgtattttctgagtaactgaaggacgagctggacatgatgagcatggtcctcaatggactgactgaaaatcaggatatcatcaaagaagaccaagacgaatttcctgagataaggactcaatatccggttcataagagcttggaatgtgggtggagcattggtcaaacc

SEQ ID NO: 13208 - DNA, 2089 bp, Oryza sativa
ctccttgcccttgtttgctattggaatcaaccagcagatcttggattgccttcagatgcttggtaacctcctccttgtgagcttgagccaaaatcgcttgactctggatttcctcatgaattagcttgttgtctccttctacctctttctgaaactcctcaaagtttaaccgcagttcttctaccgcagcctcccacgccggcatcaagacttcttcctccaatccaacagcatgcgccctccccatggtgagaaatacagatctggagatttcacaggaaagaaccttggcctctcccaaccctctctgcacttctcaattctgcatcttctccaccaaattccaaagcctggctacggaattttacagaggaacttgtcctcaaaccctcaccagcttaggactcttcgaattggagaaaacttggccaattttcgactgatgctctgatacctttgtcagatcccggggtcaaatgtcaccaaaaatctgcagattcgagctaatttgggctaagtagctacctaataggattcctaaggcagaaattaagctaagaaaattaaaggatgccgcaagacaagcaagtaggaactagggtttatatttctcgatccctttttcatccacccagatcgccttatatggagtacggcatctgagtgaggaggctggatagctcagcaggctgtgattacattaagtttcagagttttaggacaaagaagtacagacacagtaattactgaaatgaaccagctccctcggatttacatcattgaaccggtatcttagcatctgcgccgcccattcccgcaactcctgtttctctttctgataaacaacttcttcagataagcaaggcctgacacgagcttgcggacagcatgaatggcgacggtggtggacgagctcgggtacggtcgtacggcgaattggatggtaaatcctgatagggctgcgaattgggtggcatatactgaaaattctgcggacgcgtagtgggctcccagcggacacgcggacgcgggttcatccaatccatctagctatgcggccttctcgtggggcggccttgcgagactttttgcggggcggccttgcgggcaagcgggctggcccgcttgccacctgcacccctaagcgagaggcggatgcggaggccatcgtgacgcgttcaacgtctcgtgcaagcgcaggtggggtcggcggaagacacggtgttagcggggcagagggaaagctggtgcagcgttggctttacaagctttgcagagggaggtgcaagggtaggcaaagggatccagggccggtcagtatcgccttgttgcgtcgagcatcggctttagcacactacaagagcttaggccttctatgactaattaattgtgacaattacagcctttttcttgtcattgtaccccttctatgacatactagtgacaaaatagctatagtcattgaatccctgtcattatcctccttctgtgactaatagacccaattgtcattaatcgtagtgacaattgcacgcttgtcaccggtctatgacaatggttatttgtcactatatttgtcataatacattagatgggatgctgacaagtgtctagccatctgacgtggcatatgacgtggcgtgtgacatggcatgtggagtatgacaaaaataattgtcacaaaaatgaagttggcccatttataacatggtctggttttgcaattataattcaaataagcctaactagcccatgggccagccaaccaattttggcccatttctcaacagcctttttatttttttcatgtaagcccagtagtatttcagcccattttacagttgatattgcagcccaagctcatttaaagaatcatcataaataataaacaacttacaattttataacaaaaataattagacatccaaacagatcatttcctccaaaattaatggttcatacagcctacatacaatagttctaaacattcaccatccatacaaatgaatcacaacaaaatacgtccaccaaagtcttacaagtccaacagatcaccaggtcaccaatcagtaataccaaacatacatcc

SEQ ID NO: 13209 - DNA, 3509 bp, Oryza sativa
atactctagtcacagtcacaccaaactccattcacagatcaccaaaatgaatccaacagcctgcaaagaacattgtgtcaggaattaacactagtaagaaatgaacacaagctcaacactctagtagtccctagggcagcaaccttttggaaattatattcaccagtggttttatttattcagtctcatgagtcctggcactataggaagtcattgtagtagagatattgattccaaacagtacctatgttcatttgattccagtatctaactatatcatacaatactactaatagtataaaaaaatgagaggtccaagaacaagaaacagaaactgcattatgtaagaagaggcatatcataagatgaagatgtgtacctaagcgcaaccaagtcaaggaggagtggtctgatgagtgacctgagtctgtccaaatgctatcatctgtcgaatgaggttctgagtatctgctgctgacttctgagtatctgttattgccttctttaggttctcaatctcctcagcttgtttctgagcttttgcctcagattcttctgcctgggcttccaacctctggaccttttggcgaagtcctgcagattcttccttctcagcctccaattgtgcttgtagctcctgcatctgcggtgaaatagattttggagcggcaacaggctgttgaagtcccacattacgaaggaatgtgcttgactttgtcaacacttgggcaacaatatctgtgcaagtcatttcctgctccccttcatgtactggtcttctcaaaatggcttccatatcatcctagcaagacaatgatttgtcaggtttccttcacaatttattttatcagtagtttccttcacaatctctactctagtccactttcactatttatttttttcacattgtaaagttacattgtatagcaggttcttgtgtgaagatgatgattaacgggtgcatgaagatgatgattaacgaaataacagttcaatcaatctggagcaatagagagtatacttcaattagatggagaagtccaagttagtatttgtttatgatattgtagctgaaattgtatattttttttcctgaagttcaccttttcatgtaagatgtaaattaccattcagtgaatgaaatgtgtgatttttcgacaagtccctccctgattttttttatttataatgctaaagtgtgatgcagtctgatgttctccaaataaaattgtggatgccagaattgaggaggtcttctcttgccacgcagtcctacgacctctccgtccaccgctgcggcaccacatataccccttcgcaccctccctcgccgcatcccgcttccacgtcgacgccgggggcctccttttccaccacaacttcactgcttcgtctcccatcgtcaaggagttcatcctctcggtggacgctggtggcaacacttccgactgtctcatcaacgcaacggcagcaacatgtgctctgtccgcgattttggtcgttaccgagcctggctgcccttccccacccccagcgtggcgccatcccccaccctcgatagaggtgaggcgcaacggtggacggcacggcgcccttcccccactccggcgtcctccttcaccgggaacactcaacccgccgagacgctctcccctagcccgagaattgcaaagtgtagttaacaactttttcattaatttaaattcatttagggcctcagtcagttcgaagcactaatatatatatatatatatatatatatatatatatatatatatatatggcaacatatcctatgcacacaagccctcacgtgtacacacgtgtacaccaactaaaaaatgtcaccaaaaaatctaaaaaaaatcatacccatactttcaattgtattacacctagggttaaaatcttaacgtcaaattcattatattttagccgtaacaaaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattttcctaaaattttttgtgaaaatttttagttggtgtacacggtgtgtacacgcgagggcctgtgtgcataggatacgctccctatatatatatatatatatatatatatatatatatatatatatatatatatatatatatatatatatatataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcaactatgctgtcctctcacaatccagaaataaaatgagagcaacaaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtttgtcgaccagagatccttccatggtttcaactcgagatatttcctgctcatcatcttggtatgtcagatcaacccctccctcttgcctgtcatcattttcctcctcattcacattccacaagtgccgatgcgaaaatttttgaacaactttccagggttcaccatgcttgttatcatccaagtagaaaacctttgttgcctgtgtggcaagaatgaaagcatcatccttgtaccaacaacttccatggctgatgcttttgaaatatccatcattcttcatcctaaactttttgctacaggtatcaaaccaatcacacttgaataacaccactgtcctttgactgtcagcgtcagagttgtactgcaactgtattacttcttttagctgaccataaagtctatatcttctccattatgtgtgccctcaaccataactccactgttttgtgttcttctactgctctcacgttccacggtgtgatatcggacaccatcaacaatacatcctgaaaatatacgaactctaagaagtggtagacttgccaatgcatatagtcttcatcgatttgttctccattcacaaacctccgagtagcaagctgcagtatatatatatatatatatatatatatatatatatatatatatatatatatatatatatatatatatatatatatatatat

SEQ ID NO: 13210 - DNA, 1450 bp, Oryza sativa
  unsure (1)..(1450): unsure at all n locations
tatttctttcaattagagaaaaaaaatggtgtgacttctctacttaatataccgtatttcctcgtgtgatggtcatcactgaaaactgcagcttcctccaactattgcactagcatgtgcatgaaactccacacagcaccatagccctaccagctcttttgacaggaacaaaatgctatgtggatgtagccacacagcctgacaacaccccacagatgaacaaggacgctggactgggaatctccatcaccaatacgcaacaacaatcatcctatcagacttatatacagggagctatcaggaatgtcatcatggcagaagaggcagctgcacttaatttagtcatctaatctcaaaactaaacatgctgctaataaaatcatttgttgtaaaaaaacaaaaaatgcacacgatgctctattcctctcatgtgcttcattctgccaagcaaggttttcaacagtagaagcaatgatgcatgatagcacagctgcattttattcatgtacatatgtaaatttcatttgcattctcacttcagtaaatgagatatgtatgagatatattcatttgcaatatactggaaatacttaaataatgatatattatcacagagtcaaaactgaaaatacttaaataatgactcacatgtttcctaaaccatcctggaaattccttagcaaggtcccctcaacatcatgactgccagcagtttgtaaatccttcatgtaaatcctacaaacaggtgcacaactcccatgtaagagctaaaattttatatgatacacaaataaaaacaggtgcgctattcaaggacatactctataaatggctcgacctccttagtattgttgaggacataccaaaccatcctatcatactccttctactcatatgtaagccttggtgcccccaacagatttgctccatgctggaaaatagataaaccacatctactcataggaacacgctctttgttcctaccctcacgattgtgcctagtgtcaacatcagcaaaataccttgagcaagcagtcaagcactcatttgcgacatatgcctctgcaatggagccctcaggccttgccatgttccttacaaagcgtttcaaggtcagcaacctacgctctacagggtacatccatccatattgaacaggacctcttaggattgcatcatcaattaaatgaatgcataagtgcaccatcacatcaaaaaaggcaggcgggaaaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13211 - DNA, 7952 bp, Oryza sativa
taaagcttgtgttgggggggggggggggagggtctgtgttaacatcaatggtgagagaagcaatttctttagcacttatagagggcttagacagggtgaccccctctcccctcttctctttaatctggttagtgatgccctacagcctcttttgatagagccaaacaatcagggatcctctcaggtttagttccccatctttgtccaggaggtctgactcatttgcagtatgcagatgatactgtgatttttataccctttgataattcccagatcaccattacaaaatttatcatgtactgttttgaggagatggccggcatgaagattaattaccacaagagtgaggtttttactgtggggcttgaggagaatgaaaccatcagagttgcaaagatgcttaattgtcccattgggaagtttcctatgaagtacctgggattaccaattagccctgataagattcttaaacaagacctgatgttcttaccccacaaaatggaaaagaggttgggaaattgggcaggccctttatcttatgctggaagagttgttcacattaactcttgcctatcctctattccttcatatgccatgggcttttaccaactccccgagggtgttcactagaattttgactctttgaaaggtagatattattgggctggcaataaacaggggaggaaatatcatatggtgaagtgggctgacttagcactccccaaagattttggaggtttaggcttcactgaaacaagactgtttaacactgccctccttgccaaatggttaacaaaaattgaatctgaagacaagagcctttgtgttgagcttttaaggaagaaataccttctacaaggaggagtttttcaatgctctactgaaggggtctctcaattctggacaggtgttcttaacactagaaagtggatgaagtttggttctgtgtggcaactgggaaatgggactcatttttacttttggctggacctttgggttggttcctaccctttaaatattgctttctttgagattttcaaaatctgtaatcagcaaaaggttacaattgcagaggtgaatacaaagggcttggggatatttacttttagaagatcttttggtcctcaggaggttgatcaatggaggcagttatgtgatttatttgataacttggagctttctaactccccagatattatgagatgggcgttgacacctaacaaacagtacactacacaatctctctatagggctctatcgttcagaggaattagagatgagaaaatgcatgccatctggagatgccctgcccctatgaagataaaacattttctctggctagcacttagagatagaatccagtcgtgtgaacaattgaaaacaaaaggttgggaaggttctgaactttgtgtgctatgtaactcactagaaaccacaagacatattctctttagctgccccatggccaccttcatttggtgtgtctgtagagatgcttttgggtggcactctgtgcctaacagctttgaggagttcttttctctgattaaacacacttctctgaagagttttagtacttatctggccttactcgctgctatttcctgggtcctctggactaccagaaatgatatgatttttagatcgcggactgtttactcaccactaatgctcccctttcgaattgtttcttacatgttacagtggaggggtttaagtcacgcgaatgaagctgccctgatggaggccctgaccgagaaactgaaatctgctgttacaaatgttggcgcgaccagagcaggaattggctagtctgtttcagtccttgatgtagttcttcagaggctgcgagcttttgttctttttctttaacctgtcgttggtttaagatgttctagagttctggttcttttgtttcgaggcgttgccctcctgcgctataaaacgctggctggtttccccagcataccttctggctttcaatataagccgggctcttgagccttttctctaaaaaaatacagacatcttcagtttgcacttgttcctgtttgggttatgtaatctgaagaaaggaagatggatagttgatcatatgttcagttcttggtgatataaattgcctgtcagttaactacatcagtaactttggctatcaattctagctagaatgacatcagctgcatgctgatcgggatggagcacaacgacaatgctggtcagagactgagagtaacgaagcaactatgtgtctcaatgctatgcaagaaacatagtaactgcagtctcctgcagaaaaagtaaaacatgagcttggtgccagcgggagctgggccggcggcaaactgtggcggtgggggcgctcggcggcggcggagtgatgtgcggggcgtcgagggcaggcggcggcgcttggtggcggtggggcatcgactgggccggcggggtggtggccctcatgctcgcggcgccggagtggatgtcgatggcgctcagatcgatcgatccagactccaaaggatatctcaccctttgatctgacaagtgggcctaggggcaaaacagtccaaaatgcctggaaagaaatacaaattgatttaagaaatgagaaatacatcaaaaactgagaaagtggtaccaaatagactaattagtagtcctaatgatatattatagagggcatacggattgggttgtaaaagagttgaggcacgcgaattggatggtaaatactctaaattatcttttttatgaggtcaggatgcctaacttataccttttttttaatgagaatagctagagcacgagataacttttaatgaatctaacaaattaaatacccctaagctctttttaaccataccctcgagcatatgcgggattcctctcattaaaccacccgatactttatatgatgacaccatgctgacatcaacacgaaatctagatatcacatcaggtacgaggtatcaagtccgatacctactgataccaaagtaccaagtctgataccaggtctgataacgatacccgacctagtacctgttgaagttataagaacataatgatttaatttatttcataaataaatcataacattgcagatgtaaactagcatgaacgcatcattagatctacacatgtaaactagacagtaaagcataaataaatcgaatatgcgcaacatgctgaacacgtaacaagggtaccggaagaccggttacttagcaagaattactcccaggtgcgggtgttgacgacggtgcgcagcacacgagcgaagaggaagacaagccgttgtggtcgaacagggagcaatcacgcgaagcgctttcaaaaaccatattgctgccttcttctggtgcaggacgtcgaaggcgaaggttccgaagacctgctctcccgattgccgtgcacgccgacgagcgggatggagtagactacgagtgacgacgcagtacagaggaggaggcaaaccctagattaatttcgtgtgtgttgcgtggaggcggcagctcagcttatatagagatatcaggacgcttgatcaggatgcctacatgatctctgctccgtgtaaccaaaccggataagtcgcgcgaaacttatctggactccacgatgtttcacgcactggatttttcggagtgtttccaaaacaaacaagtccgaatttcccacggcaaaacaaaactatccggactctacgctttttcacgcacctgattttttggagtgtttccaaaacaaacaaatccgaatttcccgtgcaaaacaaaactgcaaaaagaggttacatctgtgcaaaaggaggttgcatctgcgcaagggtgaagaaccactttttggcggaccattcgacgcataacgtcatgcacacgcgctgccacgccatgtcaggcgagcaagcacgcgcctgtgttcaccctcttctcttcacatcacatgtttcaaatgactagaagagcatcctcccttataaggaggtcttcctctcgtagaataagtaatgtggtactaaactcctatgcttgtcatcccatgaggtgggcttttgtgattttctaaagaattaattttcgaatgggctgagacccatctattaattcccttgttagagtactatgagtacccttacaaccctagcttgccttgtcagcatctgtctccaaaggaagacaactgatcctagcccctaagttcgggtttttttttcatataatttattttcggagtttctctttagcttttcagattcaatgaataaatatggttaaaactttcaccaaattgtagggattcatttcactactagcacctcttatgacagttcaacttgattggtcacataagctgcaaacatgagttttgcttgcggaattacagattggtatctagtttgctatactttagtcagaataatatttcttaaatattgtggattgcagattgagaggtacacctattcaagttattgtggatgacatgaagctattttatagatactggtgttctttttttgtttaattattagacgggaattcctttttcattagttatgaaagccaaaaaaaagaaatactatcatttggtccctgcctattgatgatcaacagtctaggcaacggaacgtgccaaaaaaaaagccaaaaagtcaattcacaacatttctgtttttgaaacagtcataaaacaattaaaaaatagaaaaaaattggtagcatatattacaaatttcacaataacaaacagatttatttaatttatcaacgatgtaagtaccattcataactaaaatttttaactcgctgtatttgtgtgtcagtgttgagattcgatcattcgactattggtatgaagcagattcagtctatttggctcaaagtctgaacctagctactttagtgcaattttagcggcatggcgcagtattggccttatattcttagaaccgtgtactcagataataatatgaaaccacgtataataataatatatactatgggtctgtttgatagagctctaatttctaaatttagctttaagagttaggtctagaataaagttttagagagttttaaaccaatctaaacccagctctagctacctctatagtttattttgtgagaatgctatacccaacttcgctcctattttaagtggagctaaaattatttggctgagctccagctccaggtaaagctgaaattgtagcaaacatgccctataatgcaaatggatccatcattcatgatatcgagagatgcctgaaacacgttcgcttggctgtcacgcctgcaaattaacgcaaagcaattaacgaaagccgcagaaaagcaaatctggaggcatggaaatgagctgcaaagttcatgtgggcctttgcatacagataattcgatcaaagtacgtgtgaatggttgaattcttgtttctaaagatctctcaaagcaacatattctttatataactgaacgtgacatggaacgaaatctttttcgccgggggaaacgggacgaaatcgttatgtgcacaccgaacactggtggagaaaccctttgtagtcccggttcgtaacccccctttagtcccggtttccaaaccgggagtaccaatccgggactaaagatcgctatctttagtctcgggtgaaataaccgggagtaaagatcgatctttagtcccggttggtaacaccaaccgggactaaagatggctcagccacgtggccgggatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttcaacaaccgggactaaagatatctttagtcccggttgttgagaacaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaacattttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacggttaggctcatcaggccctttgcccttttttcctttgctaaacatgtccttcacgaaaaagacttgcgttacatcattggcaaggacaaaaggttcgtccgagtatccaaccttgttaaggtcaacagttgtcatcccactgtcatcaatcattgcgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataa

SEQ ID NO: 13212 - DNA, 1075 bp, Oryza sativa
attgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagttgaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttc

SEQ ID NO: 13213 - DNA, 13545 bp, Oryza sativa
accaaccgggactaaagatccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggaacttatttatatgctactatattcaatatctatgttgatataatgctaataaaaaatgtcaaatttgtcaatatttactctctaaattccagttttacaacgtaatatttcgagtactcattgcatacaggagaaatgtcactaaaatggtcgatcgcccgctttccttaaaaggaaaatcgagtgcttgcttttattttactccctccatccacaaatataatattaagattctaaggtttgaattttttttcataagaaacacaaaacaaacgcaaacactcataaacgtacgcacatacacaccccttacgaatacacacacgctaccgccaaattttgcccacacgtataagagattctaggtagtacaccacatattaactcatggatatcaataattgcacgggtaaccttctttaatcatgtttcttgcactaatcaaaacctatccactgtcttttgaggggtacaaaattgtgttcctatctggcttaaattgtttaacgatctcagaatcccttatatttataacgaagaggagagtaacacacaagtaaaaatggaaacctacataaatcaagagggatgagatgagggagataccatcagacttgcaccagatggtgggaaaaaaaacaattgaaatcaggtaaaaagaatatgttgacacttattttttgtagcaaaaccgaattataagccaagtctacccagcgtgcatagcttatgaaagtttaagctaaaccctttaatttgtacatcccttgttactgtttttaatctactgtcaatttgtcatgggatttttttttttgtaatttcaccaatatgatggagattggccaacgaaattataatctcagaaatataatggtatatatatatatatatatatgtttaaaatttcatgtttttactctttttatatatcataagctttgattcataaggctaaacaagtacaccgaacagttttcttggccatgtggtgctctttatttctcgacaagggctaatgtgcggcacagctcacttcagtctcacttttcctgaatatatatagccgtggtagtgccttggatcagctacgtgcaattgcataataatacaggcagttccccatggctacttccacaccctgcagactggccatctcagttatactattgtgctgcttctcacttctccctcttgcgcacgcgcggctcctcctttccgataaaaacaccctcaatgatagcaaggccttctccatcaaaggtggcgatggcgcaagaggtgggcggggttttggtgtgagtattagccatggaggtcacgacatatcaattggtataggcggtggctttggaggtggagccggcactacacgtggtggtggcgcaagtgtgggtggtggggcaggtggaggtgttggcatagatgtgggtcatggtggggtggatgtggggattggtgggggaggaggtgccgcggttaacggtggtggcgtgcacgcaggaggaggaggaggtggcggtgttggtgtccatataggtcatggtggagtgagtataagcacagggggtggtggtggtgctggtggaggtgaaagtgcgggaagtagcggaggtggatttggtggaggaaatggagttggccgtgctgggaatgcagtgggaggcggcgggggttctggtagcgtgattggtagtagcggaagcggaggaggtagtggggttggatcaacaagttctgcaataggaggtggctctggaagtggtggtggacaaggctaagaatttgctctgatcaattatatggtgtatttaattttaatctaaataaccctctccagtgaacactatataggtgaaaacatggtatcgaatccaacaaagtgtgagtatgtactgttatataccatgtttggctttttgcacatttgatgtgcctagtaatttgtcggttgtgaagtactaaccgacatcttatattgtaatataattgtatgctgatcaaactagcatacgagtgatgtatactaatgttttaattataatgtggttggaaaaggggtggatccaggataagattagagggaggactcgtctccttcttccttcttcagccccctactctttctcctctccctcttcttcccccctcccctctcttcttttatcaatggtgatccaatgggcaacggagtagggggactcgagtcccccaacacccatgtttgtccatccctggttagaaagatgcatggggaaatcaattatttttatgaaaattaacgtttatctcaaaggaaatccaattcttttggcaagtgaaatctttctttgtacaaatcggtaggcctcatagaagttgccacactaattgaaaggatgaaaaaaaacttaaaattaccacattaattagaaaaacataatttcccacaataatctaattaaaaagaataaaatcataaaaattggttcacactcattttataatctcaattggaatattttcatcatttctatttccactggttatttgtaattaacgccgatgagcccaagcggtggatccaccatatcccgacaccaaattaagatgatgagagagagtcacttcaaaatcgaaaacaaatactatattagatttttggaatatcaatagcttaactatgcaaaatataaaacatactattgagtaagcataacattatgaaaccagtctaaaaacattataaaaccatgtgtttgacattataacataaggacacgagccaaagtcgagtggttctaaggtcaacgtagggactagaggaaggcggtacaaagtggtgaaagggtagggccattgaggtccagggatatttgtgtatctcatggtttggttggttctattgtcttcatttatcactgttagattatatggtagttagaattatattggaatagaattgatttgtatcatagtcttcatatctctaagaaagatccttccttatctctacccatataacctctatgtatcatccccgagagcggacgctcaatataacaagttcagttatgcagtaatattctctccatgtactattgaatagtaacaactatcaactacaatagaataataatgataaaacgactgataaatgttggaagactttggaaggtacttgaaagatgaaaagagaggatatccaaagtttataattagagtgaaatcatttcaagattaaggacttgacattttatcgtcagggtttaagtgtaaagtgctttttgggtaatcatctagttgggaatgtctgtactgagtagtatgaatcgttcttagaagatcgttgatttgttaggaaaaaacaaagagaacgatttactaggcacttggaatcccgtatggccagtaattagattatcgccctaattctacatattctatgcttttagtcataagttcatcaaaaaggcagtgggggcatgtgttttacactcaaatttggcacctagagtcgaaatagggaatctgccaaaatatggaaggcgtcgggtttccttcacggggctggtctgaccagcgtgtagggccggtttgactggtggcatgtgttcgaccagaccggtagagtccgagtctgagctgattttcatcgggtctcggatttccttgcttggaaatgtattttttgagtttccattgttttctacccttagttggacgtggtcctctagacatggaggaggacctatagaatgctagatcaacccaacccctttataagggctaaggcctgttcgattcaaaacagaccacagtccctacaatctattgaatcgttcttttaactttacttttcaacaatgtttgcaactttaccctagtttagtccatctttatcgattcgcccatgatcactacgagagtgcaatacccctttgtaggtttatcccgtaaaccttccgtttgcccacgagacgggtagttatcctcatatcgatctaaatcggtctagagtctgattttgatctctaaatctactccgctagccgatttagcttttttctacaaaacccatcttgatttagcttttgctagatcggggtggttgacgactccatatcaccacaaagctttaggtgtcccgatcgtaattttcttcttgtcaaaaaaaagttgccaacataaacatacattgcaattttatgctttgtaaattgggtacaatatgatcaattataatgcatgacttgccttgctctcgcactgatgagacctcagcaacgtcttcgagaaaccgcagatcgacgaaacggccgaaaactacgcgataaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggaggggcgccggcatgtgggccccacgggcaatggctcaagggggaagaggggggtggcacccggttggctcagctcggcttcaaagccgagcggagaccatggcgaccggcggtggcgtgcgcggctgccgacggcgacgaccggcggagggaggcggcggcggacggccgaagcggcggcacggccaaaggcggcggcgcacgcgggaaggggagaaaagggagggagagggagtcctcaccagaggggcggcggcgaccagtgcggaaaacaagggtggcgatgacgaccgacgatgccgaggcgcggacgagcggcggcgacacctgggagggagcggagagggggttaggagtgtagacgacgaccacgggggctaccattgccagccggagatggaaggcagtgataagacttacaggctggtagtagcagcaggcgctccggtggccttccgtagcgtgatgatggcggccggtataggtcggtggcggaaaggctaacggtggcggcggcgcgcggccgaaggcggcggcaagcggcgaagctcgggtgtgacggctcgtggtcggttgtgggcgtgggagaggtcggcaaatgggggaaacgagggaggggactcgggggagggtttttatgggcgagggaggggcggatgtggccggggagatggctgaaaccgccggcgacgtggagaggagagaaagagagtggggtgggattcaaaatgaatcctgcccacttcgtgcgtgcgtgcgacggggagggcggaggagtggggcagcgacgtgggcgcgcggcacgggcggagtggggctcggagaacggcgggaaacggcggcggcggcgtgggcggtttcgacggcagcggcggttcccggaggtaggagacgaccgacaggtggggcccacctgtcggcgtcccgagagaggagggaggggcggcttgggccggcccacaaggaggaggggccgcgggagagggatgggccgacggcccaacaaagaaaaaaagagggaaaagaaaagaaaaagagaaaaaggattttcctaggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattagggatttagctctaggttaattaagataatttcttcgagcaatttatttagccaatttttaaagcaaggagagggggaaactttagggcgtgacaaacctaccccccttaaacggaatctcgaccccgagattcggaagagctggcgaagaggtgcggatgggcggccttcaactcatcttctctttcccaggtggcctcttcttctgagtgatgactccactgaaccttgcagaatctgattactttgtttctagtccttctctcgctggtttcgaggatacgagtcggcttctccgcatacgtcaagtcttcttggatttcgatttgatccggacttgcctgttcctcaggaactctcaaacatttcttcaactgagagacgtggaacacattgtggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctgcttggaaaacgagctcccttcggcggttgtctgcatagcttctttgtcgagattgcgcgattctcaatctttccctgacagctctgactttctcttctgcctcatttaaaacttctgtaccaaacaactggtgttcccctgtctgatcctagaagagcggagtacgacacctccgtccatacagtgcttcaaacggtgccatctgcagactagcctggtaactgttgttgtaggagaactcagtatacggcaagcttttgtcccatgctccaccaaagtcaagggcacatgctctcaacatatcctccaatatttgattaactcgctcggtctggccatcagtttgtggatggtaagcagtgctgaagttcagacgggttcccaattcttcttgcaatttctgccagaactttgaggtgaattggcttcctcgatcagacacgatcttcttaggtacaccatgtagacacatgattcttgccaaataaagctctgctaacttcttccctgagtaggtagtatgcaccggaatgaagtgagccactttagtgagtcgatcaacgactacccaaatagaatcatgccccgatgatgtcctgggcaaacccgtaatgaaatccattccgatttcttcccacttccattctggaatctgaagtggctgtagcaaacctgccggcctttggtgttctgcctttactcgctggcaaacatcacagagtgcgacgaattcagctatttcccttctcatgctgacccaccagaatttttctttgaggtcttggtacatcttggtactgccaggatgaatggaatactgagtttgctgagcttctgtcattatcaagtcctttaactccttgttttcaggtacacacaatcttctccccatctagattgttccttgttcatcttcaacaaaacctcgggcttttccaactctcatgttctttttgagctctgctatttcaggatcacttgcttgagctatgcgaacctgctccaccagtgtgggctgtgcctctagagtagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtactttagacttttgttgatctgtatatacctcacaacggttaccgatgagatagtgccgccaaagctttaaagcatgaactactgcggccaattccagatcatgcgtcgggtagttgccttcatgaggacgcaattgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattctgcagaccagataaacttttcttccttcttcaatagctgtgtcattggcttagcaattttagagaagttctcaatgaaccggcggtaatagcccgcaaatcctaagaaactccgaacctgagtgactgtccttggtagggtccatttggtaactgactccacatttgctggatccacagctactccttgagcattcacgatgtgaccgagaaactgaacttccttaagccagaagtcacacttgctgaacttggcatacagctggtgctcttttaacttttcaagtattagccggagatgctgcacatgttcttcctcgaacttggagtagataagtatgtcatcaatgaaaaccatgacaaacttgtttagaaattccataaacaccttgttcatcaaattcatgaaaaaagcaggtgcattagtgagtccgaaagacataactgtgcattcgaacaacccgtaccgagtgatgaatgctgtctttggaatatcctcttcgcggatcctcaactggtgatagcctgatcgtaggtctatcttagagaacacagtagctcctttcaactgatcaaacagatcatcaattcttagcaacggatacttgttcttaatagtgacctcattgagtgcgcagtagtcgacgcacatccttttggttttatctttcttttccacaaagataactggagcaccccaaggcaacgtgctcgggcgaatgtatcccttctgtaactgttcatcaacttgcttcttgacttccaccaactcgttggctcccattctataaggcctcttgtggatcggtgcagttccaggtaccaagtcaatccggaactcgatatccctttttggtggcattgttgtcagatcgtccgaaaaaacctctggatactctctaactatgggaatatcttccaacttcttagtggttttctccactgctacctcttgttcttcaatagcagcctggttcagactgatccctggcttctgtggcactggagactggaaggtaaccacttctcccttcgcattggtcaacttgatggtgaggctagtgcaatcgatcactcctctgtgccttgttagccaatccattcccagaataacatctagatccttagattcgagaagaatgaggttggctggaaaaatcaacccttggatttcaactctcactgacgggcaatagtgagttgtggtcatgccacctccaggagtatgaactcgcataggtatcttaagcttcactaaagataacccatgtgcaccagcaaaacgcttggaaatgaaggaatgagttgcaccagaatcaaacaatattactgccggtgtcgagttgacgggaaatgtgcccaatatgacctctggtgctgactgtgcctcctctgcagacgcatgattgacacgggcctgcacaaacttgggtccagcatgtcttggcttcgggcactttccaaccgtgtgtcccggtttgttacaattgaagcagagttcgggctttccttcgaactcctcgggctgttttgactgagcaggcagagctggctaaactgactgagctggaaacattagtggacttggagtcgggttgaggctgtgcttctcgctgttgccgtgactgccacaatggtagatcctgccgaagctacccgggtggtagggacggtgctgccggataatcatggtggaaggtccaccctaatgtcccatcatgaagcgaggcttctgactgttcccctgggaagttctaaactgagatgccttcctttttcagttcattttgttaccctgctcctcctgacggatagctttgtccaccaacttctgaaagtcctcataatctcgggagatcaactggttggtcaattcatcatcaagacccgacaaaaacttctcctgcctctcggcattagtgcgcacgtcctcaggagcgtagcgcgcgaggcggttgaactcgtgcaaatactctataactgttctggttccttgttgcagagaatggaactctctcttcttttgtgccacaattccctcgggaacctgtgctttattgaaactctgacaaaactctgcccaagtaacctctgtcccagctggacgggtcaccacgtagttgtcccaccaaacagaagcggaaccttgcagctggtgtgtagcaaaagcaaccttctcttggtcgttgcattgcaaaaggttcagcttcttctcaatagcatgaagccagtcgttggcctcgattgggttggtggtacttgagaaagtgggcggcttgacacggagaaattctaacagtttggattgaggtggtggaagaccaaactgcagtttctactgctgctgttgtgcttgctgctgcacctgctgcaacacctgatggtactgttgcatctgttgcatcatcatcgtcatcatctgagtttgattgtccaacacctgagcaatcgttaggttctcgggcagtggggatgaactgctgttaggtgcatcgttggcacatgctccactgatctgctctttgctgccactggcgttgttggagtcacgggaaccattccttgtcttcaccatctggagggggataggtagaaatatgagaaaaggaagaaaaacagggggctcagaaactaatctttcctataagtttaagtgcaattatcttaatcgtgattaaaacactgaaagagaggcacacaactcctaattgaggcaaccataccactgacacatgatatcgaccgccgactaatccaccagcaacaaacctatgcacggaaactagcaggcaaacaaaactaggaagacaataaagctaagggcggcgactctgaagctcggagcggcgcttgcaatcgagggataggactgacatctaaagatggacaagggataagaaccaattcatgctcgaatccaaattaaacgaagcaacaaatgactcaaacaaataactgaacatgatgatttttatgcatagaacatttttcatgaacccagataaagacacaattgcaactaaacaataaattaatgcatagactggatgcatggaaaatgatgcgcataacattgccccatcgaacatagacacgacctaatgcataacccccaatagattcccgactgactgtcgaataaactccaactaaaatttttctaaagctctagactgagctaattttttaaaaaaatcagatccgaatgaacgaccaagatttttcccgcaaaccaaagaggcaaaactccaaattttcccgaaacaattccaggtgcaaaaggcatatgcagatgaaaaaggggttcagagggctcttaggtttccagttggcttgtcctacggtcaaggtcggctctgataccaacttgtcacgcccagaaattcacgaaccagaatttcgaagctgaatgtgcattaaatccctgtccaggaccagccagggtacataaatgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagacagctccaactagaaagaccttcagctctggtgtgggggaaaagagagcaagactgagtactacccactgtactcagcaagtcataccggaagaggaggtatgatgtaggatataaccaaagaaggctaggggttcttttgcacaaagctagcatttaaaagcagtagttgaaagcagtaaaacagctgtagtaattaatcaatattaaccaatcactgtccaacgctacaccacgttgcaacaagcccaaccaaccacctgaactacaccagttcattaagctaaactaggggtgagactaatcacgatgaatctggttgatcacccataaccgcgggcacggctattcgaatagttttactctggctagaggtgtacaactgtacccacaagatacgattccacacatgtcgccatgccccgaagtatcaccatgatactgcaaagggggaaatcgtgacaagaccctcccctaaccatccacaccacgctaaggtttcacccccacccctcaaaaggcagtgggcggtcccctcttgcgccgcggtgaatccagcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgtcatgggtgcgaccagcaaaaccatgcacccacagcccaccattcagtgtattttaattaactaacaccattgcggtgacaccaatccaaaactatgctcatagccaaagtctatgtaataatgtgatccccatttgtgtactagttgagctaagcatggctaagcatttcctaaaccaacatctaatcattttgatacccaagttatcaatggcatatggtaaacaataaatggctgagtaataggacccatcccacatgacattgtaaaagaatgcgacatttaatagaaatgcgggatatttgtaaattgggtacaatatgatcaattgtaatgcatgacttgccttgctctcacactgatgagacctcagcaacgtcttcgagaaaccgcggatcgacgaaacggccgaaaactacacgacaaacaaagcacacaagcaaaacatgctataagactactgaaacaggaaacaaaaccatttttaatagattctttgcatttttatgaatttactgagacttgaatggacttaaacggagctcgagtgaattacttatgaattttagaagataaactgtgtttttactaataaagtaaaagtccttaattattttattgcgcaataatacccagggctgatgtcagtgagggggggtgacgtcagtgagggtgggcgagctgtgccgacaggcggggcccgcatgtcagcggcacaaggggagagggagggggcgccggcatgtgggccccacgggcagtggctcaagggggaagaggggggcggcacccggttggctcggttcggcttcaaagccgaccggcgaccatggcgaccggcggcggcgcgcgcggctgccgacggcgacgaccggcggagggaggcggcggcggacggcgcgaaaggcggcggcggacggccggagcggcggccggccaaaggcggcggcacggccaaaggcggtggcgcacgcgggaaggggagaaaagggagggagagggagtcctcaccggagaggcggcggcgaccagtgcggaaaac

SEQ ID NO: 13214 - DNA, 51820 bp, Oryza sativa
gcggcggcggcgtgggcggtttttacggcagcggcggttcccggatgtaggagacgaccgacaggtagggcccacctgtcggcgtcccgagagaggagggaggggcggcttgggccggcccacaaggaggaggggccgcgggagagggatgggccgacagcccaacaaagaaaaaaagagggaaaagaaaagaaaaagagaaaaaggattttcctgggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattaggaatttagctctaggttaattaagataatttcttcgagcaatttatttagccaatttttaaagcaaggagagggggaaacttcagggcgtgacaaaaaacaagagaaaatgaaaaggctctataaagattgtaaccaattaacaacagtttgcttgaggggatccttcattctgcagagatgcagaagaattttatttataaagagagacttccaagattgtaaggttggctacaaatttctgaagatgaggccatttcgttgttttcagatgtgccaagcacccacgaagaagatttctagaaagccaggctgattgaactgccatcttgtgtaagctgtcctttggtaaaattcaagattggcattccatgagattcccagaaactgccaacaagcagtgctaaatggacagttgaagaagagatgatatctggtttccctttggttagtgttgcacagtacacatgatagatcatcatcttctttggcacaatgcctcctatccaacatatctcttgtgttcagtctgtcctagaagaataaccaagcgaagacttttattttcattacacacttggtcttccaaatccagatcagagatctgggtgcttgaatggcagcaaaattaagtttatataatcgtttaggggtaaaacagctgttattccaaatgaaactccatgaatctcaccttccttgttccaagtgaaggtgggttagttcttcttgaaggttgagatactcacaataggcttgataagagagtggtaacatgaaagaatcctccaatggcctgggacacatagattgtaccaaatcatttttatatagagatgaagcataaaggtgatgatattgctgacatttgaattgatcattccacagatctgtccagaatagagctgtagtgcctgtccttatgttgcattttgcaatttctctaaaaacatcaaccagaacaataatgtctttcaaccaaaaagagtctttgtttgttagatgagggactttagttaccaggtaagacttagccacaagattaacccaagaaatatcagctgtagagtaaactttaacaagatgtttcatgagcaaggctgcattttggatttttagattaatcacacccaggccccccttttcttttggtgtacaaactttttcccatgaggccaaagattttctggtggaatcagggctatttcctctccaaagacaattctttcttgcagtatctatggccttgataacagtgacaggtaattgtagggagcacatgtaatatgtaggtattgatgataacacagagtttattaaagttagtctacccccttggggtaagaacattgagcttgttgtcagcattctttccactctatctaccaggggggcaaaatcaatcactcttggccttgtagttcctagggggagtcccagataagtgaaaggcagttttccaacaaaacatccagaagacctgcaattagatctgccttttcttcagagagattgaggggataaagactggattttgcataattaacttttaggccaatcgattgagcaaacatatttagtagtgccttgaagcaaaagatttccttttgtgaagcttttagcaggatcaaagtgtcatcagcatattggatgatggggaacccactgccatcattttcattgattggctttgaaattaatccaagattgaaagccctatttactgttctttgcaagagttcagcccctagaacaaaaagaagtggagataaaggatctccctgcctaactcctctcttgcagataaaagaaataccaggaaccccattcaacagaactgcagagcttgccgaggagaaaatcatttgcacccaattaagccacttttgtgggaacaccatgctgtgcatcacagataagatggttgtgtgttcaattgtatcaaaagctttttcaaagtctaacttgaggatgattatttctctttttgattgttggcattgatgaatatactcaaaagcccatgccaaacaatcctgaatggtcctccccttgatgaatccatattggttttcactaaccactttgagaatcacaccttgcaatctatcagccatcaatttggtaaggaacttaaggctcaaacccattagagaaattggcctgaaatcattaactgtttctggagaagtttttttttggcacaatggtgatgtaagaattattcagaatctgtaaatctgtagattcaacatgaaaatgagccgcaagtctgtagaagtcatgtgcaatgatgtgctagcgttttttcatgaaaaaaccattgaaaccatctgggccaggtgcattatctgctgggattatagcgatgagactatcaatctattgtgtgcaaaacatgtcaatcaagcactccaaatctgttctaggaacaaaaagctcattcaagttaaaatccattgttgggaagcaagagatacccatcctattcttgaaactctgatagaacagatttgccttttgatcatgcagataaactatctaaccattttgattcaaaatttgtgaaaccgtgtttattctgtacctttctgtggcaatagattggaaggacttggtgttttcttctcccagcatcatccatctattagtacatcgttttttccaatatattttcctgaattccagaagttttaagatacaatgtttaactacctccctgaaattccattcaattaaagaaatgcatctctcttcttccagaagatcaataaaatcaattactttattagagttactcaagagaagcacgattctggacaaatttttactccaaagcttcagtttcttcctcagaatttttaatttgtaggagatatattttgcaggatcatgaaaaccaggatctagcatccaaacttgctgaaccacctcaaaaaagccttgtgcttcaacccagaaattttcaaatctgaaaattggggacttaggaattttcgtatcaatctttactacacatggtacatggtcagagatattcctagttagagggagaacagttgtattggggaaggttaaagtccaggatgcagaggtgaaaacccaatcaagtctttctagcaaatgattttgttgcatattgctccaggtgaaccttctcccttttaaagggatttcaagcaaacccagggaactaataatctcattgaaaattaaaatatcattcatgttagctcccactttattcttgtcatagataaatctgtagaaattgaagtcccctagaaaaagccagttctgttgagcatcaatctggatatttttaaaccaggtcacaaaatctgatcttttggggccattacatggaccatacacacaagtcaaggaccatacttgggaggtgaatctagaagttaactccacagtcacagagaaagggttaacttctttgggtgacccattgaagactcttgaggcctaaacaataagaattccacctgatgcactcatggagggggcaaaagcaatagagccgaagcgcttgggggcaaatttcttgatgtcaaaaagctcaaagttttcctttttagtttcttgaaggcataagacctggcagccactgtcttcaattttctgcctagacagtaacttattttcagcattcatatccctcttgttccagcacaaaacattccaagatttaaaattactattcattatcacaccattgagggaggggcaaaagtaccaaggctagcacaactaaccgaaaaacaaaccaaaagccatacacacaagtcttggcagtctgacaggacaaatatctgataaaataactttgacagtaaacaaattacagaccccttgagcatgataaaaggaaaacacaggtctgtcaataaaactgagtcttctgtcattatttatcctccatgtttggcctggttatcttctgtcttcttttgcccccccccctaggctggattctgccacctcctcaggagagagcccgcacatgtctacccccatcttttgtatgaccaaaagtgaacaatcaggtggagaggagtcagagttcatatcactataagaagtttcattgaaatcagactcctgcaaactgctatcaataaagagttttgaaatacctgcaaattccttaagctttttagcaaacctgccccttggcttcccaatacccattcttggatccatctgcaaatctttggttgccttgtcttgcagtagcctagagctttgtcttctgtaaggactgtaaagaatggtcttcccatctttcttctttataggtgccttggggggaagcagggcaacaagggccacattgattgggctagagtggggcattacactgattggtagaacatcctcaatcaccctttccggcagaggaggagaaatggacttgaaaggttgtaaagcccattcagattcatgttggcccactgagggagaggaatcaattccttggcaggaccaaagttgagaagggattggccattctcaaagcagcagggataggcttgtcctggatcaaaatctgcatgatgccctttgctttacagagaaagtcaatcttgtctaatatgcctttcattggataaaagtaggggtgccttggagcttcattcctagcaattctgttcagccgagctaagaattcctgtacttgtgggtccaagataggatcctggactgtttccttcctggctgatgagagaggtgtggctatctgctgaggcaaaataagctgaccagggttttcttcaatctgacccattggatggtcttggccccaggcatcttcttgctgttcatttgcagcctgttgttgctgcactgcttcgtcccaacctccagctccctggtttccagggttgccaaactgccagacattaccatcatcaggatcctcatcaactgcatcatcagggcccggctgcggaccagcagggggaagatcctcttcagtggggaaattaatcaaatccccttctagcatgaaaaccaagattgtccaagattcccccccccccacacccccagcgccaagaggatcaaagagaacaatctttctcggaacagaatcctggtccctgttctttgccctaacaaaaacccttcccaatattctatctgcatccgcctaaaaggttaactaaccaaaagaggcaactaccaggtgcacatgatggcgatcattgaaatcgagtggaaaatctagaaacatgaaccaaccctctctatggaagttagccgccctccaattaaacctttgtcatgattaacaaaagtaaccaagtgaaccccatcatagaactcaggcggggagaggaccagagcatccctattcatagcagacctcatctggaagaaaccttctgcaaacgggtgccggaagctgttacgaacctcatagtgtagcttatcttgtatgaagttggcaatgagggcccgatgatgatcccagtcctgctccagggggattggctcaacaatggccacacagaagtcttcatggttccgagcagggcgctgcgggacagtgaggtcaacccgcgggatgcagaagtcacccccaacttgcacaacgtgaccctgccttaggaagcgctgcggattagggttaagattggcaattgggggcagagggaagctttcggtgggaagcactgtgtgtttgggagaagaagggtttcgggaggaagaaggtgagatttccggagcattagttttggccttccaaacagcagtagtctatttctttgaaatatacccaatattgtgaaactagtgagagttgaatgaaaacaggctcatgtaattctctactaaatctgtttttgctttcaatgtttcacttgaagggcatctttgtttgttttcaacgaattgtttatttctcgtcattcagttagttagaagatgctaacagttctacgcttgtggaattgtgctttctgtatagccgcttattaatacgagttgtttcttttcaattagtaataaagcataatagctcttctagctagcagcctagcaccataacaattgtacggtactacagaatttgcatttcatataattgcattttacactgcgggcaacaccaacaaagtttccacaacaaggtccacatgtgcaaggaattataattgtcaaaaagtaatgttatataaatatatgtagtacttcctcaaatattctacaggaaactgccacatcaaagtagtcgaacgcggtatacattcactactacagaacttgacatcgtgaacagtctatccgtgtcagggccttacgaaccgtcacatccctatctgaccagattaaacaacgacacataaacacccttgcagacaatttccataggcctttaggctgggcccatcactaatgacactcataagtgacggggagaggttatcgcccaacaaagataatcattgacgggccacaacctaacgccatcaccgatgagtgtcatcgttggcgagcccaacaataggcccgacaaagatatatgttaaactctgtcaccgatgagtacggttttttgcgatccctagttattgactgttatcgatattacacactataaataccccaaccaattcgtggaatggttatcccaaccaaacgtactggtcacatttgtggtgagacgtgtaggtgggcaaattttgccttttttaaaaaaaaagaaaaacagaaaatatagaaaaagtctactaatgtatggaaaaaataaatcatccctacaaattttgtaatacatgtcatttaaaaatcatatctaatatttgttcacttttgtagccatggaccgatattagatgtacgaaattgatcgacatagcaaagagtatagaagtggcattgcaaattttataaacgtggcggagaagaggaaaagaaggaacaatgatgacatgacttgtgatgacacgacttgtccatgtccagattgcaaaaatgagaagatgttgatagcagagtagatatatactgtcatatgatacgtcaaggattcgtgaagggctacacatgttggacgaagcatgcagagcaagaatcaatcaatattgcagatgcagcgagtagtggtcaaaatcagaaagaagatgaagctgacatgtttgttccttctctgttgggcggtgaaatggttgatgtcaatcacgatcttctacaagcaatattgcatgatgttgaggagtcagctcgatgggctgtcgtgccttcgggccgacccggcacggctcgagtcttattgggttgtgcctggaccgtgtgtgcagcctgtgggctggcacggcaccacccgaaatgtaggtcgggtcgtgccgccctgactgacctcggcccaagcacggccgtgcctggccgtaccgggccgggcggcccatttggccatctatataccgtggcgcgtgttttataaattattatgggtgaatagctaaagtggtctccaagtttcatctgagactcagtttagtccttgatatttcaatctatccatattagcccttatccttgaacttatccttgaacctacttagaagccacatggctaaacataactaataactctcttgataaatgacacttataccccctcattcacatgtataaaagaaaaaattgcatgcaatgaatttttttatagataatgtatagtaatttacataaaacgaaaataagttatgtacttgcaagtgtatacgatagccattgcttaagtttcatgtgcacatgttgaaataatataaaatacatctgcaatgttgtttattcatcttggttttctcttttctattgtatagttgtatacaaatgaagggcaaaagggatattttgcaatagaaattttgactagaaatagccatatggcatattaagtggatccaaggacgattttaagccaaaacaaatacttagaggacttatgtggacaaaatgaaacctggaggaccaaattaagccttcgtgaaatttgagagactaaattagctattcgcccaatttttattaggatgcttacttatttcctacaagggagacgtgttggttcatgactaaatagtattttgttggagaaaatgtgcaactttggtgcacatgacgataattgatcaatttctaccaattatagtttgctataaggcaaaatctaaaccgagaggcttctcggtttagtgttaaccagcgacgaacgaattgtgagaagaagtactgctacatgtgctgacgtccatacttgtttttcctcttagacatgcatgtctttttcttccttcttataaagttttctctcaaattacttatccgatctacaatccaattgcaccattatgttcgttacagttaaatcttcacaacaagatcttacatgattatattacaatgaaaaaatatttatatttgtaaattacttttattatattcgtaagttacttttatcatatatatatataagttacttttatatttgactaagttacttcttagacatataaaagtaaattcaataaagtctaaaaggtatttacatgtattataaaagtatcttaaaacaaaatgaaagtaactttgtcacgacattagaagacattaaagttctttctttttgttataagttacttctataatatatgtaaattacttttaagctttattaaatttacttttatatgccgaagaagtaatttagtgaaatctaaaagtaatttagatttattataaaagtaatttatattttttttattaaaatataatcatgtgagatcttattataaagatttaattgttacgaatacaacggtgtaatcggatcgaagatcggatgagtagtttaagagaaaattttatttgaagtataggtagatagagtctcttataggtgaagtggtagctggtttaaacaaaccaggtaccactagttgtgtagtcacgtccttgctataaatatacgggcttgtttgcagaaactatggaaataaatgcaagagaaattctaatcaattataggagatttatgttggaatcataggagattcggccattcaacctaccatcactcgcgaactcagagaaggatggaaacgatgaatggtaatgggccaatagctcttacctctttgctgcagtttcgatctaaggacctatttagtttatttagtttctacgcagaaacttttcaccctatcaaatcgaatatttgatatatgcatggagtattaaatatagaaaaactaattacacagattacgtgtaaattacgaaacgaatcttttaaacctaattgtgtcatgatttgacaatattgtgctacaataaatatttgctaatggcgagttaattaggtttaataaatttagagacgaaatctataatttattttgttattactctatgtttaatacttcaaatatgtgtccgtatatccaatataacacgccaaaatttttcaccctgctgctctagacacagcctaaatcattcttttttttcgcactccctcctcgtcatgataccgcctcgctgtacacatgtagtactaaatcatctttttcgatgaattgggaaacggcttctagtggtcaccattgacttgctagttaacagtgggacccacttgtcaataacttttttgcttacctctccccggtctccaaccctctctccccctcttcctcttctctcacctttcagcaacaatggcgcagcagtagtggcctggatggcggcggcagcggcggcggcgccggacaacggcgcggtggggtgcctggcgtcggcggtggagggcccgataacgtgaatggcaatgggccaacacccctgacctctgctctgctgcagtttcgatctagttctttttctttttccgcgcatctcgctcctcgccgtctcgctgccgccgccgatgccggtccgcgttttctccgtcccttccattgccgccgttcctctcggccgcgcctctgcttgtggtgccacgttctccagcgccgatgcggcggctgtctgcagatacgccagccgtttggtcaggcacagcaatctccggcggcaaaggttcttggtgatctgccctacggattgttcaggttctcactgtttccctgttgttatctgttactactaccattttaccgcattattgtatattcccctgattcgttaatctagggaagaggtagtagaactggaacacaattcaattcaacgtgctgaaatgcaccgtcagagctgatgccatttctagtcaatgctaacggttcagttctgatgcattttcgatttatgaaactctcaactgttttaccctacatagcccccttgtggtagcttctagcaaacctctcaaaattgtcctaagggtcttcagggtttttaggtagtatttgtttcagttatttacccaactttgctatcctatataaaagagaaaaatctacctaccaccagcattctggcttgcactgctcacccaacccccttccactccctcagcacgaccggtaatagaggcataaccataattaaacatccaaaggatatatcttgattacagataagctagggagcaaaatggattgtataggagtttgtatgacagataacatactcgagatatttatcgaaggaaacctacaaaaagaaggggattatatatttctcaggtcagacaactagttagaatgttagatatatataattgaagttcattttcatatcagaaaaggccatatttttagttttacagaatgcatcatttcttgcaatgtacaacactacttacaacatttattcaaggggaaagctcttttccttgcactaagagggcatacttaaattatacattttgagaaatagtattcataaaataagacatgagacaaataatattgtggtagtagaaattaataataccagaaagaatattagagcccatgccaagggattatattgtatgtttaatggcaaggacattatgagcaaattatcacttactacatacagatccattcaaaacattatgctctaaagtatagcagaaataaaagtgaaacatatcctctgcaaattgcatggctatactaagaattacagcggatttagtgtagaacagctcaaaacagaccatgaaacttcatctaaaaaaagtaagtatgaagtttcaaatatcttaggtaattttccttcccaagcacctttggcaaaccaacgaagagcaccggtgatgagtaccctagttttggtcatctttttgtcggcgctagtagcatactttagttcttattattgcattccaatgcaaagtaaccaataatgtacttgtatgtatgttccaaatcttccattgaacaactgtacatgtatatataggctgcagttgtataacttcggctacaccaagtaattcaacaagtttgtgtgtgtgtgtgtgtatgtctcagatagcaaccagaagaagttatgtatatatgctcccagctcaatcgacagcacagcaaaactcaactatacaacttacaacaataagtagtaaccgaagaggatcttgttgtagaagatggcaaatcatatcttagcagctgaaaagagttaaaccatccacccatgcatcaaatcaatctcaaatgatgagaagataattgaaggcttcgaaaaagccaatcatcaaccatgcaaataaacccttctaggatcacgccaaattaatttccacaggcatggaactgaccatgatagctccccagcggcccagcccccgtcctttcttcttgggcaataaatcaactgtaataaccatccccttggctcaagatagcagcagcaccattcctctgcttgtcttgattcacagagatgagagatgcacattggtccaacttgatcagaaagtttgattttattaccatataaaacagctggtcacatgaaacacattttgtaaggttgatccgaatagaccatcaagtttcaaatctctcaactgttttttcttccaaagcttttgctgcatagttggcagcaacattgggaaggtaacccacaagattaactgaatgtcatctggagtgtaccttttcccgttgccgttgcactcgtccatgccatgataaattgtatccctgtaggaattcagaaaggaatcaatttcttcctcggatccatctctcttgcaccaggaaaatttccttaacagactagtaccttgcagtttgcctccccaatcaagctttcgcaaagcattgatgatttcgtctttctctgttgatttatcacaaggtagcacaaacatgatgaatgcatacatccacaggaaaaatgcttctctgttccttagagggactagagaagcatgtgtacagataagatactccaaatccatactaataaccttgtccccagtgttcattaagtttaggagatgcatcacgtcttcaggtatatcctccttgtgttgtccaaacactatttccataattattttgccagcatccttgtagtttttagataccaaagagtcgttcttgtcatcaagttcgcttcctcttaattgcactatcccatcttctctgataaaaacatttgattcatcaaaattccgtggacacttcccccttttgtgcaggaaatatagctctttaagtagtgctctgatgacaaatttggcttcctcagtcatgaggcgatataccctttgacgcgttggaccaacaagcataactggtgtatgcttgatatattcgataagtggcttaaattccagatcacgtatgtactccgcataactgacatgatgtgtgtttctgttttggtacaaaagaagcaatggtcaaatagatatcaagagtttgcagaaaacacatacgaattgaacatatagtaaaattttagaagcataggagtagaaattacagtaggaaagggaaatgatggacgttactgttactcttcattactaatatgaaaaattgacaaagagttgcattttatacatactagtctgtccaatcgttatgcacgtaaagaatttctattgtgactgattgtttagattagagctaggactgcatgtattcttcatcaaaaaatccaggccaaactcaaataaattggacaaataaaaacaaatatcaagtgaataatcaacttatcacagtttattaagtatttccgaatctagcaattgaagttgacctagtatggacattttttatgaatacagaatatgttcacccctatatctaggatttttttttctttaaaaaacttctaaacaacaaaatataatttggagcacttatgctatgtgcacaagatatgccccattccactattagtaaatttaataaatctttcacgttaaatttccctgcatgcaaacaccacttggtttgtaatatatagaacatggggaatagctcaacttggtcaatcattattgccaaattaagtgaaattgtagaagaatcaatggacataattaagcatcagtacaaaattaggactgtaaaaggtggcaccaaacttctctctattacacggaggatgtgcacacgcgcacaccgcacatgtttgtttaagtgcccctttagcacagtatgtaacacaagcttaacaaatggagccaaaggattgaggcattgaacatacttgtgagagaattttacttttgattagaagccacatctagaggatttttagttatagctagctacacaagcagctctggcttaaaagctgttataagaagagctctatcattatctcattaaatctttgtgtaattgtggaaccagggcttgaaccacatcaacgtgctttccttatgaccaaattgactgtaataaaacatccaaatctattgccatgacataatcgagaggatattactataggtaattttggatgttacaatatatagtgaacgagctgtaaagaaaagggtgaaggagttaccgaaacgggaacacgactcctctctttgtgggcaatgaatcaacaccaatgtcattcttgttcgtgtcttgattcgccgatataggcattgatccaacctaaaaggaaaaattgttgcttttgttgcaatttgaaacagctgaaggatccatgatcacaccaaactccttgtccatgttggatccaaatagactatcaagttgcaaatcttccaactgtttgttttcccaaagctcttcttgcatccttggcagcaacattgggaaggtaatcaacaggattagttgaatgtcatctggagtgtaccttatcctttcctcaccgtatttgtccgtgccatgaacaattgcattcctgtaggacttcagaaagtcagtgatttcctttttgtagcacatatctttctcccgcctgaacaattttttgaggagattatcccctttcagtttcttgtgccaataagatttgtatggcatatcccctgctggtttgtcacaaggtagcataaacatgatgtgtctatacatccacaggaaaaatgtttccctgttccttagagggacaagagaagcatgtgtacagatgagatactccaactccatactaatagccttattaggattgttcatcaagtttaggagatgcttcacatctttaggtatatcatccttgtgttgttgcaacactatttccacaattattttgtgagcatcctggtagttttcaaataccttggagtcgctcttgtcatcaagattacattctcttatttctgctatcccatcttctctgataaagacatttgattcatcaaaatgctgtgggcactttcccattttgtggaggaaatacagctctatgagaagtgctctactgacaagcttggctttttcagtcatgatgttgtccataattggttcagcctccttatattgggtgagtggtttgaattcctcatcgtgcatgtacttctcgtaactgatttgatgcattttgctgttcaagtaaacaaaaaaaagtagcacaggtcaattagtttcaagaagcattggatactaatgacaatattaaaagaatgaattgatgaacaatacaattactcttcactaccaagcaatgaactcagtggacatattgagacatcacgtactaaataatggatcaggttaaaattagaggttgaagaaaacagtcgacagaggtccataaatatgccacttactatctgtctatctccatcccgaaaagcatataattctggctagatgcatagccaacttacaattttttttttaacggagctagtactctctccttttcaaattgatcatcatatatatttatgcacgaagactaaggataatttaaatcatatcaatcaagacatcatgcacatattttccgacaatgcatgtatcgattaaaacaccatgtcaatcacaccttagcatgtacacattctctcatgctacattaattgtattctgatgaaatctgtatccattcggttatatgataattaatttaagaaattttgaattccattatatgatgatcgatttggaaggagtaagtaatacacaccttacacatataagccatggataaatttgtccatcgatatggacatcaaatcaatattttagtctctattgggtagggtcaagtccctataactgtaccaccatgtgaagaaacctctcactgacaagattgacttggtgtggcaaagcatccaaatgcattgccacattatataatcgagaaccccacatagataattcgctaaggcattattcggtttggaggggattaaaggagaataatttcacactataataggtgtgggataaatccctttcaatcctttcattttggggattaaccgaacaaggcctacaagaggaaatttaggatggcactgtacgggactcggatcctcttcattgctgttgctactgcagagaagcatgttttgtgcattagctcaaatctaggccgttcatccaaaagaaatggctgtgatttcttcttgcttcaatctcttccatacttccacttctcttgtgacatatacattagctctgcctcctatgctcatggtcatcagttcatatctatgctcatggtcatctcgctcatggtcatcttgttgtgacggacctcccttgcctttgttggcttaataacttacccgtctattccaaacatctacttgtggaaaaatttctaagcggtaacttctttattttccgttagcacgcttcccgaacagttaaaccgtatgttatatgaaaaatatttctatataaaagtttatagtaaattaaataattaaaaatagtcatgtccgaaggagcgattgagattagtattttagtgacacgtaaaacgagacaagtcattaacgcataatcaattaactactccccgtttcatattataagtcactaaccaaacttgttaagtttgacaaagtttacagaaaaaacaataatatttttaacacaaaacaaatatattattaacatataataaatgatagttttaatgtcactaatttagtgttatagatgttgctaaatattattataaacttttgataacgagaaacatactcatagagaacgaaaaagttacagttagaaatcactctctagaactcagttattaccgtgagtacagtgatgtgcaaccccatgacatcatttttaagatcaccacaatagagtatgaacagataaatttgatagaatgaagccatgaagacataaagtgtgaacagacaattgatttgatggttgagagcagaaagagctagagttttgctagaagtacgcaaccgtccttgcttggatggatggctcggatttgagctaatgcacaaaaatgctcctctgcagtagcaacagcaatgcagaggatccgagtcccactgtacggtgggcaagattgatgcattgcattagtttgacttacatacaagaagcatgatgtaccaaaataggatgtgcaaaacaggatcaaccactacattcagttagaaatataaacagcattacgcatccgttctaagaaacagacacacaattaatgaatgttcgaaagcaacaattgcacctctggattttcttccatatattttttttccattacaacgaagccacacacataagggtgcatcaagttctcataaacagtatcactcatccgttctagtacatgcgtatgcttgtgagtcttatacttttttatatacataatcaaacacaccatacatatgtttatttattttagaaaagatgaatcaatatgcctgagaaaatcataaatcgcacacacacatatatgcatcacgccacgtttgattcatggagctatgcaccttgaagcccgtaacaaacttcatctaaatcagtgatcagtgttacaaaaaggtggctaactcccgatctgtgtccgaaaagcaacaattcgacctatcagtcgaccccatctgtcgctcctagcgggaaaataggaaaaaaaataaatgaaaaaaaaaaacggatgctgaagccgacagattggctaagcatttcgaagagatcttcccaaaaacggaaggattcgtactaaaaaggcccacccacccgaaagcacacaaagggcggtggatcggtcgtccgatcaaaactcatcataggatttattaaagctggaaaaaaattaagcaagatgtcgtgtaaaaaattaagcacaacctcttgaagagcggaagaggccacacacgagctggccggcggtaaaactccggcggaagaggttggacttaccggagagaaatcacggcggtgcacgtaccggagggttttggcggcggcggccactcttgtagggagtactacgcatgtgtggtacggaatgtctctgtcacgtacagtggccgtcgctccatctgacagcagtggctacgctggtttgccgtgggcccaatctcaggccctacccgaatctattttccacgtggttgctcctagaggtgacaggtgggtgggacctgagagctaacggggcacgacgtggctgccgcaacagcaaaagtagagcacataattaatacaattgagccaacataagctacttcctccgtccaaaaatatatcgatgtgatatatcccaattctacgaatctagaaaaaaataataggtatatcacatatatccagaaaaaattgaccatggagaagaagatcaaagtggagtggccgccgagagcatacgatgaggaccatctgccgctggccggtggcatcaaagtaattggaagagcccccgtcgctgctaaccggtggcggtggagccgggcggaaattgaggagggatatgccccggcgagaaagctaggctagccttccccgccagagtcgaccaggacgccgatggcgcccaagagcgtcgcagctagctggtaccgcgcgccaccacttctactgctcccggcgccagcgtcgatagactccggcgggcggaaaggctgagcaaattgagaaacggagaagctcgatcgatttgccgccgccatgtgacacagctccggattgacttggggtcgacgacctctctctctctctcccttgacgaccacgatgcttttgctcttgcaatggatgccgctacactatcatcgtctcgttgacatcctcttctactgatccagagcaggtatacctaaacgtatttatttttaatgactcgatcgtaataatgtatagctgacctgaccctttcaaagtcgtctccgtatttgtaactacgacgcaattctctgtagctacattcctcgaatagtctcacaacgcgcacctatgcatgtactcacctttatgaacgcagatacatacatcgtatcgctacgagttttcgaaatttttttcgaaagattaaatcgacatatctaaaaattaacgaaatcaagctaacttaattcgtggaataaaatttccttttaaggaagaagaaggtgcattgttttttcagcaggaagaaggtgcattattgttcccggcacatgattgacgggacggtacgtagtttttgaattatcttgccatgaaacaaacaagcatgtatggacttggtaatatatacggtatatcgatcatcctagtttacgtttcacaacgtaagatgttttttgttttgaatatattcatgcatggattcttacatatacttcatatatgtgtgttcaaattaatatgcatgttagtgaatctaggggagggacatagaaatcaaaacatcttattgtgtatacgtgtgagagagagtatttatcaagaattttcccaactaatgctgtacagatgatttcttttggatttttgtttgattcaccattcacgttatgacctaactcaatttttttcagaaagagggcgtcctggaatatttaaaaatttttaaaaggacgatgccataatgtttgggtgtttgaatgtaccaacagcctaaataatccataaactgttggcccactaaccggctcgttttctcattatccaaacatcacgcgacccaattgagtagaatttatttggaataaattcacttaaggtctctctatttgtcaccgagtttagaattcacccttgaaccataataccatgttttggctcatgtggcgtttacgtgacattggcgtggcacttaaagttagagaaaatcatagaacccacgtatcagtaagagtcggtttaaaaataaaagagaatacctaactaacacattaatagattaactaggtaactagtaattaattaagtagaattattatttcaattagcatcattagaaataattaattaatcgctaattagtacgattaatctgctctgtgagaccgtggtggtatctcgcaccgggttcatattctctaccatagtaactatctttatacacactgacatgtgagacaataaaaatgtaggacccatatattagtagtaaatgtaatagtagtgatagtcaacacattatagtaaggatcctcaagcggctgccagctgacagctttcaaactcatcatcatcactccccaaatttaaaaggagtccgtcacaactctcctgctctgccgccgctgcagtttagatctcgaaattttttcccccttctcgctcattcgctcttgctcctcctggctgatgctgccgccgccgccgccgcgcagcaaaatgcccgccggacggcatcgccgccgcttccttcctccacctccgttataccatccatccccgctgcagtctacgaagtaaggatggcggtggcggccgtcgctgttggtcagccgcagcggtctcaggtagccaagttcttggtgacgtaagagttaagacttggcgccgttctatttgttctacattaccttattacatcgcccttctgtatttttttgctttcggtatttttgtgtcatagattattactacccatagtattgatgcatttctgttaaaatggaagagtgcaatatgaagactttgccaggataactacgctgtatctggttggtatttgcaaaacatggcaactagttattgacaaagaatcatctggccacatactatgaaaaactcgttgtcaaagctgaacaatctacattgtttctacctgttaaaaactgttctcatatcataagttcataacctgatgtcttgactagtgtcttcaaatgtcaccaatttactcaaattaaaagaacgatacccaggtagaagcgcattccaaattctaagagttctcacttcacactttaattttacactttatgactactagtattagtttcagatctgcaaccaattcactgcattttttttccagagtagcagtatcgacataatcaagttcaagtagcagagcaacattttagtagcagctcagagtaataggggcctgtttggcacagctccagctccacccctcctgaagctggagctcagccaaacagtttcagctccaccaaaactgggagtggagttgggtgagctctctcacaaaatgtactagagttgtggagctgagtttaggcagctccacaactccactccagactcaactcctggagttatatttaggagttggagctgtaccaaacaggctgcagggaagccggtgaattcagatcgttagcttccccggattgaggttggggagtgcggatcagctgaatgcaggcgtcgtctcccagccgagaaaatcaagacaagggaaaggtgaagaagaccggggatggtggtcttcttgggttttgggggaattgcacatagaatattagaatgatatagaattagggaggtgaggtgacatactgtaggtgtttattggtgtagttgctacaatgcgaatttgcgaggtcacacggcacctctccgttcctccctgcatcagaacaatcatggccattcattatgtgatctaacggctccgaacgatcaatatagtataagcaatagtagtagtcagaaaagttttttcgtcgcggtacatttgctacagagtcatggcaatctttagccgtttgttcctgatcttgtggtatgggcgtctccgtcggcgtttgcggcagcaatagctatctgaaggaatctttttactcttaaaaattgtttgcaatacaaaattgctctgattgtggaccaaatgactagccagataaagatgacggacccttatcggtgaaccgtgatgcaagacagtgacacgtaattaagactggttcccataagacttttggcggcgctcccgtggacggtgcatctcgttcgttaatcttatttgttccaatccagtggaagtgcacccgttagctccctgcttcctgcacacatggcgtgtgtgtgagagaactgagaaccttgtacctcatggcaataccctggaggcctggaactggcaagttgccttttaattccaaaacaaaaacaaaataagagaggaaaagaaaaaggaaaaacaatgacatactttggttagcttatcttggacaagtcttctttaaaaaatctctcggacaagtgaatattattaatgtatgtactatctccaaatagtatcctagtacgaggttagatataatctagtattataaatttagatatgcttccctatgcagatttatagtactagattttttgtgtatagtatactaaagggtgaatagtcaaagtagtcctccaagttttatctaaggctcagtttagttcttgatgtttcaatctatctatattagtcctttaaattttcattttagttcaaactcattcttaaaccaacaactctcttgataaatgacacttataccctcatcattcacatatataagagaaaattgcatgcttgatttttttatagataatgcatagtaaattatgtaaaatgaaaacaaattatgtactagcaagtgtatatgatagcaattgcttaagttttatgtgcacatgttgaaataatgggaagtacatctgcaatgttgtttattcatcttggttttctcttttctatctagtacatagctaaatacaaattaagggcaaagggatattttctaatagagatattgactacaaatagccatatggcatattaaatggacccaaggataattttaaaccaaaacaaatatttagaggagttatgtggacaaaatgaaacgtgaaggaccaaattgagccttcgatgaaacttgaaggactaaattagctattcaccctatactaaactaaattgatataattttgaaatggatgaagtcataactaattatttcctcttaaccctatcttgcaacgtaaatatacgcttcagtctcttttttatatacatggaaacagggcaacaactgtctcacacggtcactctcaggcttcccaacttttccgtatactctctccatatcaaaataaaccaacctagctataaaaaaatagaatttagtacaacgaattctgacaggtttttgtccagtttcattataccaagttatatcccatgtaacctagttggtttatttaaacttgtcacacctaacctagttggtttattttagaatggaggaagtaattgtaaggcatgatgctgaagtcatatacggtgagcccttatggatggaagttttgttttaaaaaaaaatggagaaattcaatccaaagaaataattcctacatgagtataggattataggattgcttcaaagataattcaaatgataacgaaaaaatcctccatattttgcaggaattctagcaaggggtcgaacctcattgtttcaaacttctttgagatttccaaggcactgtctctcaatctctctacattcttattaggaaaaaaatctaacaataatacaattaaaatagctttcacccattgtaacgcacgggcattttttctatttaatccaaaagaatgtgggactattcaatagccgccgctgttgccgcagacagccaagaagagccggagccatggccgaattttttggggactttgtgaagggagaaggtttgccggaggagggagaggaaggtagcaagccactggcgacgaagtcgagctagcgatggcggcgatgtggttgtcgacttctcggggaaacgatgggattgggccaatccagtggatacccatgggttgaatctaatctggaaccaaacttttgcagccaaaaccaaacaatccaaaccatttcccatctccatccaaaccagtccagtccatcaggtgcaccaacccatttccacccgcccaaagctaacccacactgaaatccaacccactatatccatttattagcaggcttactcgtgtagcagattagctcatgcaaacgctcagtcgaacggagccttagcgcaaactgactacatgagaattgagattaagccgcgcaaacatagcagatacttgaaatttatttaccagcatacatacaacagcactgcgctggcgctgattgcttcactataatagaagcattcgagagacctgacatgttccaacctctcttacgggagaaagaaaagaaatagtagaaccactagacatggaacagcagatcattacagagaaatgatcatatttatgattcttctatctccattttctgctcttgttcatcttgacagctttcagctcctgcattcaccacagccttgcgatacttctgattataccgcaggattactaccgaaatgaaagctgcagataaagaaatagatccatgttagtctcatatttaaattagaaaggcatgttgtgcatatctgctaaggctgttcagatcataatgaaaacttaaaaaacgaataatttgctacgctgtatgaaacacaagaaaaaccgatcacccaaataaaacacatatatgctacattatacattgcatatcagctcaatctatctattatattattaaaacagccttgaaaggaggcaccacgttcgcggtagaaaaagagaaatatctacaccgttagatcgtggtgggtccaaattataacggtgtagatcaattcataacttatatagttatgaaatagaatttgtattcaactaggaaaaggatattccatctctctgtattggttagcagcatatgcatttacgtatattggagtcctgatagtatttccgtatggtgtccgatttgggaaagaaaaaataaagaagtttgcatgcacagcagaactggaaaggtacatgcgggcataactacacatgtataatcacatattactaccagtaacatagcatttgttgccaagtgttaatttactgtgtattaaagaagacattacgttcgttcattgtgtaggctagaaattctcacatcaattaatcagagaaaaaatattttaatcgttacatcatgatgggtttagataataacaacatatattgactgatatagctgtatgtaaaatataattgtatctgtataaatagagttaagagttgtatatgaaatctaagcttatagaaaaagaaaaagttgtatacgaaattaaaatatacttttatatgaaccgtaaaggagtagggtggtccagaaaactatgaaatagaaccctaatgacgattaggtttgatttttagaatcccaataatataaataggagggatggcgagtgggccataaaggagtagggtcgtgatagttgataggacttttatagagtaaaaaagggaccgcaacgatgatcaggttcattttttaactaacaatgataatagggggagcgggcaggatcgggtcataaagatgtaaggtggccacatttgatgggatctctagaaactaaaaaacgaaatccgatgagacaataaactctaaaactctattgtccgatttttaaaggtcgcagggaagatgaatataagccgtggcgggctgagcaacaagtaaagggggtgtcagttgtgtgactttataaaactataaaattaaaaacccggtgatgataaagtttgattttgaaaatcctacaacaatgagatgatgatataataaattttataaaaatcatgtgtaaaaatttaaataattttttagagaaaaataaatatttttctatggatgctagccgcgcaattgcgcgggccaccctactagttatcttcaaagcatgagttttttatcaaataatagcaactcttcattgcagctcatgttgatttcaagtggtgcaagtaaaagagaaagtacaagtaggaggctattatttttctccaaaccagacagtttttcatcacaatttagaggcaacaccaaatacttccaaagaaaatattttttgtatcacgcacaatgcattacctacttatagaaatcaatggtctcaatattccattatgtttctcactatgggttcttgggttggtttatatgatctttaagttaggcttccaaacacaacactcctgctttgctactcttattgtatagcccaagtataatctttgcaacaggatacatgctggtggccggtctgagacagtcaacatataaagaagaaccatctttctacttgaaatttttcagtaggttcctagccagttcataaaaatggtctccttacagatgtgaccaaacactgtatcgaaaatacttttaccagtacctagtggatacataacatttttcatgaaaagtacaatggttataaagttattccaacagtataaaccatatcagcatagatacctgcaatgatgcgggtcttcacactgaacatgttccagcacattgtcactgctgtacccgcaacgagtttcttgcggggacaagacttccatgcttctagagcccgatctctcaaaatttcaactaaaaagaggaggaaatttagcctagcgccctgaccaattgacatatagcacggagaagggttaatccataaaaacaagttaattaaaccttttttaaggattgggttggaaaacaagtaataagctttgggagtgtaaagctggtgaaaaaccctgcaaagttccattaaacacaacaagcttcagcagagcagtcaccctaaacattgatattcttctttgtgtatacaatcgtacctgtggccagaagtctccatactgtaaccagactaccgtatttagcaccaaacagaagagcaggtaatacctaagattcggcaacaatagacttctgtattactcaggggaccgtttgtgtgccaaaagaatgtcatcaaattcggtacatgcttactttgagagtcatcgatggttcaccagagaagatcacttgtgcagttgatatcatggagtttgcaactggcaacacggctcgtgcagcacgaagcacatcatcttcagtcaatctgaagctccttcccctctctacctgctgcctgctgcagatgagaactcagattgattgccttgattgaaatgggtttacaaacagattgccactggctcatactgtcatacctctgaggaatggaatctttgaagaaggctaagcccaagaccatcacacccaagtgacaaagcgccgagattgggctgcagatcatcacccgaaagccgaaactcagtaacagtacatgatcaaaagaacgaaatgaactgcaaagcaggaaatccaggtagaaggggatcagattgcgcaaacctgaaggtgatctcccttgaaaaggagcaggagaagaagaacatggatcccaacccaaaccagagtgccgatttcgccacattcttccacatcaccaagtcgacgatcctttcccagagatcttcccacccagactgctcgagggcatcagcacctgcgccacaaatcgagatccgattagacacgaactcgaggaggcaattccccatacacaacgagagcaagagcaaaagagagcatctggagcagtgattttctcgaggcaaaaattagccccaaaccaataagaaccaacaagagatggcttcgctaacctcgtatcgcatcggtgctagccagcaccaacgccatgctcgtatcctccttatccgccgccgccgttgccaccttgtccgcggccgcaggcgcggccttggtcgccgccgcccgggtggacttcctcctgcgtgccctccgcgcggcgtcgtcctccacctcgatctccttctccagcctccgcctcgccctccgcccgttcctcggcgacgccaccgcgggcgccgcgcactgctccgcggccacgcgccgcctccgctcggcggcgtccccgccgccggcgccgccaccatctccaggctctcgtccaacccagccccgcgatgccgcgaccagttgcggcgcgccgacccgggcggcggggacatcaggaggagctcctgcagcgagcaccccgacagctgcagcggcgacggcatgggcgacgacctctgcgcccccgcccccgccgcggacttccgcggcggcgtcgcgacctcctccaccgccgcagcagcagcagcagaaggggagtggtggtacggcggcgcggggagcctcgcgggcggcgccggcgacgaggcgtggtcgtggtcgtggtccatggccatggccgccatgtgttcgtcgatttgcctcgccgcgtgctttggtcggcgttggatttggaaggtgtatttggcgtattggagaaggttgggttggggtttaaggaggtgggaaagcgagagcgggtgggggagatttttatggggcccacgtgtcagtgtgcgtacgtgcgggaatatagccgttggggaaacgggacacggccacacggcaagcggtggtgcttttccaggtgtcagaatgaattgcggtgatgtggatgacaggtggggtcatgtggaggactgaggagtgggtccggcaagtcggtgagggggagtttgaaccgtttcggagggtggaagggtggttggtgaggaactgatgaggatcgttaactcacactctcacagtgtggagtggttgaaggaaataaagctcgatagaggaattaagaatggtactactaggcctcctttttattagcatatttttcactctgttaaactgtgcatttcatacagtgcatttcatacgtaaatttatatagaaattactataaaatattatataaatatgttttcaagattaaaaaaatttaaatttaattaattaatcatgtgttgattgtatttttgttttatgcacccatacttaatcttcatttttagcactatcgaatagcctaaattctcaattcgttttcccatttgctatttagcctcacatcgttttgctctatggctaataaggcgtaaattaagcaaggcaattataaataatttatgagtaaaacttacatatttatatttgtatgatttataagagctaatgttaaaaacaaactacactaaaacttaaaatcaagtttaaaatttaaatttggcaatagctgatagaccaataaacaaatgacataggtgtcaaataaagttgattgccgatgtctattatacattaagtgaaatgtttgttttagagcaggtatagtagttagtgaaggaataagttcaccagaggtcactcaatataacagcgagagtttttttgaggtcccttaactacaaaatcaaaaatgttcacttctaaactcactcaaaccgtgcaagggagatcccatggcagtatttatgtccggttttactgacgtgtcattctagttagaaaaattaaaaaaataaatatacagggcccacatgtaagcgatggtgtaggccccataactctcctttcttgcttttccttttctcttctcttctctccttctctctagcaggcacggcggcagactcggcgtgaggcggccggcatcgaagcaggggcggcggtagcgggagagggggagagacggccggcgcgatggcgagctcggcggcggagagtagcggcgcgcggcgcggcggcgagggagaggagcggcaggagaggggtcgccgtcggtagcagctggccgcggcgcagcgcgccttctgcctgccgctcacggggcacgtccttgccgccgcggggaccgggaacaccacgcggaggcaggtgctgcaggcgctcggctgcggcaggggcagcgcggccgacgtggccaacgtgggggctgcggctggcggcgtccgtggcggggagcgccgcgggcgacgagatggccgtccgcgccgcgtccgacggcggcgccgtgcgcgtgtagaaccgggtgatggaggagtggcgccgtgcgctcttcgtcgccgcgcgggagaggcccggcaggcgcgacggcggcgtggctgtcttctccgcgctcaccggcgacctgcgccatcgtttccgcgtcgcgcacgaccgtcacgtcaggtccttcacccccggggcgctcgccttcgacaaccggtgcaaggcgacaaccggtcctggtcggcctcgagcagctgcgcgacctctcgacgcatctaccgcacctgtacctccttgcggttcctcagcagcttgatccgcgccagcgccatccgcagcgccgtcttgctgcggcatccacgagacaaaaaagaaaagaaaagaaacactgttagcccttgcaagcacgcgccgtctccgcgcacacaaacgcgcgcggagagttagcgaggacgagatgatcttgggcaggcaggcaggcaggcgggcaaactgaccacttgtcgggcttgaagcccatgtgcaagacgccggacagcttcaccttgctcctgtgcatctccgcgcgctcggtgacgccgacaagctccagtggctcgacggcacgggcacgctcatggcggcgaccatgttcccacggacagactccttcgtcagcctgctgttcatgcgaaaaacacatactagtatgagagatctgcttaactctagtgcaggtcctaaatcttgctttcgggttcaaaaacgtgccagttgatttgattctgcaatcaacaagaaagaaaaacaagaaaacaaggttaaatcaataaacgatagccaatcggctaaaggctgatgacatatcgttaattattgagccaacgttattggcattagatcggcaatgaagaattaaacaaaataaagttaaatctgctcgatcggctgtagatatcaataatatataatctacttctagaagtatatttaagccaaatgattgggatagatcggacagcaagccgagacagtataaatcacttatgcttaaaagtactttaagacgaagatcatatatatatttataacatagccgatgaaacagatttaacacgtatcgactagtactccaataccactctatattaggatattaaaagcagatagactataccagacaataggcctaatatattttaatgcaataaaatcttaatataaagggcagatttagcatattgagtagtcatgtagagagcaaagtagctaaatcaggtaagatcggctgaaactccgatactatctctattgataattataaaacaagttagaattatagctatagatattacttagtaggtcgaactcgatgcagcattaagcatagggacaaatataatatctacacaagttgatgaaaacctctgcgagatggtaaatatcaatgttgctgtctaaccccatcagcggccttctaaccgtagatgttaaccgatttagtgttagacaacgatattgatagaaattatatagcatatacgataactcgacgatttacataaccaagattagagtgtcataaagatgtaagcactaatcccaagaacgcaagccgccatgacaagttttacctcttgttgaagatcgaaatcgatgcagctcaacccaaaagcaagaactcgttgaaacaataaaaataaaaaagggtggcgatacaccgaaagtgttattgaactgtcattgttaattacatgggatcgggttatatttatacccgagatatatgacagttccttgccggacacgactcttatctccaacaaaatttaagatacgaacaaattgtaggatcgagatgtcgactagaggggagtgaataggcgattttaaaactaaatggcacctaatcaaaactaacctaagttgctaggcttggtgagggttaagtctaactaagcaactaagttatgttttgcaaacctagggtgatagtggctcaattaattctctaggaaagtaaatcacactcctatgtcaaagttttgcaatcctagggtgatatgatctcaagtatgtctttaggaatataaattacacaaatataaatgcgacaatcaaataagacaaggagacaagagatccctccacaaattggttgttgttctaatttaaacgaaggcccggtttagatggcaaaaatttttgttttggggtgttacatcggatatacggacacatatatttgaagtattaaatgttgcctaataacaaaacaaattacagattccgccagtaaaccgcgagatgaatttattaagcctaattaatccgtcattagcaaatatttactgtaacaccacattgttaaatcatggcgcaattaggcttaaaagattcgtctcgcaatttacacgcaaactgtgtaattgatttttttctacatttaatactccatgcatgtgtccaaatattcaatgtgatgggtgaaaagtatttgttttggaaacaaaacagggtcgaagtttcagcttgtttctagtttccacttaggcctagttttttttctcaactccaaacttcaaatttataatagttaatttataatagtatatttaacatatactctactgctatatagttaaatattagaatgtttaatcatcaaccactataaattcatatagtttaacaccataaaatttttattttttccactatgataaatacttttataatatataatccacatcttgttaaattatagggatatccaaaaattaagagtaaatttcacaaaaactaaatgtacttttaccaaactatcacaaaactacaaatttaagatgaaatatcataaaaatataggtttaggaataaaatgatgacaaattacatgttctgcatgactacaccaagttaagtacaaaactacaatatttataactctaacataatagcagtgacatgaattcaactgtaaaatatacagttttgtaataacttgagtattaaatctacagttttatgatacttggccttatatatgtagttttatgataaatcttgtgttaaatatgtagttttacgatattttgatctaagtacttatagttttttgtgaaatttactcaaaaactaacttctaaagatagacacaatgaaaaaaaaacccataagtaactaatttgaattggtttgctcaaatcagatgcacatgcgcacacacccatttagtcctacacaaatgtgtcgtatacaggctgacgtattcaaatcaactgtaaccaagaatgacttacagttatagattacagcatttcccgacaattaatacattacaaatacaagataggtttgagttcacctgccggaagaatacgatatacatgtttgacaaggtaaatgatcatcttggtcacagcaacagattattaagaacaacatttgggtgccccaacgcgtagttgccgatgcaccacaataatgaaatatctcaacacctttgtgcttaggtttccagtttgccatgcctctggcagaaagattttatcctttcaaaggcatccacaagagatggtatatcgatggcgaaagtgatgcgaacccaattcttcaatcctaatgcactccctgtaaaatatttttttttctcctgagaaatactcatgtgcattggggcagaattgagtagccaagaacaagaaaaggcgtgccatctggacaaattaaactccttttcacgctgtgtcttatcttaacctttattttcggtaatacgcaaaaggtttgtgtatcgttgcattaagagaaataaagttcagtacaaataaatacaacagaggtaaatgttagcctaattcttgcaagtttcttaacctttatttgtgttgcctttccatgtaaggttgtagaatatacctactagtgtactacacattatcattaggaaattggtgaatggtgaaattgcattctaactaacattgtttagtatacttacactatatgttaaagcaatgacaaaatggctgagatataataggaaggcatgccatatgataatcaagttcaagacaatgtttgaaacgcaaaggctgctatgaaaaaaaaaacaatgcaactgtgtctcgcaatttaccatgatgtctctgttataataatggaagaagcataatgaaactaatcagatgctcaattcgtttcgcattagggtcctcttgtggagttgttgctaacaatatgactccattgcagacattaatgtgtagttgttccagtgtatttccactatgtatccataaaattcttaaaacaggttgacacgttgagtggctgtagtacagtatttctgtgcacatagtggattttgatttatattgctaaatggaagtaataatggtcgtcctgtttttttaccatacaagaggttgaacatttatggaatttgtacctggcaaaactatcacagactcctcttttgccaacctgcagcagaagtccatatcatcatggaagccatccaagtaagagagatccaattttacctgaaaaataaaggatagacatgaattagatgatgattgagattaggatacaaaactgagccagttcatccagagcatgttagcctgtactttttcttaccatcacaaacattgatccctctggcttgtgtggacatgtaatgcccttgatgtcctttattttatcataacataaatccgctgcattccttaattgatcgagaattttgttgaagtaatcttcttttgtgttggctataatttgagggattgctccctgtgaataagaatattagaatgtaacacactttctgaaaaattatgttgccatgcatgtgcatgcttgttagagagtttgtgtccagaaaaagaggaatatgtctgtaaatcatattgccataaatgatggatgtgaaaataagaaaggcacatatacctgaacaaacgttgcaggatcagttgagatgttaatatagttctcaattgattggttaacctgtcatgaaacattttagataagaaatccaattgccagtgcaatataattattatcctttttttgtgaggaatataatgacaaaatatccccttcaaaatgtaattgaatgcacatgcagcaactaaaaagaaaaggaagggaaagatctgggtagcatacaaaaatactatcagccaccgcaaaatggtgcactaacacattattctagattctatgctaccaacgcaaattaaccaagtatttctaagaagaaattatcaggctagacaaatgtaaaaaacctagccaggtgtgcttatttgctaaactgttttggagcctggaatcaaagaggcatcaaattcatctgcacttctgcagtttacccttaggcagaatgtgcagctttgttaggcaaatttacgagcacaatacaacttcgcgaaccaatagtgaacctagtcatggatcaaaacaagatatgcattggatgttggaacacagatcgagagttaaccttggcttcctttaaaatgccatttggatcacatgttgctatccaaccaagtcgccaaccaggtacaagccatctttttgaaatagatcccaaggtgatcactgggacggtcttcccaaaaacaccaataggtataaaaggattattcccaaatgccaaatggtcatatacctcatcagcaattatcagcaaaccaagtttcctggcggtctcggcaatctgtttgttaaaagcacataaatggcaaattgcatcacacaacaaaatacccagtaccttacttgtccaagaaatatactcacttttgccaaatgatcatacgaatacacgcttccacaagggttactgggattgatcacgacaattgcaacagtgttctcatcagcaatagcttgcacaccctctaggtctacctcccagcctctctctggaatgagatcgaaatgtcgaacctctagattgctgaatgtagtccgtgattcatacaatggaaagccgggtttgggaagtaagatgttggatccgggctgagccaaaacagagatcatgacttcgatcgcttggacacatccggaggtcaggtaaatatcatttgccgaaagctcataaggaagatctcgagataggtattctgcaatagcactaaagtttaaacaagtaaatatgagagatacacaccattcaagattgaaatctttgggaaaatatcatgcagtattgacaagcaggaattttaaaaaactggtattgcaagtaagagaagctaaaatattttacagatgagcgcctgacttagtactttttttacaagaaatgcacagagaattcttttatttagttaagaacaatatgaccatcaccacaagaaaataagagagaaggatatgaacatgcattcctaagttggtaaattgtactactatatggataagaaacaattagaacactgcagatccttttctttttcctttgaaattttctgaaatattgttccacactctaaacatgccgatttacattttgttagttatttagtgcaacaaaacatcaacaaattcccctttctttcctcatcaaaatgttaggagtcaaagcatatctacatccatagaaaagagataagaatgacaaaaatggaatcctattcctccatttgcttttagtaaaaatattattattataaaaaggaatcaaatttccagctccatattgaaccattctccattaaatttacctcgcaggtaaatttcaaagtttccagcttggaaggtttgaggccctgtttggtatcccagcaacttgtcaaaagtaccttttgtttttttcctattcttgaaatagcatctccctatgtactcgaatatttgtccaagtcaagaaagcaccggtaaggcaccagacaaaataaatgctcaatcggccagaaattgtttggtgccaggggaaccagggaatccggtgaatacactgtgatgccgggtttgaaaattccaaaataaatcatggatgtatcataaatttaatttgacagtcaccataaacattgaagaactgtttccttttctatttttttcttcttaccggaaacaagaggtgaaaaaaatatgtaattacaacttcgtcgtgcaaccagtatgtgaatgaggagtaccaaacatatcttccatggaaaaaagaattcaaactagaaccacaaaataattaaagagagaagaaaacaggaaccaaataacataagctaaaacatcaaagagttttctaacaaaagagctaaaacatcaaactacacatactttatgcagttaaatttgttgaaaatactaaaaaaaatccaagtatgcaaaatgttgcccataaaaatattcaaatctgtttttctgatcagtcacatactagaacataagcagagcacagtgtggcaagggggggggggggggggggggcagctcaccggcgcgccgagaggacgccgacggttagggagtagccgttgtgcgccccggagcggagcgcgtcgacgacggcgtcctcggcggcgggcgcggtgcggtagcaggcggacgcggtggggtcgccgttgccgagccgcaggacggggcgcggcccgccggcggcggcggcgtcgacggaggagttgacgcggttgagcaccgcgcggatgctcgtgaggccggcggccgccaggggcccgcctgcgacgacggccgggagaagcgccaccgcggcgtggcctccgccccgtcgtccccgcggcgcttgccgccaccgacaccctccattgttagctcgatcggatgccgctcttcgagcggtttatccaaatttgttcgtttcgaaggtgaacaaaaatggaaatatattctccccatatatcggcggtgctgtaccctgtactgtactggctgtgcatcgtcacagatgtcacaataattatggtgatatagtatttttaataggaagaggtagaacatcacgtatcacgtgaacgatttgtttaacattattggttctaaaatatactccatctgttcaaaaaataagcaatttatattttgtatcggtactgcttgtccggttgttatatccagtatccacaactctcatttatttaaggcatggtttatattcaaacttttttctttaaactttcaactttttcatcacatcgaactttcctacacacataaactttcaatttttctgtcacattattctaatttcttcaaacttctaattttgacgtggaactaaacacagcctaactttttctcttattacaccaaccaccctcatactcagccatgcatttctaagttccaacgaaggctctgattagattccaattttcttctttaaatttctaactttttcgtcacatcgaactttcctacacacataaacttccaacttttctgtcacattgttccaatttcttcaaacttcctattttggcgtaaaactaaacacacctgaaatggagtagtatttcgtagtcctgtcttggtccacaaatgcatatactgtatgctctctttcgttccataatgtcatctagtgtccatagcattaaatacattgtcacataagtaaaaaattctactccctccttcccaaattgatcattatgtaatagaattcaaaatttctaaattaatcatcatacaactgcatggatacggatttcatcagaatataattaatgtagtatagtatgtgaaaatgtatgtatgctagggtgtaattggtatgggattttaattgatgcatgcattgtgggagaaatgtgtgcatggtgtctttattgatgcgatttaaattgtccttggtcttggtgcataaacttatatttgggaaggaggaagtatgtggcaagagagttaacgaggagatatgtaaaaagatgaagaaatcatttctcatgcaagaaactatctctacacaagaaccaataatgaaaataataaggggatagatagataaaaggagagagaagagaggtgattggatgagaatttaattgaacacaccatccattgaatacatagtttctacacagtgtctatatgatatggcaagtatagaaactacttcatagtttttggattatggatagcccaatgtacgagaccgttaattttttatcccaaaatatataaaatttagtataaatatataaaactaaaagttaagattatattttctttgatgataaaacaagtcagaaccaaataaatagtatttatatatttattttgaataaaacaaatgatcaaatattataaaacaattcaacacatcatacattttgagacggagggagtatgtacccaaactttaacaacacattatatgattgaaatatgttaaaagcttagtataactattttttttcaaaatatgataattgaagagttaattctagtgaaaattgaatcctatagaatacctcattctatggaagtcccaaccttatagaaagtttgatttgagtctttatcctttctaaaattgttgtgtttttttctacggtacaattaaacggttattctgtaatttttttcttttttaataatcttttttagtacttgcattcttataaaaattctgtgttttctttagttctctgttttaatcctatatctatacttcctataaagttataacccactaattctaaaacttaacatgcaaccatgccacatcatcatccactagcaataattatatattcaacctcatacaagcaatatcatctacaatctatttaattctacaaatcaacatgcgtccaaacatattcaatcatcatctctcacatcatttccataatatttttataaatatatgtatcatttttcggtagcgctattccgagcgctagagcgcggaatatatatatatatttgggaataggcgaggggcgcatctttgtattaagaaggaataaataaaaaacacgaaagggacaagattcaggaggggggaggaggaagaaaataaaagcctaatctcccaacgaatgtggcgaccttccacccgacataagggtcgccatggccggtatcgcggctctagccaaccgccaaaggtccgcttcgcccgtcatgtccatagcaatttccgcccatgtcctgctcttttggttgaagacctgattgtttctttttttccaaatcgtccacgccaccaaagttgcaatggtgtcgaaccctcgacgatgttccttggccattcttttgcgactgtcacacagccaggagtgaaaggaatgctcattgagaggcagacactcagaatgaccaatagctgaaagagcaatccaccatagctggaatattgttccgagcaccgcacatcacgcccagagtccgcaaaaactggtgtttgtttgcccacgttctatctgtctagattagttctatttaaatttggggtaaatcaattatagatccgtaaaatcggtggtcggttgaaaataattgttgtaattggtttatctctgtttccaatcaaggagctgaaagagcaatccaccatagctggaatattgttccaagcaccgcacaccacgcccagagtccgcaaaaactggtgtttgtttgcccacgttctatctgtctagattagttctatttaaatttggggtaaatcaattatagatccgtaaaatcggtggtcggttgaaaataatcgttgtaattggtttatctctgtttccaatcaaggtagttacgatatggtgtgcaacaaactgagaccaaatcttgtagtaatcgaattaacatcacgcccagagtccgcaaaaactggtgtttgtttgcccacgttctatctgtctagattagttctatttaaatttggggtaaatcaattatagatccgtaaaatcggtggtcggttgaaaataatcattgtaattggtttatctttgtttccaatcgaggtagttatgatatggtgtgtaacaaactgagaccaaatcttgtagtaatcgaattactgtcgatgtaaataaaaattgatggtgcatgtgcctgtagtaattagattaacgacaaccatgattagtgaaatcttgtagtaatcgagttactgtcgacataaatgaaaaatgatggtgcacgtgcttgtatgtaacgtctcgcctctcccagaccgggctcgcttacatctggccgctttcataggtcatagattgccatcacagaccaacacaagccttttctgcacactttgtcgagaccggcttccggaaaagaagttgcaacttattgatatgagtattctattaatcctattaagccctaggctgggatgtcacaccctcacccccttaagagagatcgacgcccctgtcgatcaacccaggccaggaacgtcccctcttggccacgtccatgtgtccaatgccagcgcatgtgccatgctgtgtgatcacagaccaacacaagcctttcctcttggccacgtccatgtgtccaatgccagcgcatgtgccatgctgtgtgaccactccgggtccacaccagccatgcataccatgccgctttcataggtcatagactgccatcacagaccaacacaagccttttctgcacactttgtcctcactcatgcgctttcataggtcatagactgccatcacagaccaacacaagccttttctgcacactttgtcctcactcatgcgcaatcaggaagaatttcctgatcggtcacccatcccgaaattgctccaagctaagcacgcttaacctcagagttctttcgagatcggcttccggaaaagaagttgcaacttgttgatatgagtattctatttatcctattaagccttaggctgggatgtcacattgtagtagttggattatgaacaagattggttgatcaaatcttgtagtattcgtattactgtcgatgtaaatgaaaattgatggtgcattaacttgtagtaattgcattattgctagccttggttgatgatttcttatagtgagtgcatcaataaggagggagttactggggcctaattagtttatcccaaataatacgtgaataaactttttacttattcattgaatcactccattcaaaatcacaggacaaaaaataaagattttacatgcacatcatagtaaaagcacaagaacaaaaattttacacacaaacacagcaatacacgcaatcgccagttccttgtgacggctgaatggagtttctgtccgggggggctaatgggcgatcgatcgccagggcgatcgcccagcgatcggatctgcccccctgcccctataggcctcccacttctccccttcctcatccccttcttctcttcctactacagtacaccacaaaaattttttaaagaaacaaaagttagaaaatttatgtatagaaatattatatataaaaaatttgaattcaaattcaaatttgaattcaaattcaaatttgaatcgggtatgtaaacttttgacttataaactttggatctataaactttaggtgtataaactttagatgtatagaaatactatatatagaaaatatttgaattcaaattcaaatttgaataggatataattcaaattcaaatttgaaacatgtatataaactttaggtctataaactttaggagtataaactttagatgtatagaaatactatatataaaaaaatatttgaattcaaattcaaatctgaattggatatataaacttttgacttataaacttttggtctctaaactttagatgtgtaaactttaggtgtataaactttagatgtataaatttactaaaataggaaagtaatgcggtgccaaaaaaggaaactaggtggaggggtggagggggggtgaatctgatcgccctgggcgagcgagggcgatcgctcacccagtagcatttccggtttctgtcctgctagagagagctagcaagaagacaaagcggcggagatgcaggctggagccaaggcagcaccaagtctagccgctgcgacctcggtaggagccggatccggcgacggagccaaagatggaggtcgttgttgctgttgtcaccgcctcactgtcataaactggggaatgacagaggtgatgaaacaaatcacagtttcttgccgatgttaccaaatcgattaaccatcacaaacaggatctccgccatgcaagggagaatagagaagcacgccaaaatgagtgctcaacccaatcgaagtcagactgcatacaatcaagaaggataaagaatttaattaatcatagattatatacaattcttgcaagaaataaagaatctcattaggaattgttgagagaactcaccgtcctcatgacgtccacctcgtttgccatgggccagacgtctcttcagcatcgatctgaagcagatgttgctgcagtgaggcctgaagcagtgccttcgcctcaagcgtcgccggccaccgttcaccggccaccgccatcaactgccacggtgtcgtcgtcctcctccatggtgcgtcgccgatctgtgggctgggatggtggatcgattgagatctggaaaaaaaggaaaaaaaatgaagtgggggcgagaggggttggttgggtacgggcaaaatagaatatataccagaagtagagaggttgtttttatcggagtaaatcatttactccgataatggtgggagcacgatgcgggacgtggggtgggatcgaaagggaagttgtttttattatcgaagtaaatcgtttactctgataacggtaggagtgggatgaagggacgtggggtgggatcgtaaccagggaagttgtttttatcaaagtaaatcgtttactccgataacggtgggagcgggatgatgaaatgtggggtgaggtgggcctggctgatacacgtttggcgcttggaatataggagcgtgcagtgctcccaatagtagttctaatcttttttataatatttaacataaacttatcaatatgttccacattgaagtgcgagattcatttgtttgttttatgctaaaaactgtaagacctgatatttcatttgttttccttttacccttggcttgattgtaaaaaaaaatatatattgaaaagtactaagtaatccccgtagcaagacgctgggaatcacttagttttaaaggaggcctaactgttatacaatgggatcggaatagtactatacaattaaaattttggagtctaatttacttaatcacttaatttttctcctaaacatgatcatcgatctggtgcttaatgcaaaattttgatataactgaccttcttgtgaagccattgaagccgttcaatcggttttgcttgttgttcttcctttctcttttcttattcttcgtctactttgcttgttgttgttattcctttctcttttcttattcttattctttgtctgctttgaatagcatcttagccggggcagagatgtcggcttctctgttgacaaaaagaaaacttgtagagatcacctcatgaaccccttctagcatcgagtcgatcgggcgacttagggtgtgttcggctgtccaactgagtggttgtgcagtgctgctgctgcaataattatggtagaaattgtatgtttgctactgtggttgttggctgccatcctgtcacaccaaacaggcccttaaattagtgttttaaaatcaagacttctggtgtcttcaggagcggcgcggtgcacccgtcatcgtcggtgcatcccttgtcaaagccttccatccattttccgatcatcgttgtttgcttcctctcctactgcctcacatctgccgctgctgctatgtagccactcccgctttccgcggcctcaggacgctggcatgcttcaatgcctcgcaagggaacgaggcaaccgatcatgctgggatatcgggagttcgggactagggattggcctccggtagcccgacaagtgccttatccagtccctctcactcttctctgcgtagcgtgagtgctggagaaaacatgggaaacagtagcagcatgcatgggtagcttttgaatgtggatttggataaatatctatatctatactaatataaaaagaagttgcccccctccaatgtacaggccaaatcatcccccaatcatctttgtcctcagccgtccgatctgttgatccaacagcgaaatcaccgattccgccatcccaccaccacacaaatccaccgcgctatctacgcccccacgctctccccgcgcgatgactccgccgccgcgcctcctcgcgctgctcagatgcgcgctgcgcctcccgacgcttcctccctccaggccgccgtcgtcatcgcgcggtcccgacccctccagtatcccccccatcccgcctcctcctccaccgcgtcgccgatggttccatgtcgtcgtcgtcgtcgcgcggtcccggccagctgtccaccgcgccgtcacagatccagccatccctcataccggactcccccatcccgacggccccatcccagcggcgaggaggcgccgtcgcgcgggagatgactggtggggagagtgaagagggagaggcggatggcaaccatccctctgtcacgctcgctctccaatcccccttcacagtcgagccctgcgtcgtcgccttcccccgccgatgccaccacatcaaggcacctcacgcatggagctctttccccgaagccggatgcaatggccggtccctcgctaaggcgcccagcagatccggccagttgcctcagcaacagagagtccacggacctctccgctgctctgtaagaggatctggactcttctgccaacgaggccactgtctgatccaccatcgtaggggattctttccgttccctaaatgcaccacatatcttcccctccggaaattatttttttcaaatgaaattgatagaataccaatggctgttgtaacaaggtaatttgccctcaacctttagcttttcaaattagaatcaatttaattacttctttgtttacgcgcatcattttaccctaaagactgatgcttgcactgatgtaccatgttgtcatgggggatgatctagacgtgaggactgacaagccatctcttgatatgtttcttgctgagatgaggaggttcgaggtattgccatgtaagtgctctcacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcctgtgtactgccgccacgccgccgcatcctcgccggagccactttcttctccatccaccgccggagccgaggtccatcttacagtttaattcctcactgaatgttgactatccctgccaatccatcacacgattccctctgaatgctaatccattcaattaatttcctgcactggtaatatctctcccatagtggggaatcatgtgtcttttgtacaaattacataggttattaaactggattctccatttcactttagaagttgattttcttgctttcttggctatatttcctgtcatcacatcttacatttacaagtaggaacgaaatgatggccgactaccttcttgatcactgcgatgtgccccttcgcttcaaggatatgcataaatccaaggtgattctcatcttccaaatctttatctcgatatttcccctaggaataaaagattccaaacccatattcacctatttacagtgagcattaggatcattttatagaaaaagatatcgaggtgatctagaagttattatacattaggtctgctgcttcattataatagatcatatgtgtatttctgaatatatcttctttgtttggtttttcccagtccggcactctgctactattctaggtaccggactacaacctgtaatattattttgcggtgtactgattgggtggttagatttcaaaagcaatttcaaattatctgtcctgtccaataactattgccagattacccaggtgccatgtacaatactatttttttttaaaaaaaagtggcactgaggaagtttgagaaccagtatgtactcctaccaatgaatatcacatcatggtgtttcaggttttgtttaagtttggaaagaaaatatacataatttgtggcaaataatgttcagatttgcagattaacatgctaccaaggtcaaaactgtatgtaatacatgcaagtgtcagattttttttgttcccctactttactaaaactgtaaattaggtttataacgtgtttctgatatataacaataagagaaatcatgatatcaaaaagtatctgttaatgctataaggcatctgaatatattggcttacttctattgtttataatacaggttgacattgtggccaactggagattttggtaaaatcctatcatgtttcaccatggcatttcactgtttggcgcacggtatttaggagctatttgtatagtaaatgctggagtattgaagtaaattatatgttcagcttattaactgcattgcgataagctttgatctagatccggtttcaattttcatttgtgtggtcgcatcctttaatttatatagcttcataagagtatactccgaagtacatgccgttttatgtatttttatgccttcatattctgattgtctaatggctctaaaacaacagacgggtggcctcatcaggcgaattgctccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcagatggcttcaaggagaagcttcagagattatctcagaaaagtttttggtacactcttcttcttcagagattgtctcagcaagttgtatggttgtgcagctctttggtgacatcaaagaagaaatcacaatctggagggaggcaggcttcatggtaggcgaaaaacgattggcattattccttttgtagttttttctctcccgctctttgtaaccggttttgacaacttcgtgtggacgcttagtttgtaacaccatctcataatcttaatgaatttgcttagcctactcttgggccagtctggctaaaataaatgtaatcagagttacactttatttgttggaaacataacttgtaaaataaaactaatcatttttatcctaacaaaaggctgctcaatgctgcaataatttctgttgaaaaaggaagtggcaaaacaacatgtcttttgctaccttgttctgtctgtttttcttgaagaattctctaattttattgtgattagtcttttgaaaaggctatattaaagaatttcttattttgttttggttctttctatatgcacaaattaatagctctataaattcaatagttgaagagaagcaatgttcagaaaagttgaatatgcacttgatatatatgtgttaataaattacctttcaaagtatgtgtactttctaatttttaaatgtgactatatattttcttgatatatattatgacaaacgtgctttgcacgtgcatgataactagtaagcacgaatcttaaagataaatcttatggccttgcagcaagtcactttattcgaaaatcaacgggatgaaataacttgactctcatggcatcgggaagctactcagctaagtcggcgtacatgatgcaatttgagggcacaaaggcgaagcctttcaagcgcattgtttgggaaccttgggcaccgcccaaatgtaagttctttgcatggctaatactgcaaaacgaagtatggagagcagatagacttcaaaggcgtggcatggcaaaccagccgctatgccctctgtgtgggacaacgctggaaacgtcgttacacctcctagcaaagtgacggctttccatcaggatttggaaggaaatggagcgctagacatgctatgatctgcatctataggattggcaagagtatgacacagcggtgcagtggtgggagggattcgtttcaattcctggaataccgaagaagcccctaaaaacgttgatcatcatggtttcatggatactatcgaacgaaaaaaacgcaaggatcttccggaatacggcgcaaacgcccacagctctgatccaggccatcaaagatggagctgcactttggtatagggcaggcgcccgatgcctaactgagtttgtaccgtcgggagagtaagccttttccctttcctttttgtgcactatcactttctttaagcaagccttgtacataaaggtgggagggattcgtttcaattcctagaataccgaagaagcccctaaaaacgttgatcatcatggtttcatggatactatagatcgaacgaaagaaacgcaaggatcttccggaatatgacgcaaacgcccacagctctgatccaggccatcaaagatggagctgcgtatagggcaggcgctcgatgcctgactgagtttgtaccgtcgggagagtaagccttctccctttcctttttgccggctgtcactttctttaagcaacccttgtacataaattgaggccatgccctcctctattaatacataaggcaaagtctcttgcctttccttcagaagaaaaagaaaaatctggttgacaaatcaaaataaaacaaccgacggttgtgcagcaagtccattttttttaattacgattgggtttttctttactaattaaacttactttcccatgaatttcattgaagttcacatagaagtttcagtgttggattttatagtccagaactttttcttgaaaaaaaaaattgtagccgtaaagcatttaaaaaaataagcccgaaaataatactagaaaagaaagaatataaatgcaaaaatgccaagcacatgttgtcatgtgcccttccaagcagactatcctgtatataccatataacaatacaaggattgtttgctaaccacccatatcaggtggtgccccgtatccgtggagggcaccttataacgacgtaataaacttgcaatgctaacgatatggtacaaatcagattataccgggaccacaatatgtttaccgctaactccgtatccaaatttgggcctgcacagggttgtcggcccactagaagctacctccgtatgcaaaggcccaccgagaggaagcgagatggcggagatccgatggtcagcacggtggacgcgtcatcatcatcagaaatttggtgccccaagctgaacacagtgtccaaaaaaatgttgactatctggactgatcaactggcaacaaagtttatcacaaatatatatatgcatgagccatattcatatgaaaaatgcaatgcctcgtgaacttaaatttgatttcgaatatataataactaataagatacacaagttcctcgattgaggaatttgacgacataatgtgtgctgatttaagtgtccaacttgattcaactttattctcacatgatgccggttctacacatccatgagtacggatgctgaaagcctgaaactattcacgagctagctggcttccttgattttaccatgcctcttgcagaaacacttggttctctctagaccatcctctagtaattgtggatcaaccgcgaaggttatccggagccaattcttcatccctaatccactccctgcagtgaattacatttacactgttttattcatcttccattatctgaaaatacatactagtcgcggcaaaattcagacagagtaaaatggtcaggtcattcctgacactgaaatgcgttcagtgacagaaacacaaccatcagatgatctacagaaacatatccataatttaccaaaaccagtaaattaaactgatgttctaattactgtaattacctgggcagatgaccacggattcctccttggccagcttgctgcagaagtcgacgtcgtcctctatgccatctagggaagacaggtccagcttcgccatgacgaacatggagccctccggcttgtgagggcaggtgatgcagtcgatctccttgagcttctcgtagcatatctccgccgccttcttcaccaccccaagggcattggtgaagaacgcatcgtccgtcttcgcgaggatgtcgggcaatgctccctgctcgatcgatcatttccatggcgtcatcgtcacagctaattaattgatcttcagagaagcgaagatgcgcgacaactgaatttggatgtgtactgacctgaacaaatgttacgggatctaccgagatggctcggtagtcaatgactgagtcgatgatctgtggagacagagaaatgatccatgaggtagttgatcaagtttttcaaatcaattgcattttggtcagtgttttaaatagcgggctaagatatttagtggttgaacttctcaagcagctataggtaggttctatttgtgggttggggggggggggggagcaactagtgagaatctgaagaagctcctagcttctggattctttaactatagcttctcgatcagaatctgagtaaaaatatgtattttttaggagcttctggtagctagagattttaggagaagctgtagctgccaaaagctctcccaaacaatagtggactaaatgaggctatagtagctaaattgtatatgagagtaaatagctactccctccgttttaggttataa

SEQ ID NO: 13215 - DNA, 18611 bp, Oryza sativa
  unsure (1)..(18611): unsure at all n locations
ccgaggcgccagccgggcaccatccaccgcttggagatgccgcccagcgtcatcaccggcgccacgtcgccgaacacccccatcggcacgaacggcttgctcccgaacgcgaagtggtcgtacacctcgtcgctgatcaccattatccccagcttcctcgccgtctctgcgatctagtacgtacagatattaatccggttatgtattacgatttgtcatcatcgccgatccgaattgatttgatcagatgtattaatcaatcaaaaccttggcgaggtggtcgcgggagtagacgcagccgcaggggttgttggggttgacgatgaccatggcgacggtgttggcgtcggcgagggcctcgacgccggcgaggtcgacctcccactcgctgtcggggaggaggtcgaagtggcggaactcgaggccgctcagggcggcgcgcgacgcgtacagcgggtagccgggccgcgggagcagcacgttggcgcccggcgacgcgagcacggacatcatgatctcgacggcgtggttgcagccggcggtgagcaccacgtccgccggcgagacggcgtaggggagctcccgcgacaggtgcgccgccaccgcgctgcacatattcaatcaaagctagccatgaggacgatatcgacttctctttagagttcaaaccaatttcatctcttcctgtcacgaaagaatttcttgaaccgaaactcaaaaaacaaacaaatatttgcccttataatatgagatgcaggtaacggatatttctccttttcaaggcagccacaaaattgagcccataaccgtcggtactaattcatgaaatatattctattagtatgagatttatgcgtttgaaaatcaccttatagtatgtagacaaagtgctaattcctaccgaaatatattctattacttctgaaattggaaggtgacctggaaaaattcttaaaaatcatgaatttcagatgcctttgttacgatgccagtctaaaaagaaaatctcaaaatcccctcaatccgcacatggttatctgaaaattagtggggtggcatgaagtcggcatcgcatcatcgctcagatcggaaatcaaatcagaagctagcatctctggagtcttgacactgaaatactactatttctggactgattgattggaatctcattagttaattaccgactgatcgatcactagtcaccacgccctatatcttttattgccagtggctggtcaatgggaaataattgaagagtcttatttatgttattttttgtccgcatattgatttgatagtactatttgtagttgagcattttctaggttgtccacagggctatgttactactctgcagctgtgttcttgggtgagcgttggaaaccctcacctcccgcacagaaaacagcgcaatggatttgtgcacgataaattaagtattagctaaaaaaatattaaaaaatgggttagtatgctttttaaaagcgactttcctatagaattttttttaaaaaattacaccatttaataatttaagaagcatgcgcgtggaaaaaaaatagaggatgggaacaagcagcgccgaacagtgtagacagtttgagaaggggtagagaatattagaaagatactgtatgattaattgagtattaattattttagatttcaaaaatagattaatgtgtttatttaaagcaactttcctagagaaaatttttataaaaaacacaccgtttagtagttcgggaagtgtgcacgcggtaaacaagagaaatcttctctctattaccggctgccgaacgcaggtgcctgtacatcactgttttaaaaataataatatagccaactacttactatatagatatttatagtttatctctcagcttactcatatagtgattaacttttcactataaatatatggcccacctatctttcccacatattttattggttcctttgcctaagctggctgtaaaattacagcccgcttctcatctctctcctctcctctctcatccacttcagcattcagttttcttatagcgctctataagaaaacgatttgtgtcagagctttgttcttgtcttagggtgcttttatattccctacatttcgcttatacaacttcattgtttggtgctttcttttattctatacgtttttcgaaaactttttatattgatgtttctttttagaaaaatcaaataaacatatttttaagtttgtaatagttaatactcaattaatcatgcatcaaaagtttatcttgttttgtgcgtcgtcataaagctaagttgaacctcacatttgaactaggccttaattgaagatactctatttatttcatattataagacgttttagcctctcttttttttttgtctaaactaacattcatatgaatttagggcctgtttactttgatgccaaaaaaaaccttaccaaattaatgccaaaattttggtatagttgacaaaattttggtaagaatttcttatatagttaccaaaatttggcagcaaactaaatgtagctattttttttgacaacttcatcaaaatttggtaaggttgaaaatggcatcaaagtgaacaggcccttagaaatatatctgaagcacataaatagatccatggatgattgtatttaaaactaaaatggcttacaatgtgaaatagagaaagtacttatttgcacatggaggataattagcacttcatgttccagttggaatgattcaagaggagatagaaagataggtatagagaggtagtttgagttgttggaatgtttttatttagagaataaaatacactcctaaaatcaggctgattgagtagtgacttctttagtctaaaatattatcttctgatgaaaaccatagaaaagattgatttcattgaagaaatattatcgtatataaaattatatgatatgcgattttttctataataaattaaatcaaacattaattatgtagctagctagtgtctactcctctgtcataaaatttagctatttctctttttttttcatgtgattaattgagttcggccttgaaattctgtaaaaatatatgtacaatgtaccctatgctaaagtgtgtgctaatttatatatataaatttgaatatttggccaaaattcaccacgcgtattcacatttttcacacgatatttcatccaagaaaaacgtatgatctgtcatccacttttgcacgcgacgacgtacctgcacgccggggcgattcctacggcgggggagtagtagttgtacttgccggaggcggcagcggcggcgacggcgtccgtggcggcgggcgcggcgcggaagcacgcgaacgcggaggggtcgccgtgggcgagtggcgccacgggccgcgcgtcgccgctcccgtcgaggcagcggtaaatccgtgtcacggccgcgcggatctctgcgaccccgccaccgccagcgccgggttcgccgcgccgaaccgccaccccgccgtctcgccttcgccgccggcgccgccgctctccatggtggtggagcagagcaggggagaagaccagaagagggtggtgtgcgtacagcgcgtgtcacaatctgtttcaattctttgtagtttttgtaagtagggatcaaatttgacccatattgnnnnnnnnnnnnnnnnnnnnnnnnnnnnnnaatcttgttgggggcgatcatgtccttgatcaatttaataatacactacttgtcaattaactgattctatgattaacttatggtgttagagcatattcttcagcacaaaatttacatgggcaatgctccgagtgctggtatgaccatgatgcttcagattgacgtgtcatgtgtgccaacgtgccattaacacaagcaatgtgtattttttaaaggtaatgtattctaaaattacatttagcctctacgtctaaacacgtgcatagagaaaagaaacaagaaaattaagacgatacgaacgtatcgacctgcattacaataatgtcattttaagggaagtggagagtttcatttcacggttaccaagagtgtcatgtcatctaatgagatttgaattgatgaatgaaataagatctctaacatagaatttcattttgcaatttcgtaggttcatcataacatttaatagcaatacatgggattggatgagattaaactttttatctctctttataattatattgtcatgtcaccaaatctgctaatatggtactccctccgtttcaagttataagacgttttaactttgatcaaagtcaaactgcttaaactttgatcaagtttataggaaaaagtaataacattttcaactcaagacaaatttattatgaaaatatatttaattattgatttgacgaaactaatttagtattattaatattactatatttgtctgcaaacttagtcaaatttaaaatagtttaactttgaccaaagtcaaaacgtattgtaacctgaaacggaaggagtatgctatttattgagaatagaactcctgtatgaaactactattgggattggcctaagttgctatcttataacaccttttagaacgaactgtcattaaccaacctaactattagtgcgttatttttctccacacatttttatcacctactccctccataaaacaaataaaataaattcaaatcctggttatgaaactggataagtatttgttcaggttcatagcgaggatttaattcttcctgtgatggaaggtataatttattatatttttgttacagtgattttcggagattcgtttcactcaatgttaatcaacattgagtggtagtacgaactaagcactggaaccttccgttttagcaagttccagtggtaacttatcaaatctgataatagaagcagtgatatgcaatttctcttagaatatctggttctccaaacaacctagattcttacccaatctctaagaatctatagttatataaaaaataaactagaaatcagaaactgtattgctaccaaccaactacatcttagaatcttaacctattccaaataaaaccgtagattaaaaagggcacaacaaaccaacaatttgatagaagcatggctatgtgttaattaacaagagcatggcaaaccaacaatttaaaccaagtatttgcagggataagaattgttaagtggcaaccgagcaagagcatggcaaaccaaccatttgaactaagtgcttcagtgatagggaaggggaaatgtaatgctcattatccaagcaaattttactgaaacacgactccaatacaacggtcttgctttcgtattcgttacgcgtaaaattttcgagttcgacttctaaacagttttagttcgtaccactagtacagaaaagatttttccatacaggcattttgatttctctgtgcggttatccggcaccctgtagccggctgtctgcgaaaattaatattttcgcgtgcgggtgggtcgaccgcacgggataatcgattatcccatacggttgtgttatactgcccgcacggaccaaaaaaaccaaaaataaaaaacaaaaggaaaaatcgctcgagcgccaccgcctcgctccaaaaaaaccaaaaataaaaaaaggaaaaatcgctcgagcgccaccgcctcgccgctccccgccgcgcccggccaccccggcgttgccggccgagttgccgtcgtcctcctccgcttcgccttcctcctcgaccaccgtgactagcttggcaccgagcgtggccatgccggacaggaaagacgccaccgacaggaaagacgccaccgagccggtggagcgtctgatggtggtggtggccgcggcttggtggagaacgtagttggcgacgagcggggtgggagcgttgaggagccccaggccgccgccgcgcccggccgccgccgcctcggcctggccgccgctgttacgctcggcagccgtctcgcccaggatgccgccgcgcccaggccaccgcctcgcctagccgccaccttggcccggctgcctcgcccagccgccgccgtcgcgcccggcccccgcctcgcccaggggagggggaggaggaggggaatctggccggggaggagggtgggaagccgaccggttgaggggttgagaagaggttgagaagagataaggtagagagagagaggtgggagccggttgagaagagataaggtagagagccggttaggtgggagtggttgagggagaataaaagggaaaaaggaggagagagataggaaaaaattgaagtgggtgagagggaaaggagggaggaatatcccgtgcggttgggataggacgtccgcacgggaaaatcgatttttcccatgcggacgacaccccagcgccggttccctatttttccgtgtggttccacttacagaccgcatggaaaaaaaagggggggcgtccaggaaaatcaatcgtgtagtagtgtactaacaaattagataaattatgctataggtcatcgtgactttatggttttagctatagggcaccacgcggagtgactttggggaagatactcttaaaagttagatattcgctggtagacaccgcacccattaaaataataatttttagtttaagagaagagagaaatcacgtgaaaactctgaaatgcccttgggcccatatgtcagatctgtaatctctctatctctatctctttctcatgtgcctctatctctttctcaagcacacgcgcatgagaagaggaagaagaaggggaaaacgaggcctcgtgtgcttgagaaagagatgatatagagagattacaaatctgacatgcgggcccaagagcatttcagaactttcacgcgatttccctctactctttaacgggaaattattattttaataggtgcagtgtccaccggtaaatatccaacttttgagagtgctcccccaaaagtcacttcgcgcgttgtcctatagctaaaaccacaaagtcacgatgtactgtagcaaaatttgccaacaaattaataaggtgatacgatactttgctactggttcttgcttggttgctatgtaccatttttgtgaaaatagtcaacttttaacttccttaaatatatttttgatctgtatatttttgatctggtttatatcttagatggtgtttagtaaggctccaattcctggatttaactcaagagctgagaataaagtggagttatgaagcaacctaaacacaactccacttctttaatttattttgcaagagcacttcaaccaactatacttttattttgggtggagatgaaactgtttggctggactccaactccaaaaaaccagatataacgactattctaacttttaaaaccggtgcaaaccggatataacgacaaggaataagttcactggaggtcccttaatttaacagcgagattttttaaggccccttaaccacaaaaccagaaatcttcacccctaaactatacaaaaccgttcatcggaggtccctcggcagtatttttgcccggttttactaacgtggcatcctagtcagcaatttttttttaaaagtacttgggcccacatgtcagctgcatattctcttttctcttctcttctttggagaggcgggcagatgcgggtgcggcgaccggcggcggtgcgggcgtggcgggcgtgggaaagaagcaggagaagaggagaggaggcgggcccggagcgggcgcggtaggcggcgagcggcgcggagcgagctgcgagttgccactcaggtcgagcttgagtagctgcgtgaggtcgccaatcggccaatggcggatggaaccacgacggagctcaacatcacgtcggcgaacatgttgccgttgaggaatatctcagccaaggtgttgcagttggtcaggttgtccaagaactcccaggcgccgccatcatcggtcggcgtacggctccgacgagatggacgccccgctcctgtgaagcctcccctccctggggcgggggctcctctcatcgtctcccacgcccgcgcggatgctctccgcggcaacgtccgacgccctcgtcaagatcaagccaggcgagataagcatggtctccggcatccccaaggagcacctccgccgcaaagtgcttctttggacttactctgatttatgtagtgtcgatagattcgctagccctcgcagatccgtgtgggaatcgctcgagatgtcttggtttggtgggttcctttggttgttactcgggttagggatagagcctggaggtgtcgagtcgtgaacttgttggaattaatagatgggctaaggctcattcgaagattaattctttggaaaatcacaaaagcccacctcatgggatggcatgcatgtggagtttagtaccaccttgcttattctaggagagggggacctccttaaaagggaggatgccctcctagccacttaaagcatgtgtggtggagagaagaggggaaacacacgcgcgcgctcgctggcctggcctggcagggcaggcggcgcacgtgcacgacgtacgcgtcgaatggtccgcaaaattggctcctcacccttgtgcagatgcagcctccttttgcagttttgttttgctgcgggattcggatttgttttgttttggaaacattccaaaaaatccggtgtgtgaaaacggcatggaatccggataggttacgcgtgacttatccggttcggtttacgcggacgccctgatcaggcgatctatctctatataaaccgagccgctgccttcacgcaacacacgcgaaatcaatctagggtttgcctcctactctgtactgcgccgtcgctcgtagactactccatcccgctcgccggcgtgcaccggcaatcgggagagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacctcggtatgtgttcaacatgttgcgcatatttgatctgttcaggttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccggataaattcaccggtgtgcactttaagagatggtagatcagggtcactctgtggctgacggctatgaaatgcttctgggtgagtattggcaaacctgaaggaattcttactgctgatcagcagaagcaattcgaggaagccactctttgtgggatgcattcttagcgttcttgacgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagttgaacaggctcatgagatacaaaccatggctaaggaacttgaactccttaagtgtgtcttacccgacaaatttgtggctgggtgcattattgcgaaactacctccatcatggagaagtttcggtactgcactcaaacacaagagataggaatactccgttgaggggttgatagcgtctcttgatgttgaggagaaagctcgggaaaaagacgccgcgtctaagggcgatggtgggcagtctagtgccaatgttgtgcataaggcccagaacaagagcaaggggaaatacaaagctcaacagaccaccaacttcaagaagcagaagaagaacaacaatcctaaccaggatgagaggacttgctttgtgtgtgggcaacctggtcatctggctaggaagtgtccacagtgcaaggggatgaaggcacctgcagggcagacttctaagtctgctaatgtgaccattggcaacactggagatgggagcgggtatggtaatttacctactgttttttcagttaatcagtctactaattggtgggttgatactggggccaatgtacatgtttgtgctgacatctcattgttttcttcttattaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctaactagagacaaatttaagttggtttttgagtctaataaagtagtcgtgtctaaacatggatattttaatggtaaaggttatgagtgtggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattgtcaaaggttctaagtgccataggtgtgtgcaatcgaagcaacctcgcaagcctcacaaggctgccgaggagagaaacttggcaccaatagaactcctacattcagatctttgtgaaatgaatggggtgttgacgaagggtgaaaaacgatatttcatgacgttgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaatgagtttgacttattttgtgaggaacatggcatcatacatgagaggacgcctccctattctcccgagtctaatgggattgctgaaaagaagaaccgcacactgactgacttggtgaatgccatgttggacaccgcgggactacctaaggcatggtggagggaggcattgttgacctcaaatcatgtgttaaacagagttcctaacagaaataaggacaaaacaccatatgagatatggattgggagaaaaccatcactttcttatttgcgtacatgggggtgcttggcgaaagtcaatgtactaataacgaagaagtgcaaacttggacctaagattgtggactgtgtctttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaggcaaccctctgaaataattcccagttcaatcacaccaccagaacaaactgaacatacacatgaacatgtctctgaggaggatgtcagtgaagctcctcgaaggagtaagagacaaaggacggctaagtcatttggtgatgatttcactgtgtacctcgtggatgacactcctaagtcaatttcagaagcatatgcatctcctgatgcagactactcgaaggaggctgtccatagtgaaatggattccattatcgctaacgggacttgggaggtgacagagcgaccctataggtgtaaacctgtggggtgcaagtgggtgttcaagaagaagcttaggcttgacggtactattgaaaagtataaggctcggcttgttgctaagggctatactcaaaaagaaggcgaagatttctttgacacttactcacctgttgctagattgaccacaattcgtgtgctactttccctagcagcctcacatggtcttctcgttcatcaaatggacttctcgttcatcaaatggacgttaagacagcttttcttaatggagagctggatgaggagatctatatggatcaatctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttggaacaaaccttgaggtgataaatgaggttaaatcattcttgtctcaaaattttgatatgaaggatttgggagtagctgatgttatcttaaacattaagctaattagaggtgagaatgggattacactcttgcagtctccggaacctctgccttcgacgtcctgcaccgggagaaggcggcaataaggtttttgggaagcgcttcgcgcgactgctccctgttcgttcgcgacggctcgccttcctcttcgctcgcatgcttcgcgccttcgtcgacgctcgcaaccgcgagtagttcctgccgagcaaccggtctttccgtcacctcggtacgtgttcaacatattgcgcatatttgatctgttcatgttttactgcttaatttacatgtgtagatctaatgatgcgttcaatctagtttacatctgcaatgtcatgatttatttatagaataaattaaattattatgtgcttataatttcaacagaactcgtggtacagactaaagtgctatcgctagttgacgttcgaatcgtggagtagatagaaatgcgaattcggtgatgaagttttacacttgtatggtttgaactgcgtttagaacttgggaggaatgtgctggtccacgtgcgcccacgtcgatcggctgggagctccccacagaacacgttgttcgcgagtgcgagaccttgcaacgacgtcatgttgaagaaactcggcgggatctctccggtgaggctgttctgcgacaaggctaacatgcggagcgccgggaggtgtgacaagccgtcggggatggaacttcccagaaggttctggtcgaactcgagctgcacgatcttcgtgaggttcgccagcgatggcgggaagtggccggagagcgagttgtggctgagctggagcaccgtgagattcggcaacgcgtcaagccaccgtggaatgccgccgacgatcgaggttgttgtttttgaggtacgcgacgtcgagggcggtgcaattgtggagcgcgtcaggtatctcgccggcgaacgcgttgtcgcataggctgagtgtaacgcctcgattttcgttcgggtttaaaaaatcatttaataatgcattttctagaaattaaataaaagttaaaccaatttaatcaagtggaattatggagggaattaaaatttcctttaaaaatcattggccgggaatattctgtaatattctttgtgccctaatgtactctctagaattttccgtgagttttcggagctcaagaaataattttaaaagcaccaagttcattttaaccaactaaataaaaagaaaaacaattaaaatcccccttcctctctttgggccattttcggcccaactcttccttctctcccgcggcccgcgcgccccttttctctccctctcgggccggcctcctccctcggcccgctcggctctctctccctgaagtctgctttacctccctcacccgttttcccatctctctctccccaacaggtgggacccgaggccccacctgtcatcttcttccccaacctcccgtcgccccaactgccgccatggccgccggtttcaccccacgacgccgcggctcccgcgctccaccccgccccacgagcgcgtgaaatcgatcccctccacctcctccacctttccccccactctccccgcgaaaatcggcgccggttaacccctccaccactccacgtcggcgccccacttcgccggccgattccggcacgtccggcctcgatcccgccttcttgagcccccaaaaagcacccccgtgctcccctggtccatttccccttgttttccgggcccggcactctctccctcgctctccccacgccgctcccgcgcgccgccacactccggcgaactccggccgccgtttcccgtcgctagggtcgccgccgcactgctccgccgccagcgctggctttgccacctcaagggcacgctcagccgccgtttcttcctccccttccaccacgcgaaccacctctccaccgtgctccctctctccatcggtccccggcgtgctccggccacctctagccgccgccctagccactgccgcgccgcgccgtttgcgccgccggcttctccgtgcctcgccgcaccccggcctccgctccgtttccctatttaatcgccgcaaccacccttccacagtgcatcccaagccacctccaccctacgccgccgggccgccgttccgccttcgtcccgaggagcgccgacgccgagctcccccgcttttccccgcccctcgtcgtcgcgtccttggtgagctcctcctctccctccttgcctccctcctctgtctcccgtgcgtgctgccgcgccggtggccgccgccggcgaccaccgggccgtgcgtcgccgccgttaggtcggccggccggcttgtcgccgccccgctcgcctaggccgcccggatccccttgccgcgccgcgccgccgctttcccgcgtgcgtcggccgtcgccgcaggaggccgcgccgccgtgagccgttgctcggccgggccggcctaagctgtgcccgtgctcagccgcgccaccccgtggccgcccgatcagctcgggctgatctgggccgtcggttcccgtggaccggcagtggaccaccccgtggtcccagttcacggtggaccactcccttgcccgctgtcatgtggggcccgcttgtcggcgccgctgccctttgatgacgccagcaggagccttttcctttgataaaataattaacaattgcacaataattcgttaataattctagaaattcatttaaatggctcaaaacttctaaaattcatatctaattcattcaaactccgaattgagccattcaacttgcaaaattcatctaaaattgagctctacatgtttgtttactttttatgtactgtttccttggtttttattagagtttttcctcgttttgcgtgcctgcgtgtagaatccgtcatttcggaagatcacggtcgcaaggataagagttcggaagattgtttgaagaagcaaggcaagtcacacattccccttgagcatgttgattccaatttataaatgttttactgtttgcaaataaatatgcatattttgctaattacatggggtcagggttttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggacggctgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgatggggatgggggtgaaacctgaggtgtggtgtgcttggctagagtgggttatgcgaagggtcctgtcacggcctctttccggtatgtcgtggtggcatgtcggcgcacggaaacgtgtcgtggggctgtgtcatgtgggtacagttgtacacctctgatcagagtaaagttattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacatctgcatcgttagtgtggcttgctgagtacggtggttatactcagtcttgcttttattctcccttttcagaagtgttgtgtttctgagctgaagatggagttagaggaccaagtctcagaccccagttgagttttgcctgtggagtggagctgaagccccgctaggatcgcctttttccgctgctgtcgttctgtttcggtgtgaggactaagtgcctcttccgtaagtattttacgctttatttacatttagaactgtatattacttgtcgttttgtgtaccctggctggtcctggacagggatttaatacgaaaaatagtctgaaaatttgggttaaatttctgggcgtgacactgagataccacatccgccggagccagccgaggccatcggcgatgctcccggagaaggcgttggaggtgaggttgatgagtagctcgagctacgtgaggttggcgacggccggtgagagctcaccggcgaggcggctcatggacacgtccagcgacgtgacacgccccgctgcccacttctctgcccgcggccgcgctcgcgcccgcctccactccgctgccgcgctcgccctccactgctccgcctgccgccgcctccctcgctgaagaaaaggagagaggagagaaaagagaagagaagaaaaagaaaaagagaagaaaaaaatgtacagctgacatgtaggctccacatactttttaaaaatttatttgctgactaggatgccacgtcagcgaaaccacccatatatactgcttagggaccttgagtgaacggttttgtatagtttaggggtggagatttctggttttgtggttaagggacctcaaaaatctcgctgttaagtggagggacctccggtgaacttattcctcacgacaatgatagtactgagagtgatatttgctaggtccaaaggccagaagcagcgtagctagctatagtacttggtagcttgggcccatgtatgtaacttgggcctggacttctttcgtcccgagccttctaatccagcccaagagtaaatgacagtaagcaacggcagcaaaaagtacactacctgagtaaacggataaggaaaacaatgtacctgcacgcctccgcgattccggcggccggcgcgtagctgttgtgcgcgccggaggcggcggcggcgacgacggcgcccgtggccgccggcgccgcgcggaagcacgcgaacgcggcggggtcgccgtgtccgagcggcgccacggaccgcgcgtcgcccctgtcgaggcaggcgtacacccggtacaccagcgcgcggatgctctgcgacctcgccgcctccatcgccgggttcgccgccccgaaccgccacgccgccgccgacgcgtcgccgccgccgttctccatgagcacacctacagcgagcgatgcgtgctgcttgtgagagtagtgcgagtgtttggctaaggaatgggaggtgtggcagcgaccaaagccgtgtgcaatgcggacagggagccgtgtcgctacagcttgatggatgatttgatttgatcgcgtcgcatcagcgtgcggtgacagtgagtattcttggaagtatctgctttgttatgttatgacaatgatctgtaccaaattcaacagtcaagattagtaatcgtgctgctcctacaatacctaggacgcaccaacgatttttctctttctcgtaccgtgaaaagaacactgtcgggtacagaaagtactgtcacagacgctacttcatctctttcatataaaatctgacacatcataatactataaattataagtgcaagtaggtcacctgtgaacccacttatagcttaaaataagcgagttcacgtgttagtttagcctataagtgagttttcacagatagccgcttgcacccttactatgaatctagacatatctttggccctgtttagttccatgggctaatgtttagccctcacctttagcctcaaattagccctcaaggatccaaacaagtaggctaattttgagctaatgtgaattagccccttcaagaggtgctaagagcatatccaacagcctctctatcccactctcagccaaattctagccattctagccaaaaagggtactccaacagcctctccaaccggatggctaagccatccggctggccaaaaccctctctccactagccaaatttagccactctatttggctggccaatggtgggtcccacacagccaaactcttccatagctccatccccacacgggcaaccagggagaggcacgggaggagcacgaacagaggacgagcacggcgaccgccggccttcgatcgccaccgcatggcccgccagccggctacgatcgccg

SEQ ID NO: 13216 - DNA, 8265 bp, Oryza sativa
cacagatgggtctgaattgtttgaagatgtctgtattgtgccgctgaaagcctgaaactaaaccaatttccatgcagattcccgttcttccagctgccattctgaacaacatcgcatggaaaattgctaccaatttcagatatgtacactcccataaacaatcaaatatgtctatgtatatagtatacacaatacatgaactagtacatcaaaatatgaacaatcaatgagtagtgccccaattctctgtcctctatattagagtgtatttacacatagtataagcaaatatgtgtttttccaactgaaacactgaaaaagaacaaactacagcttggtggcggcagtggggcgtcgagtgccgacggcgcccagcggcggggttggcggcgcccggcggcggagtggtggcggcgcacggcggcgggggtggtggcggcgaacagcggcgggggtggtggcgctcacggccgtgctgagcgacgcctggagactggagggatcaatcgattgagagaggaggaaacatcttcctttgatctgacagtgggcccaggggcaaaacagtccacaatgcctgaaaagaaatacaaattgagttaagaaatgagaaatacataaaaactgagaaagtggtaccaaatagactaattagcaatcctaatgacatattatagatggcatgtggattgggtggtaaaaaagttgaggcacgcgaattggatggtatataatctaaattctccataaaaaagaatgctgattgtggtatcttgtaagtacttcactatacgatcttcaaagctgggtccaaattcttaatccaagtttcagccaaacttcattgcacatttgcataccagccgactatcattattgaagaaattaaccatatctctaacagataattacataatccagttttaatttagttcatgtcacttgcaagaggaactttacatgataatatagactgttgcctaagatttttcattgataattttttatgtaatctgcggtactctctgcccccccaaatggatctttcattttccacacacgaatgtacaaaccagaggtcccattaaaagcgtgttcaattaatcctcatgaggagggattggagaaaattgagggattaatttcacacctcaatagttatgtaataaataaatcatctccaaatctccctcgatcccttttggggattaaccaaaaaagtgaagtaagccaaaaaaagtaaatctaacaaacagaacatgtaatggtacagttaaaaggtaacgaaaacatcggcaaacgagaaaaaaaacaagtaaaacagatcgagcactacaccttaccaagaagctttaccaccagggacggggagacgtacgtacggcttcacacgaccaattgcgacggcagaactagggtcacccacgtttaatttgttggagtctcctgtccgcttgcgctacgtacggactctccctggctcctcacgtaagcccatctggcccaaccacggccttccaacctgcccctagctggctagctagggctgcgtgccaccgtgacctgacctagacggagacggccgggcccgggcgcgcgaggggacggcgacgaagctctcgttgggcgcacatggagattgaggacggctgcgccaaggttctccacgggaagaaggaagaagcgatcacgatcacgccccaagacgaccggtgcccagatggcgtcggcgggcaaaccggcggcgggggtcggcggctgcagcaaggaagccggagagagacgccgcgccgccaagaataataagcgccgccgcaccgagaaagcggaggacgccgacggcggctgcggcggtgacgaggatcaggtggtcacctccaaggcgatggaggcggtgtcagtgccggaggaggtactccgggccaagaagaagaacggcgaccggcgaggtcgcagcaaggaagccgaagagaggcgccgcgccaagaaagccgccgacaagaaaaggagagcagccgccaagaagctccgcaccgaggaagcagaggccggtcgtgatgacgacggggcaaaggaggcagaggagggtacaagtattcacttaaatagcatcaaattctgctgtctttactgcatacattgttgatttgccctgttctctaatctgtactgattcagttcaggatttctcagttttgtagcattagaaggctcacataataaacagtaccgaactttcagtggttaccgcatatcgcatctctctcgcaccgttgtttgctgcgttttctttaacctgcattaataactgtgctcacttactttttttttctactttcctccaggacgtccacctaattaatgcaggaatgattaaccatgttaattacagacaaacccatagtaatagacttcccctagtctatagtactaccaccacctgacaacacggaattcaaatagatctggacgctgatcaattcagaatacattttgggaccattgatgagtacttgttgaaatgtttatgaagcttagacctagtttagttcctaaaattttttcccaaaaacatcacattgaatctttagagacatgcatggagcattaaatataaattaaaaaaaaactaattgcacagttaggggggaaatcgcgagacgaatttttttttgaccctaattagtccatgattagccataagtactacagtaacccgcatatgctaatgatggaataattaggctcaaaagatccgtctcgcgatttccaggcgagttatgaaattagttttttcattcgtatccgaaaacccctttcgacatccgatgtgacacccaaaaattttctttttgcgaactaaacatgccattacttttcgatggatttggtctcatgtcgaaattcttcctaagctgtttagaattatcaaaacgagtcagttacctcatccactacgagtctcagttttgggtcttgtgtaattatgtcatgagctaaacccaggggaaatgtgccttggggctgttcgtaggacatccactcatatatactccctgcgtcctataatataagtgattttggttggatggaacatattatagtactacgaatctaccctgtcctgattcctagtactagaatatgtcatatccaaccaaaagcctttatattatgggacagagggagtattcgatagtcgttatcgtttaattaagaaccgggtttgtttatattattctgccaattgtagtttcgacgctagttcgatttgtggaacccaacttgtgagattcatcttatattcgcaatatattcagattgcatcttctactcttttgcttatgctttcaatttgcttgcaggagatgggttaattggattcataaaaagaaactaatagatgaaaaggagttggaagctgtcgaaacaagatttcagcaatactaaaaggggtggctatcaagctagaaaagtggatgggtttgaagacaaggaattttatacaggttcaggcttccttattcaagaagtaataccctactcctgtccggggatgattccgccgagtgtattattgatcgtatgatctgggagaaaatcgtgtcccgagagggacccggacccctccttatataggggaaggggtccgtattacaaaatacagtccatatccctaacggaatatgtgattacagataaaatacaatcgtaaccgactaggatcccgggtatttccttgacatacaagtttagaaactaacccgagtcctcataaagatattctatctatattcggtaccctgtacccaactagactataactgccgtgtagatatggggtatccataatctccacagtagcccccgagacctttgcagtcgatgaaatagccttctccgaacaaaaagcaataatccgagtgcttcaattcctcctgctctggtctgccgagtactaaaatcaaagactgtgaagggcgaaataaaacatggtgcatcgagtagatgcacctaattaggtgtagcccccgagtatgtggttagttaaaaaactaaacatgtagtcaagaaccgagtggttttacaaccaaacatcatatagcaaagcatgcgtggtattcaataaaacacccagccgactgcttcttagctttaatatatcgagaatagaaatatgaaaaggcccgagtgacaaacactcaaaagatccacaaatagacatattttacaagaatccgagtaagaaactcttaaaatgatccgccaaatatgataaaaaccatggtaattaaagaatctaatagcctaggctatgactcttaccacaatcaaaataagcatataacatgccaagagaatgactcctaataaactagtcatctcaaatcaacccaaacagcttttgcagcctaataaagcttacaaaaatagtataacacctttttgtcgggcacctttttatttgcatcataataattccaaagaattatctaaccgcgttaaaaaggattttagcagcatcgggtcacatcattgtgagcacaaattgccaaagcaaaaagcgcctaagtccctagggatcacaacgggccacgctggtaataatattgggctgaagtattgtacaggcccaggcccattagcactcccgataccctaacaaaacaccgaagtccaagcgacgcttcgtcttccccgccgagactctcgccatttccccattcctcgctacagtacaaaactgcgccgacgaagctagggttcatcaatccgccccaatccattctcaaaaatcccatgaaacttctccgagcgtccaccgcaccgattccccatccccctccagctatatctcggaccaaatcagaccattcagctcgcattcatggcggaagagagagaaagtttcgagagtcagtgggcgccctccgatgtggcggaggagaatctgaaagaaatggtggcgcacaacgttcttccagcgaaggagatcatcgggtggcgaccagcgttcggcgaagtgttcccgaccccggatacacacgaggtcgtggtattttctcacttcttttatggcggattttctcttccaacttcaagattcttccgaggaattctgaacttctatggaattagcctgcatcatttgaatccaaactccatagtgcatatcgccaattttattcatgcctgcgaagcttttctgggcattaggcctcattttgctttgttccgccgcatttacttcctcaagccccagccgaacaagagcaaaccatgcgttgttgggggcgctggtttccaactcagaggaacactaagccaaaagtatttctccatgcccttcaagacgtcaaacaaaggctagcacgcaaactagttttacgttcaaaatcttgaacccgcactccccgagtactcctgtctccctccggtctattaggacacatggaattcattgcctatgggagatgaagctgctcaggcagtggaattgatggagcgcatgataaagctgaaggaacaaggtttgcaaggagaacagatcactcggcacttcatcaaaagtcggttagctccaatcaaagagagatcccgcacggcttttgagtttgacggcaaacatgatccaaatcgtgaagatctagactctcttgactttaaggtcatgaaggaaagaatgtacaagatcttctcaaatgctatcgtcgtcagctattcacatctgctgccagttgtgccatacaatgcattcaaccctcctccaccggtatggattcaaacacttcaaccttcctcaaaatatgatcttgtcttcttgttgaatcagttgacagtggaagatattatgtctaggaatttgctttgatgaagtcggatcccccaatcgctcagcgccgatcaccccgccgtcaaattggtcaggggagcggggaaccaaagatccggtctgaagcccagtcgaatacctctaatccagtcggccagtcggattcccgcaagaggaagttagtgctgagtgacgacgaaggcgatgacgctaaaaagcctggagatagagaaacaaccagaaaactgccgaagcaagctattccaaagaagaaaacatccagtcgtcctatgccgaagatcaggaagtcttccaggtacaaatcatataacgatcttccttgtttcgatgctcacttatcatggaaacaacgctgacagtacaactcaaacttgtagaaaaccatctgacatagacccttctgggaaagactctgatccgactaacttggacacgagttcttccaaagaaaccgggccgactgctgaggatcatccgagtgacaatcagccggcaaccgataatgtaggatccggtgatcaacccctgactggaaaccagtcggtcgaagctgaagccggagttaatcaggagcccctgactagaaaccagtcggacacagggccaagccaagagattccagaagtcgaagcccaagcagacaaccctcgtggtcaagacgccagcaatgaccggagatctggatctccttcaaaggcatccgagtccactcgtcctcgtccagaaatcatcacaggtaaacactttgtctgaaatcactttgatctaactgactctatgtgattgttcgacctttttccatggatgcattaggaccaatgattggtgatgaagaggaaattctccggatacgggtggctgaagattcgcgccctcccattctggtcaagtggtgggatgacgatttgcaacctcaaggaattgtgataaactggcaaaaagaggacgaagaggtgtgcctactgaaaaaggcactcggccaggcgactcgcattgtaaacgtaagttccttgacgcctgacctcaaccatcttgttcgctatctagctcaaacgctaataaaactgttttgtagaggattcatcttaggaatgaagcgaaaaccgcgaccctagaaaaattagtccctcatcttggaacccttgaagctgtcagagatcagctacacgaggcaaaagagcttgccaagaaaaccgagcacgatctgtcgcgaccgagaaaaatacattttcccgaacgctagtgtattaatccccgtcccaggaaaagccggggtacaccacacaaacatgatacaaaagacacatctttattatatcgataatatttacattattacaaaggcatttaaggcctgacaatcaaaaataaacagcagcggactagcgggcctatggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaagggggtacaaggggtaataatataggggttaagtttggtagaaaacagcatttaaaagtcacttagttgcccaaagccattttataaagacgatactagagttacacagtattattaatcaaggccatggacccacacgaatgtcgcgaccgagaaaattttgcattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaaagattgagcaagagtgagtacaaccacagtactcagcaagccacaccggcggatgcatgattaatgcaagggggtacaaggggtaatgatataggggttaagttttgcagaaaacagcatttaaaagtcacttagttgcccaaagccattttataaagatgatcctagagctacacagtattattaatcaaggtcgtgaacccacacgagcctgccttagcccaaggcctacgatgattcagaccgaactggcaacccgaccctgggtcccagctcgtcccaagccaacccaggccaaccattctacaatttagttgttaagcaaattttaagaattaaaacactaacttgggtacattgctcggcttgcccataaccgagggcgcggctattcgaatagattatactctgatcagaagtgtacatctttac

SEQ ID NO: 13217 - DNA, 13675 bp, Oryza sativa
agtgagagggggtggccggaggaggggaaaacgggcgcgggagtcccggccgccattaatggcgccggcaaggttaggggaggagtttccaaacgaatccagggagagagagagggaaaaatggggggaaagggggaggggatcccggggaataattcccccctattgattgcacgcggggcggacgggggcggcgggattcgcggcggcggcggcgctagggcgcgggcgaggcggcgggagcggcggaaggaaggggatgacgggtgggccccacccatcaccgagggaggcgggcgggcgggcccgtcagcggtgcgcgcgcggggaggaggccgaatgggccgcggggagaggagagggagggggaaggagatgggccgaggcggcccaagagggagaggggggaaaagggactttttagagcttttctttttataaaaccattttaactttgtttatttcctcttaattattatttgtgctctgaaaatttaagtaaaatttgagggctccttttagaccaaggagaatttaacaaaaattctccggaccacattcgaattcttctggcacgtattttagtgtttgccaatttcttttcgaattttaattaattctattattccttttagataatgatttttatttcgggatgaatttatcaggacgtgacaaatccaccccccttacaggaatctcgtccccgagattcgaggaggctagcaagaagataggttgggtggtcttctcttcttgtctgacttcttccgttgcatcttcttgaacgggcttgcccagcaaaacttccccactctgaactgcttggcttgatctcctcttgcagatggaatcttcttttcacctgacttgaaccagggtgcaccttttagctgactcagactaggttgcggtagtttaatgatgcttccatttccagaacttctcataattcatatctttggcgtcaacctcatacaggttacccacttcacgttatgcgtcgatatcagcttgtcattactaggataccatgcttgtcatcatgagaataccatacttgtcatttacttctaacttgccaccaactgcctcatattaactttcctgctctccgggtgctagctacttctgctattcgatgcaagggtcgataactttgcctttgaattatgtttctcaaccgaaccaacttctcccacttgacatgctttgacgtcttcccaaatggctttactgctggacttcttattgtttgatcgttatcctgccaaatctgaagcttcgttgtctgacctctgtagactatcttcgaacatatcacttggttcataactgggaatagctcccacgaacaagcagctcggattcactttctttacattcagtttatttcccactattctcttcatgttgtcattatttagcattcaacgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacaatttttttttctctcaatgacaaggtgactgttgcagggcgattactgtgaggagtcttccttgtgtgatgcagagcatgtttctgattatcctttatcaatcaccgttcggcctacatctttccttctagagaacatcttggccaacctcttttatcaatcatctttcggcctatctctaacaggtggtactctttaatgtgggttgcagacacttctggtggcgatgaggtcctttggtctgctgcctttcagtgaaaccttgaagtgtttcgccaaaagctatactgactgtcattgcctttgacccgaaaaagacacatttgaaactcttagttcaaacaaatgtctctttggttaatcgcttgattttcttttccatcatcaggttggttattaactcaaggttaaaatatagttcctctgaaatgagaccctatgtctcctttgtcagtaaacaattatacacataatcccatatccacatcttccaaaagaatcctaatagaacttgtctgtattacatatttctcccttattacatgaatacaaggcactaccttaaacaaaaagggaagatgcttaacatcggtacattgtttctactatgggttatgattaacacgaggcctcacaggtatggcgtttgctccagtgaccacaaggcgagtgacttgtcttcttcttgcataatggccggagtgatgacgcaggttacgcttcggctgtggacaatctctggagaaatgacctggttctttgcagttgtaacaaatcaatgtcttctttactgagttgtccgtctgggaacgatcattctgacttggagttggaattggtggttggaaatccttgctaacattggcatcagtggtaccatatttgctatcaccattggagtctttctcagagtcaaaattgctagggttgtcattctgggtgccttcattgatactatcgtcgatatcttggtgaatgctgttgacattgcacgcttgatctaagtggtcatgaatggggcaagaaccatggttgttggtggtatcatcagcattagtattgctaatgttgttgtctgcgttgtgtccatcttcttggggtagtaactcttgatgcgcaacagaagatccggtgatctgaagtggctcagtgcgctgtctttggttaccacatggaaatactgggatgttgacaatccttctcttgtagttcgtcatccgattatgctcactttcgagttgcatggctttgtccacaagtttctcaaaatcttcataatcctctaggagtagttgcactgcaagctcatcttttaacccttggagaaacttctcttgtttgtcttcatccgtttccacatcttctggtgcatagtgagccaaacgatagaactcgtgcaggtactctgtgacggtcaaatctccttgcttccggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgtgttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggttttgttgatgcttttctcattcccattggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactctttttgttgatgtgttgtttgttttgcttattctgcaggttgattaagcaaacaacctagcatggtcacatcacaacccaccgatgcaaaccacgcactacacacacaagcaaggaaacacacgactaacaacactatcctagaggacggcttaggttctgcgactggttctccaagatcttcactcctgcttcacagctggcttcattgcttccttcgcttcgctagcggaccctacggtcttccggaccttcggcgaacaattgacgacatcttcttcttcgcaaaactaaccatctagtactagctgaaatttgaagaaggaagaaagagtaaacattttgcaaatagcacaggggaaaggaggaaaaagggactttcgcaaatagtttcatttataaaatatgtccttaggttttatccacttggcttatcctacagtcgagatggctctgataccatcttgtcgcgaccgagaaaattttgcattttcccgaacgctagtgtattaatccccgtcccaggaaaagccggggtacaccacacaaacatgataaaaaaggcacatctttattatatcgataatatttacattattacaaaggcacttaaggcctgaaaatcaaaaataaacagcagcggactagcgggcctacggctccatcttcacaggcgctcaactggggtataagccaggactccacctaagacttcttctccaaagcatctcttactgaagggggggaaaagattgagcaagagtgagtacaaccacagtactcagcaagccacaccggcggatgcatgattaatgcaagggggtacaaggggtaatgatataggggttaagttttgcagaaaacagcatttaaaagtcacttagttgcccaaagccattttataaagacgatcctagagctacacagtattattaatcaaggtcgtgaacccacacgagcctgtcttagcccaaggcctacaacgattcagaccgaactggcaacccgaccctgggtcccagctcgtcccaagccaacccaggccaaccattctacattttagttgttaagcaaattttaagaattaaaacactgacttgggttcattgctcggcttgcccataaccgagggcgcggctattcgaatagattatactctgatcagaggtgtacatctgtacccacaagacacatcttcctcacgtgtaaccacgtgccacataccaccacggtatacggacggaagacatgacatagttcccaacccatcctagccataaacaagagtaccgacccaaccccacctacggccggcacccccgggacaggtaggcaggactgagcccccagcagcaggacaccaaccctgtgccatgacatctcgactaccgggccgcagctcgtgtagccttcatttgtcctagagatgtccatcgacccccgacttcgtccatctccatacgtgtgcttttgtttataaccagactgagccacaaactaagccttacccactagacatgtggaagtacggtagtgctttgcaacagaggcccgagcttagtccttatagtggccggggtgctacttcccacaactggcatgcacccaaaccccaccgaaaaaacaggttttaggggctttgaaagaggaagagaggggtatgtccaattccaccataagccaaccattccatagtatccaagagatatgaatattcccaaagtctaaagttataaaaaccacctaatgttgtcctattaaccagcgaagcatctacctaaagtcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataagctgggattcaatatgttcaaggatgatgtgacttgccttgctcgcttttccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaatggatttattgcgtcagccgaggggaggggcgcgcggaccgggtccacgggggtggggcccacgcggcagccccacggtccacggtggaccgggcgcacccgggctcacaccggccggcgccgggggtcccacgcgttagccgcacctaagggtgcgggcggctgacagccgggccccacgcggcagccgctcggtgcgcccgaaggcgaccacgccggcgcagcggcgggaggcggcgcgcccgcgcccctatggtcgccggcggaagccataggcacggcggagcggcggccgagagaggggagggaaggggggaaacgaagcggcggtccacggctcaccccgggtcgacggcgacgacggaaacggcgaccggagcggaggaaggcggcggcgcggctcgggtggacggggtcggcggtgctctggcggtcggcgagcgaaatagaggggtggacgaggtcggcgaggatgcggcgaagccgaaggaggcggccccgagggggaaggtggtccggggagacgacggcggcggaccggagctcggcggcgacggcggagagagagagcgacggcgcgagctcgattccgatggggagtgagggcggcgagtggcggaaacggtggagggaggcacggggagggtttatatagggttgggagtgagagggggtggccggaggaggggaaaacgggcgcgggagtcccggccgccattaatggcgccggcaaggttaggggaggagtttccaaacgaatccgagggagagagagagggaaaaatggggggaaagggggaggggatcccggggaataattcccccctattgattgcacgcggggcggacgggggcggcgggattcgcggcggcggcggcgctagggcgcgggcgaggcggcgggagcagcgggaggaaggggatgacgggtgggccccacccgtcagcgagggaggcgggcgggcccgcccgtcagcggcgcgcgcgcggggaggaggccgaatgggccgcgaggagaggagagggagggggaaggagatgggccgaggcggcccaagagggagaggggggaaaagggactttttagagcttttctttttataaaatcattttaactttgtttatttcttcttaattattatttgtgctctgaaaattcaagtaaaatttgagggctccttttagaccaaggagaatttaacaaaaattctccggaccacattcgaattcttctggcacgtattttagtgtttgccaatttcttttcgaattttaattaattctattattccttttagagaatgatttttatttcgggatgaatttatcacgacgtgacaacgaacctgccttaacccaaggcctacgatgattcagaccgaagtggcaacccgaccctaggtcccagcttgtcccaagccaacccaggccacccattccacattttagttgttaagcaggttttaaaaattaaaacactaacttggatacattgccaggcttgcccataaccaagggcgcggctattcgaatagattatactctgatcagaggtgtacatctttacccacaagacacatcttcctcacatgtaaccacgtgccacatagcaccacggtatacggacggaagacgtgacatagttcccaacccatcctagccataaacaagagtaccgaaccaaccccacctacggctggaacctctgggacaggcaggcaggattgagcccctagcagcaggacaccagccctgtgccatgacatctcgactaccgggccgcagctcgtgtagccttcatttgtcctcgagatgtccatcgacccccgacttcgtccatctccatccgtgtacttttgtttataaccagactaagccacaaactaagtcttacccactagacatgtggatgtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtatccaagtgatatgagaattcccaaagtctaaagttataaaaccacctaatattgcctaattaatcagcgaagcatctacctaaattcatcctagtggaaccatgaatagagtacccactagttggggttttattttcctagggtgaacaaggtaataataacaatacaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcaaagagaacggtcttccgaaccttcggcgacgaccgcgaaccacgcttcgggaacctccagaacgacagaagctacgcgaagcacacaagcaaagctacaagcctataaagaagcaataactatacataaaaagaaagcacacggttctttaggttataacaaaaattaggagacttgaacatatcgattcggagctcgtatgaccaagacatggtcatccgaagtttaatgctgttatatggagatttgcggattattgtaattaggttttacaactataaaacatgtgtaagtgctagcctggaaaagacaggaaggctgcgctgttgacatgcggactccacatgtcaacctaagggaccgcggtagaccgagtacacagagacggtcgacgggtcgacggaagcagaccccgtgtgtcaaccgaggcgagtggccgacaaatggactccacaagacaccacgtgggctgtacacgtggaaaccacgcggctaccgagcgggcacactaacacggtcaccacacgcataagcaaacgactaccgacaccggtacacgggtaccggggtcgacaaccgcacaacgggcacgggcgacaccgaaaggacgaggacggggcaacgaaggagagatccttaccaccacgcgacgaggcgagggaacgacaacgacgaacgggcgcggcggagacggccgggaatgacggagacaaaaggcgaggggacgacttcggcagcgatccttggacgaaggcgagacgcagccagcacaacgcttggcgacacggaggcgaggacgaagacaatgacggggctgcggcacttgacggaacgaggacgacgaacgagaacggcttgacagagggacgaacaccacgatgaccgggaacgacgggaggacgacgacgaccggggccggcgaggaggcgacgtgggcagccggcggtagctgcacggagacgaggacggcgtggaacacgccgctgcgaatccgatgacagaggcggcgcaatgagacaacgagccggcgaggaggaacgatgacgacgacgacgaacaccggcggggttcggtcgaaggggaggcgaggccgagggcgaccttgccgctgcgatgccagaggtggagatggcgacgtcggccgacgcacgggcacggcggaagaggctgccgaaggcgacgtcgacgaggaggaaggagaggccggcgtgggcgacggcgttccggcgaaattcgggcgacgccgtggcctggccggggaagaggatggcgccgcggtgccggggaaggaggtgacgacgacagccaccgtacctgcgaggtggcacaggcggctggaggcggtggagtggtggcgacaccactagacgtcgacgaggacaccgttccagcgagcttcggtagaggggacggtgaggccggtgaaggggacggcgttgcagagccgagggaggtgacggcacggccggacggcgcgcaggcgaggcggtaggggtggctggaggcggccggcggcgtgggagagagaaggaggacggtggagagaggcggggcggccacgggagagcgcgggagggggctaaaactggagaacgtaccgagggggttccattttataggggaggagagggagccgggcatgggagagggcggaacggcgacgggaaacacggccggcagccatggaaggcggccgggaatggcgcggccgttccgggcgattgggggcgccattcaagggggaaaacgggagaaatcaaagaggaatcaatggggattaattccccctatttaattttggaatcccatgattaaatcgcacggatttgagggaggaaaggagctagggttcacgggagagagaggaggccatgcgggaggaggaagacgaccggcgcgtgggccccacgcggtcagcgcgcgtgcaacgcgcgcgcggcgcgcgtgagggggggcggctcgggaggctggcgcggctgggtggcgcggcttgggccgggcggccgacctaggaggagaggagggggaggtggcctcggggagagagggaggaggagggagtgggccgaggggaaggagaggaggcccaagagaaggagggagaggaggaaagggagaggaagagagggaggaagagaggactttggccgcgggccgagagagagagaggactttgggccagacttggcccaaagggaggagggggattatttttagctctttctttttaataaactttgttaattgtttttgttgcttaataattattttcggtgctctgaaaattcaagtaaaatttgagggctccttttagaccaaggagaatttaacaaaaattctctgggccacattcgaatttttcttgtatgtattttagtgtttgccaatttcttttcgaattttaattaattctattattccttttagggaatgatttttatttaggaatgaatttatcaggacgtgacacgatctaagggatcggatcgccctgctccaggagtctaacttcgaactgagtggctcatcaaaaggtacacacaaaatctgtccgactaacttgtgctgtcatctttgtaacttcaattaaccggagtcaatgtagtgcaagccgccaagatatctcaattggagaagcagattcagactctggaaagcgataaagcagagctggcaaggcagagggactcggctttgaaggacgttgaaggtaccatcaatcttctatatactgactcattaatatgaatctgttgatgcagactgcaagatcaagtcgcaggctcaattcgacgtcctggttggcaaaatcaaaaggcttgaaggggccagggatgaagttgctaacgctgctaccccactcgtccaagctatgttcttcaataacaacggtccgagtacattcgatgcttccgaaatctttgacaagctgagagttgctccggatacatatttcaagaacatcaaagaggccgggagtatgggagcgagtctggcgctagcaatgaccaagtccctttactcgaaaatcgacattgatgccattgacggctttgcagacgggacgagcgaagaagctgctcttgaccttatcaatgatgcgcagaaagccgccgacaagatagcggtcgatgtagtcgagaggttccaggacaccgatcttcgaccgactggtcctgataactctgatgatgaaaaaactgatactgattgatgtaatgtgataaaaatgattctaatgaaaatgatggaggcacaatttgtataatactgatgaatttatgctgtgctcagtgtttcatacttagcttctgatttcttaaaagcttttgtcaagccttattgagcctaaaacccgcaaaagctattaaaaactttcagtcctcatggactaagccaaaaaattaagcaaggcaatgataaatcgagtaagcaaattgaactaataaaaatcacactccattattattatgatagcccccgactgatgacttcaaggaaaagcttgatgttgtcagtcaaaatagggaaatacagaaacaaaactttaggcataaaaacgacgaagatgttcgatattccaagaattgtcgataggtgtaccgtcttcacgcttgagtcgataagaacctggccgagtaacttctgagattataaatggcccttcccataaaggagataacttgtgccgatcccgtatagtttgaatttttctcagaaccaggtcgccgactaagaaggctcgcgatcggacgttacgattatgataacgacgcaacccttgcaagtatcgggccgactgaattaaggctgcttcgcgggcctcttctagtcggtgtaggtcatccactcggtcttctccgtagcgctcttcatgaaaattgcgaaaatgcaaagattcaaattctacttcactaggcaacattgcttctgctccgtaaactaagaagaatggcgactggcccgtagcccgactgggggtggtgcgcaaggaccaaagtacagatagcagctgttccacccatttgtcggtataaggattcagtcggtcaaaaactcgtgcctttattccttggagtaccatcccgttggctcgttcaacttgtccattgctcataggatgcgctacggaggcataacaaattttgatgccgaagtcttcacaaaaatctttgaatactccgccggtgaattgagtaccattatcagtgatgatccaattaggtaccccgaaccgatgcacaatgttgatgaaaaaatctctagctttatctgccgtgattatgatgaccggtttggcttcaatccacttggagaatttgtcgatagccacaaagagatgtgtgtaaccgctgactgcctttttaaacgggccaaccatgtcaagcccccaaaccgcaaacggccaggacagcgggatggtttgcaactcttgggctggcagatgagtttgtctggcgaaaaattgacaaccttcgcatgtccgcacaattttgtcggcatcggacacagcagtaggccagaaaaaccttgccggtaagccttgccgacaatggtgcgtgcagcagcgtgattgccatagataccggaatgtatatccttcagcaattgtctcccttcttctgaagacacgcagcgttgcataattcctgatggacttttcttgtacagctcggcctcatgaataatataaagcctgctgcgcctggaaatctgctcggcttcgtctttatcttgagggagttcttgggaggtcagaaatcgtatgaggggctctctccagtcggcttcaaccatagctatgtcttgagtgtccgcggcctcagctgtttctctccttggtacggttggctcataaagatgttcgacgaacacgtcagaaggggctgcttcgcgtttggatccgaaatttgctaatctgtcggctgctttgttattgtgccgaagaacatgggtgagttcgagtccatcgaacttatcctccaacttgcgtacctcttgtcgataagcgatcatattgtcatcaagacaggaccactctttcataacttgattaacaactaactgtgaatctccgcaaactatcagacgcttgattcccaaagagattgcgatccgtagtccgtgaaggagcgcctcgtattctgccacgttgtgagatgcagagaaatgtatccatagcatgtagctcagtctttctccagttggggaaattaaaacaaccccggccctgtcaaagtgcatagtccaatactccactccatcttttcctcgggcgtgtcctcttggcactcggtccactcggcgac

SEQ ID NO: 13218 - DNA, 1071 bp, Oryza sativa
tttcgcagtcttccctggcgtcctgcaacatctgaccaaaatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatctattgccgatccatctacatgagtcaaaaaaaccgcacacaaataattattcttacaataatgacagtcatacaataattataagatatctttattcatacaaaaattataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctccgatttgatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccggatcattagtcccggttggtattaccaaccgggactaaagttaagatctttagtctcggttggtaccaccaaccggggc

SEQ ID NO: 13219 - DNA, 605 bp, Oryza sativa
caatatgggtcaaatttgatccctacttacaaaaactacaaagaattgaaacagattgtgacacgcgctgtacgcacaccaccctcttctggtcttctcccctgctctgctccaccaccatggagagcggcggcgccggcggcgaaggcgagacggcggggtggcggttcggcgcggcgaacccggcgctggcggtggcggggtcgcagagcatccgcgcggccgtgacacggatttaccgctgcctcgacgggagcggcgacgcgcggcccgtggcgccactcgcccacggcgacccctccgcgttcgcgtgcttccgcgccgcgcccgccgccacggacgccgtcgccgccgctgccgcctccggcaagtacaactactactcccccgccgtaggaatcgccccggcgtgcaggtacgtcgtcgcgtgcaaaagtggatgacagatcatacgtttttcttggatgaaatatcgtgtgaaaaatgtgaatacgcgtggtgaattttggccaaatattcaaatttatatatataaattagcacacactttagcatagggtacattgtacatatatttttacagaatttcaaggccgaactcaatt

SEQ ID NO: 13220 - DNA, 616 bp, Oryza sativa
ctgcggccccgggcagcgtggagagagctatggatgatattttggtaacgtcagacctgaccagtcgctacaaaatttcacgcaaaaccctttggtcatggcaaagtgcagacacaatgcctcggggcttcgtatgcccgttcccaccccctgactggcccggcaaccctaaccgctggcgctctgagtcaatcaaagagtgggaggataaaaagaagataaattaactgaagggctctccgatgatctcttcaagatggctctgccaaacgcggagccagtgtttctgatcatcgatatagtcatgaaggttgtaatgcgccataacccccaccatctgatgcccgagcagcttttcaattacgtgcggcgggcaacctaactcagagagatttgtggctatcgtccgcctcatatcatgaagcgaccactctgccatacctgttccattccaaatagaacgggcgtaattggatgccacaggtgaatgaacgggcgaatctttgatcccgccatcaattttacgttgtgaagtcaccaggtgattggtgtttattttcttgaggtgatttctgaccaggttaacggcggcgtctgagagtccccttctaatatg

SEQ ID NO: 13221 - DNA, 241 bp, Oryza sativa
gttggtgcacatggttatctttagtgaagcttaagatacctatgcgagttcatactcctggaggtggcatgaccacaactcactattgcccgtcagtgagagttgaaatccaagggttgatttttccagccaacctcattcttctcgaatctaaggatctagatgttattctgggaatggattggctaacaaggcacagaggagtgatcgattgcactagcctcaccatcaagttgaccaa

SEQ ID NO: 13222 - DNA, 5515 bp, Oryza sativa
  unsure (1)..(5515): unsure at all n locations
nnnnnnnnnnnnnnnnnnnnnnnnnnnnnnnnnnnnnnnnnnnncgggttgccgctagctgcatgcgtcgtccccttcggaccgccactacaagttatgtgtggcttatatgacacaggttataatgtcactatatcatctaatttatgacattttatttgaagcattttaacttaatgacaataaaaagttgtgtgtcacaataagtgtcatatagctagtctagtgtcatccagtgacaatatttactatgtcataagacctatttatgtgtcacaaattatttattgtattattttaaatatttttgtccatgtaggcaagccttattgccacatcagattttcttttctcattttcagatgggccaacctggtgctagcccaacagccgcttacccgaaatgggccaacccgtgcgctaggccgagcagccgcgcctaactcagcaaaatggctaaaaaatgttaggagttaggagtcgaacccgcaagctaaaaattgttgggagttgcgtgaaaaaattgtcaaaaacaaagttatatgacttatcgaaatctaccaattttattttagttatttctccatctgagtttgattgatctatataaaatttgaattttaaaatataagaaattcaaatatatatttttttgtgtagtaaatgatttcaaatgaaaaaattgtcaacaaaaaatttgtataacttatcaagatctacaacttttgttttggtcattttgctatatgactttgtttcaataatttgaatttgaatttcaaattatgactacttcaaacaatattttcaaatactaaatgatttcaactgaaaaagtcatcaataacaaagttgtataactcataaatatctataacttttattttggtcatatcttcatctggcaaagtgatattaacattgttcacaaaatttacaaatctctcttatagtttataaaaccatattaaaattttgtgaacaatcttactatcgcttcgtcgaatgaacaaatgaccaaaataaaaattgtagattcagatggattatacaactttgttgttgatgaatttttcagttgaagtcgttcactaataaaaaaattctatttgaagttctcaaactttgaatttcaaattcaaattgttcaaatagagtcagatggagaaatgacaaaaataaaaaatttccgtctcgatgatttatacaactttagttttggtgacttttccatttgaaatcatttattaaccccaatttttattcgaaattatcaatttttgaaaattcaaaatttgtattgttcaaatgaacttatttgtaaaaaggactaatacaatagttgtagatctcgattagttctataattttattatttatgattttttcatttgaaacaaaaaaaatcgacctaaaattacatttaatgttttcataaattgaaattaaaaaaaaaacatatgatcattcctgtttcggcccaaatggcccaactatttctgaccgtccatcttcgatctaatggttctgatcgccgtccctaaccctagccctatataaaaccctcctctccacccctcctctctctctctctctccaccctcagccgccacactcccatccattctcctctcctttcctctcctctcctctccggcggtgggtatcggcgatgacagcgtgcggcggcgtcctccttcgccgcttaccacgccgcctctatctccgccgccaccacgctcgggagcggtggatctgctagatcccgggcctagggcggctagatcgagcggcggcaatccccgggcggctcgaggacggcgtgcggctgcatcgacgggcccaaccgctagccgattccaaaccacgttggccacagcatcctcgcgccgcccgctgaccacccccccttcctcgtgctcctccgcgcatagcagcagccgggtcaaaaagagtgccgacacggcgtggacgcgtccgcaaatgccagtgctggtcctcacgctgatagctagtgggcccattaggcttgtttagtgtaaatgagacccaaatttccccatctgagtcatctgaccatctcctccaacctccgccaatccccatccccaatccccatcggcggacgggggctgctgtggtgcgcgccgcgcgggagggcagggtgaggtgaggagggcgcggccaccaggcttccagagctgcggctgtggcatctgctccggcaaggcggcagcacgaccagccgccatggcccaaatgggcaggcgcgcagcgcaggaagagcagagacagaggcagggtgggatgaatggcacaacagcagtgcaggcgtgcagcacccagcgacgacagcaagcaagcgacaagccaacaagccaagcatccatcactccatcaacaggtgcctacatatgtgaacattaatcaatctttggtactatatctatctatactcagtactgtacttcctatttgtgatgtattgttgaaagcatgaatcttaggaagttgaggtattttttgagtacctactcttctatctagtttacaaatagatgatgaatcatcaacttataattagttcttgtttaccgtgcttaatgtagacttgttgtgataatattgcatcgtataataacatgcattgagatttttcgttatgtgctaacttctgtggtaattcgtaggccacacctaaaattttttccgtcctccgccactggtgtggctgtgatgcatcaagcgccggtggttgatatggccgagacttctgtgccgaatcttggcatgaagcccaagatctctgaacggacaagcaacaccaaggccacaatgggcacaaggtgagcttgtttatttcttgtattaaagaaagctgaacggttctgctcgttcatagcttgatgtcacattccttttaatcttagagcaagagatgcttttgtatgattaaggatgaatctggattcgattttgtatggaataactcttcatttttgtgtgcaatatgtggactaaggctaaggctaaataatacttttgattaaggatgaatccttacggatgctgccgtcatgcacgttgtccacctgtgcgttgtcatgcggcagataaacgggctggagcagcaatacgtatgaacataaggtatttgctataatcgtaggctttagtccagacatgataattttgttgttgtcctgaaatttattatctttattttatagttgctgctcatacaatacatgtgaggattctaccattaaatgcacaatgacccaatttgaggatcagtttagcactataaaacctgatgggattcaagtcagatgccgtaaggtacttgttcttttttgcactggacttcggacaactctgtctgtttctatcaatgaaactgcggccaatgttttctaacgtaaatgcaatgccccgcgggggtttacttgagtctactaaattttgcttactcatgtattataggattcatagatacattatgccactggggtacatgtaattcaagtacaataagaaactactcaattgtttggcagcaattttgcatcatcagatgctgaatagtaagcactcctactcaattaggttccagatgatattttggtgacactgaacttgcgaccattgtgcttgtgggatgttatttaggtgctgctgtgcttctggccgttgtgctgttgctgctgtgcttttggccattgcgctactgctgctgtgatgctattgcagatgtgctgctgttgctctcgcagtagcaggaatatgaaatttgagagtttggatatgtactgaattggtggatggatgtaatgatattgcatttcaagacttctggaatgtgaaatgcatgtgacattgcaatcatttgtggaatgttaattcatttgaatctgattttgtatgtgctgaaatatagtatctgggctgaattgtatgggctgaaaaaatatcagttgagctttgtgggctgaaaaaattatttgggctggaaaaatatatgggctaaattgtgggggtggaaaaatcatatgggctgaattgtgcgggttggaaaaatcatatgggccgaattggtgtgggttgaaaatttgtacaggctgcattcataaacaaacaagcaaaaaatatactgggccagctagcaacaaccccagaaaaaatatatttgtggcccatgagctacatgggctttagcaggccgaatcttattttgtgactttttttttaaccatgtcaactgttatgtcagctgccacgtggcaagccccaggattttatgacaataaagcattgtcaaatgcttgtgacaataaatgtacaaacgtcacatactaaatttatgacgtggctttttgacgtttggaattacgtcaactgatttcatatattatgacataataaaatgttaaaaatccacacacctcttatagtgcgtggtatcgctgctcatgcttacttggcactgcatctacatgaaactgttgttgtggcccctttggcgatagcatcaccactctcgtcagactttcaccatcatcaacttttatccaataccccaaatcacaaatataccggccgatgcattaagaaccggtactaaagctatttataatcggttctaaaagcctaggtacctagaaatatatatctttagccccagttggtgttaccaactgatattaaaaatacatctttagaaccggtttgcagcaccaaccggtactaatttttgtggatctttagtcttggttactgttatccgatactaaagatatttttagcactggttgataatatcaatcgggactaaagatatttttaatacaagttggttgttaccaaccagtactaaaaatgcctctagagttagttcaaaatgaaaatacctttatccaagttaaacgtgtggagtaggtaagatggtaacacagataatggttgagatgcgagatcttaagttcgaatcccacatcctatatattttttatttagtatgcatctttagatcttaagtctcggttactataaccgagattaaaaagagtttagaatcggtattaaagatcatttctctagtgtgtggattggttataagttttacgctttctttaaccactcttatttattgtagtctattagggattatggaatatcaaagttctggatacatgtgtagctcacgattcaatgacaaacatagttgtcggcaagaattcttagagtgtgttttcaggtcaaaaattaaaagtttggttgaaattggaacgaagtgacggaaaagttggaggtttatatgtgtagaaaagttttgatgtgatgaaaaaaattgaaaatttgaagaaaaaatttggaactaaacaaggccttaatttgcaaggaaaatttacaatgtgagctacctccaccagatgaatcaaataggtccccgttatctacatgtgcattttgcctatattttcccgcatttccccaactggttttattcaagcca

SEQ ID NO: 13223 - DNA, 33945 bp, Oryza sativa
gaacttgtcaaagttctgggtaggtgtgtactcgctgaagatgccattgtctccgggtatcactacttgcaaggacaaatgacaattaattgatgagctaccgccacatgattttaacgcatgttttcaaacctctcttcgtcgttgtttattacggaattctaggaatctcaaagttctggatagatgtgaacgtacgtagctctcaagattccattgcttaaaaaacagggttatatatgcaagaatcctttgcacgttacccagatgcgcaatgcctatatatatttattacgcatttcttcaactgctcatattcaaggtagtttattagccaatttgagataatatcagtgatagtatggcagctcgaactttgtaaaatgggaacaacttgtcagagttttgggtagatgtctaggtcgaacaagattcaatttgtttcacaaatacgaatcggattctttattagtttttacgaaattgataatacacaattctgaaattacggactttccatttttaatttgaaataactaatttaatttgaaattttgaaaccacaaatgtgaagttgtaactaacgtgtgcgcttcttttagctagagtcagtataataaaaaaaatataaaacctacatatttaagctatgattaaaatttaaaatatatctctatactctataatacccgtgcatcgtacgggttagcggctagtgtaactaatgcatgggctttggaccatgtgtagagctatattttgcatgaaaacttgcacttctctctttttttttatatatatctcctttctacctaagctatagttggcttatactctcactggaaagttgacgtgcaacttttataacttttactacctccgtctcaaaatgtggataggtcttatctcattctaagttactagacgggggagaagtacattgtttttttctattataatatataaaataaataaatatttttttacttttagtacggtactttttttctattatatatatatatatatatatatagacacacacacattatcctattgtatttaaacaatgacatgctctttaaaatatatgtttgactatgtatagtcaatgatatattttgaagaccatatcattattcaaaacgtcataattaaccggagggagttgccaactattaaaattgctcttaggcaacttggaatatcaaacgatgcaaaatgtgaagatcttgttaatgttctgggtagatgtgtagctcaagataccatttgtttaacaaatatagttatctggaggaatactttcctaggacaacttacaactaatcttgttactcccactcgattggatcatatagcttccggttatcaacatgtgcgttggctatatctttttacgtgtttcttcaaccactcttatttaagggagtttatgaggcaatttgatgtaatatctgttggcggatggcatgaggctcttcaaccaaacctgccgaaacccatggcgaaggctatagagcaagaacggcgcaaggcgaagagtcgtacaagcgccaggccagaggcgtctcagacgaagggtgcaaggcgaagactatctgccgaaggaggatgacttcgtcttgacaagttcgcccctgcgagggccgaggaagcctttttggcccatcaggccggcgatcgccagacggcccatcaggggcccatgagcccctataacattatgtacccctgtaaatgcctctttggtaagggtaatcatgtaaattcccctgtacaacctaaaccctagtaataagaacctgtaatggggctataaatagtcccctagggccatgtaatgggggatccccaagggaaattcaaaatttagtacactttatttttccaaccattgttgagtaaccacgtctttcgacgtatgcagttgtcgttttgacaacagctggtgccgaccgtggggactccgagcgaaaccactgagagcgaatgccaccgaagagggtcgtgaaggagaaggttatcaggcggaaggagagcgacgccggaccggacatggctgccgaagaaggagcagagccttcggcgtccgtggccgaagatggagaagcacaagcgccatcacaaccgccttcggcccccgcgccatcagaaccgtcttcggcccccgcaacgtcagtgcaagtgccgaacacggccgacgtggcgaaggcggctacggcggaagggcactccagactagggcggagatcctttcgacaaaccaactggtggtgccccaagccgccccatcgcagccggcggcggccccaactgcgctcaccgttatacaggcccaaatcagcctggaccccgaagcgcaagctgaagccgacatggaagccatgcggcagaacatgacacggctccaagacatgcttcgccaaatgcaagaacaacaacaagcatacgaggcggcaaggcggaccaaggccacgtcggctctaatccttcagtattcggcaggctatgccccacctcaagtccggccgcaagtggtgacccagccctctccgccactagccacacaggcgccggtgaacttcgccgggcagcatcaaccacctggccaagcgccacaatcagtggcggaaggggcttcggctctgcaggcgcaactccaagctttccttcagcaactcaaccaaccccactacatttcaagcacaaccccatcggctcacccggtggggaatacaagtcatggtgcgcccaattgattgccaccaattcagccaggcttggaagcttcgccgtggaatcaaggaccgcagttcgacttcgtcaacactgctcaggtgccaactgttcggcagcaagttccaactctaggcttcggaacaaaccaagcaccaatccatgctgccatgatgtggttgcagccaatttttgacccatccgtggcggctcagcaagtaccaccagttgggccagtctgcttgagggcgaactaacaagaaaaatcgccaacaaggagccgcagatgctcgagcacctacttcgcatcattgacgggttcacaaggagtgaggaggattctaaacgacgacaagctatacgtcgccgctgctcaagctcaagcacaagttcaagttgccgaaccacctcccctctctgttcgccagtctcagccggcgatccagggacagccgccaaggcaaggccaagcccccatgacttggagaaagttcagaacagatcgggcgggcaaggctgtgatggctgtcgaagaagtgcaagccctccgcaaagagttcgacgcccagcaagcaagcaaccatcagcagccagcccgcaagaaggtccgaaaagacctctactgcgcctttcacggatgctcttcgcacaccacggagcaatgctgaaacattaggcaacatggcaacgcgcaagacctaaggccacagcagggaacaactgtcgaagcacctcgtgaagcagttcaggagcaaacacccccagccgaacaacgccaagatgcacagcgaagggtaatcgaagtgattacaagagctgacccgccaagccagttgtcgaaatggcagaagaagatgtagatccgcatggtccacagcatcacttcggcgggtgagggggcgccacagtacgtgaaccagctgatctctttcgagccagaagacgctgaaggagtcctgttcccgcatcaagatccactggtaatctcagctgagatagccggttttgaagtccgacgaatcctggtcgatggagggagttaggccgacgtgatcttcgccgaagcatatgctaagatgggcttgccaacccaagctcttacaccggcaccaacgtcgctccgggggttcggcggagaggcagtgcaagttcttggccaagcacttttgctgatagccttcggctcgggagaaaacaggcgcgaagagcaaatactgttccaagaaacagagtccggacagaaaccggtctacttcgtcttcgaagcactgcaaggagcaaagacaaggtacattgaaatggaaaagctcgcttacgctctagtgatggcttcgcgcaagcttaagcactacttccaggcccacaaagtcatagtgccatcacagtaccccttgggcgaaatactccgaggcaaggaagtcactggccggctcagcaagtgggcggtagagctatccccgttcgacttgcattttgttgcacgctctgctatcaagtctcaagtgctagctgacttcgtagctgaatggacaccagtatttgcccccgaccctgagcccaccgagcagttctgggtgatgtgctctgacggttcgtggtcgcacaagggggcaggcgttgcggcagtcctcttttcgccgaatggtgtgccgattcggtacgcagcaagattgcagttcgacacaaccaacaatacagcagaatacgaagccgttctcctgggcctgagaaaggcgaaagcattgggagtccggtgcctgctaattcgaactgactccaagttggtagcaggccatgttgacaaatccttcgaggcaaaagaagagggaatgaagaggtatctggaggctgttcggtccatggaaaaatgcttcaccggcataatggtcgaacacttgcctagagaccagaacagggaggcagatgccttggcgaaatccgctgcttaaggcggcccatattcgctgggcatctttttcgaagtcctgcatgctccaagtgtgcccatggactgctccgaagtcatggcaatcgacaaggagaaatggggtgaagacccacatgactggcgaaccccatttgtgaaacaccttaaaactggctggcttccggtagacgaagcagaagcgaagcatttgcagctcagagccacgaagtataagatggtttcgggtcagctttaccgcacaggggtacttcaacccttacttcgttgcatctcatttgccgaaggcgaagaaatggcaaaggagatacaccaggggctatgcggcgcgcactaggctgcaagaacagtggcctccaaagtatttagacaaggagtttattggcccactgtgttgaaagtctgtgttgagcaaatcaagaagtgcgaaagttgccagcgtcatggccgaagccaagccgcgccccagtatgatctgcagcccattgcgccagtatggcccttcgccagatggggactagacatcattgggccgttcccagtggcacgaaacgggtataaattcgcaattgtagctgtggaatatttctctcgatggattgaagccgaaccgcttggggcaatcactttggcagcagtacagaagtttgtatggaaaaacattgtttgccgtttcggagtgccaaaagagttcattactgacaacggcaagcagtttgacctggaaatcaagctcgcgtcggtcgcacacccgcagtcaaatggggcggccgaacgcacaaatggcaagatcctagaagcactgaagaaaagacttgagggggcggcgaaaggcaaatggccagaggaattgctatcggttctctgggcccttcagacgacccccacaagaccaaccaagtttagcccgtttatgcttctttatggcgatgaggcaataaccccagcagagctaggggctaactcaccaagggtgatgtttttcgggggcgaaggacgcgaagtatcgctcgaactcttggaagcagtaagagtcgaagcgctcgagcacatgcacaagtacgccgcaagcacttcggcaacttacaacaaaaaagttcgacccacggagctcatgcctggtcatctcgtcctaaggaagaaggcgaacccagtagcagttggcaagcttgaatcaaagtgggaaggaccatacctcatcaagcgcaagtccaggacgggatcttttcgcctagcgacactcgaaggcgaggagttcgaccattcctggaacgccgcctccctcaagcgcttctatgtctagaatgggtggcacccaaatcgccaacttgtaaaaatgtacatactatcatgtaagcccttcggcactatgtaagcctttcggcaaagaaaaaaaaagaaaaagaagaaagagagaaaaagaaaaaaaactggatgtagggctattatccaccatggaggcccgaaccagtataaaatctctgtgtcctccgccttcttcttacttttcgtgtgattgataatttgtggaaaaaccccaaggcaaacgcctgatcagcgaaaaaggccaagggggcgaaacgaatcggccgaagcattgctcgccgaacattgaaaccgcaacagcttgtctcggaaaataaatagccgaacgacgttacgaccgatcagtataaaagcaaaagcgtttctctcgacacagaacgctacagattaaaaacgaacgacgaaaagctgaaaagtcaatacacctatttcgctaatatatgcaaaggggccggcatgttccgacctaacaaaagcacaaaatgtgacgatgcgaaaaatagcgaaaaggaaataaagcacgttctttattagcttcgaaaaaaaaataatcaaagaatacaaggtttacaacccgatacaattcattttacaagtaaattacatcttcgccccagtgatcattatccctccctaaggaatggtcggacgaactaggttcgtcatcactactaatatcatacacaaccttaagaggagtagggggcgaaacacagactaaactgtaacgacgctgaaagatcgattcctgacgtttagtcttctaatggtttcgccaaaagcgagccatatcttccaaacgtcttgaatgaacaagatcgtaatcttctaaggttcgcccggggtgcacacgtagccagttggcaaccttgataatcttatagctacgaccgtttatctccatttcgcgataaacatgccgaaatggacattgcgtcttcggcagccccttcaatgccacaaatttctcgttttgacttcgccagctcccagaagggggccgaatgcacgattttcggcggaccccctggtagacagtgcagaaaaggcaaaacacatcttgaatggtaagagtaggcgaaagaaggggaaggtatggcataatgcgaaacgagtgaaataaaaatatgccaaagacttcgatcatcaaaaggtaattaagattatgtcatacattccaaatataccaaaaagccttttttaaggtttagcggcagtttgccgaatatacaacggttcgccacatctagcgaacaccaaaagaaaactatgaaaatctaagagaagggtggagggcctcacacctctgggtggtcctgggcatcgcctccaccccctccggccgccgcgccttcctcttcacaaaggtccgccgcctctgctttcgccagctgctccaaaaggcgcgccttagcggcggagcggccgtccttctgccaaaattgttttcgccacgcacgaagtgcaggtgaaatgtcttgtgcactgatttcccaatcccccttcgcgtacttggggaactcggcgatgtgctcgcagccgaactgctgcaggaggcccatggtaaaggccgctgacacgcgcgcacagcagttgccgtacgcggtggcgcagtccgaaaccgatccgccggcctgctgggtccactcggagaagtcgaaggctgaggcatcctcggtagggaccccccgccccttcgcgcccatgtcggtaagggcgaggcggagggtttggcaagccgttctcgcagattcggcggtcttcgccatctcccgcgaaaaccgctgcgactcctccgcggcgctcgcttcagccctgctagccttctggcgaagagactatcttcggctcagtaaggttgtagtagtcgatgagcaccgccgaatgggccttctctttctccagttcggcctttaagcgatcgacttcggccctgacttctttccctttctccagttccgattggagccgcttgttttcagccttcgcctccttaagagtgttggcaagggcctccatctccaaatttttacggcctagtttgtcatccttggcccgaagacggcttttgaactcatcaagtcgggctcgcacggttcgctccgttgagcagtgagccgcgaggatctgggcgcagaatacgagcggcgaagagaacaagtgtcaattgtaaaaacaagataaaggaagggtaaagataaaaaaagggggggggaacgtacccgaacagccaggctttttatagcagaacacccttcgtcgaactcattcagttccgtgaacaagctcggggcactggcgggcagtacaagattgcttaccccctccaaaaaaggaaggaggtccgctcgcgtctcgaaatcgccaggggcgaagcggggtaccgagatcgaatattccgaagcggacgtctcagcgacagctctctttcccttcacctcaatcagcggcgatgcaaccggctgaggcggaggattgccgaatactttcgccgcggccgtcacaatcctttccgcagaagctgaagccccagcggcggtactaccgtccactcccgcggcgtcgaatggaggaatgggggcggccgaaagatccaggctgcgaccagcgggcgaagtcagagtcccgtcgaaggactcgtcgtcgctaaaaacgcgagcgacatcgacgagtcctttcttcttagccacctttttgccaggacctcccttcgccgctgcacctgaagagaacgcaactagggccttcgccccttccaaatccttccgatgaaggggggagctgttcgactccaccccggtctcgttgtgaccgggacttggggtaggagtgtagccgggggtgtcgacgcagtcttcgaccgcctcgctcgcggccttatcagccacagcctccacctcctcctcttcatctccttcctcctcgccgtcacgttcttcggcatcatcctcgtcgtcagcgtcggagtcagacgaagtaggaacccttcgcttcctgggggcaagcttcacttgtccgcgcgtccgctttcgcgaaggccctgcctcgtcgtcgaccttttggggattcgcccggggaggcagttcgccattgtaaacccggttcgcccgcccagccgcttgatgcgttaacagctgactatactcgacggccgaaacatcgccgatcatcctgcaggctttggcttcggcctggtcgagggtcaacactgtaaaagtagagtgtgaagctatgtcaaaagtcaaataaggcgaaataacaaagcacagcagtaaatagcaaaacaacagtcttactgttcgccccctcaggaagtatcaggttcggcaaaccgtcgacctcttcgccttgttcaaccgcgacttgccatgactgggagaggggaaaaattcgaagcatacaaaattcctccaccaagtcacggcagctaaggcgggagcaaaccttccgtagtagaacgaaccatgcctccatggtgccgttcacagcaatcttgggcctccggttcggcgcaatcgccttgcgccggcaccggaaggctttcgctgattcagaaatagcctcgaaggggatggtgtggtagaaccacctcgccatccaatggcggtcccacttcgacatggcagcgttcaccggctagagatcggaccgctcggggctaacgttgaagttcacgctcccgaacactgtttttttcattccagccggggtaatcaccgtcttcgagttcacggtggcgaaaaatatggcgccaaagagctcggtgttaggctcaaacccggaagtccagcacgcccagtcaaagatagcgatctgaacaagcgccgacgggctcagctgcggaagttccacctggaagaggcgaaggatttccggcaacaacacgttgcaaggaaaccgtagccttgcctcaaaaaatacggcgaacaccactgtccgattgtcgacaggtttcggcaccacggttttccctggggcgaaagcctgcccctcaaccaacgctccggagctgaccatcttcgccagctcgacgtcgtctacaagagagacccccagaaaggcggtgctgttgtcatcgactaggccgggatctggccctttcgccgaagtagggtttggcttacgtggggccatggcgaacggtgcgtttgcggtggcgaaaaacgagattcggcgaaacgcctgaggggtcgaaagatgctgtgaaaggaagagacggaggaagagagcgctcgcggtaaaatggaaagtggggcggtgaaaaggaaagagaagcgggaatatatagcccacccaggcgaccgttcgcctaaccactagtaataaagcgccacgtgtcgcaagggtaggtgaaatggtaaattcccatcgaccgagcggcacagtgaaaagcccacgataggaaggcttccgttcggcccaggaaaaaagaatatatataaaaatcaatcgcaggaggcgaagcgcggcaaaataataccagccgcacaaataacaaacttcattcgcaggaataatgtaggtttcggcaggagcatcggtcgaaagggggcgccgcataccataccacatggtttgcacggtctcggccgaagctccaatctcacccttgcccgtgaggggcttgttggcggatggcatgaggtccttcaaccaaacctgccgaaacccatggcgaaggctatggaacaagaacggcgcaaggcgaagagtcgtacaagcgccaggccagaggcgtctcaggcgaagggtgcagggcgaagactatctgccgaaggaggatgacttcgccttgacaagttcgcccccgtgagggccgaggaagcctttccggcccaacaggccggcgatcgccagacggcccatcagaggcccatgagcccctataacattatgtacccctgtaaatgcccctttggtaagggtaatcatgtaaatttccctgtacaacctaaaccctagtagtaagaacctgtaatggggctataaatagtcccctagggccatgtaatgggggatccccaaggaaaattcaaaatttagtacacttcattttcccatccactgttgagtaaccacgtctttcgacgtatgcagttgtcgttttgacaacaatatcaatgatagaatggtaccttgtagcttgtaaaataggaagaccttgtcaatgtttttgatagacgatgtgtagttcaagactccacagcacacctatggaataggtcatccatgttgggtgggtcccttctatgtcggcaaggagcccagttacagattattggtcagtgatgtcaaaactcatctgtgtcgaggatgagtgtcattagtaacaggtccagactagaggcctgtggtgagtgcctgtaatggtgcttttgtgtcgaggtttattatgtcccgtcaaatgggaggtctatatgatgggatgcaagcccctatcatggatgtcccgttcacgacgtcatgttctatagtggtagcaatttgcaagggatcgcatgtaaaaataagtctatttaccaatacggtcatcttaaggggccacataccaaataaattttcgtatgcgtgtctcttaagttgtccgcacgcgaaaataccctcttcttcacagattttttttcccgtgctctctcttttcgctctcaccacttaaaacttttcgtctcctctcctctcactcttcctctccttatgtctgttcctctcctctcctctgatactctcttgtcttcctctcctcaccgagtgtgcgggagcaggcggtggggttgggagcaggcggcgccgccgttgatgacaaggaggtggccaggagtaatgccgcctagcgtggatctggcggtggcgacccatccccacgcggatccagtgccggtgacgacgatgggcggcgggggcggcggatctgacggcgacgacgagaggcgcacggtggatccggcgcggaggacggtgggctctggcagcagcagtggcgccgccctgcgtgggtccgactgatgacagcggcgagctagggttcggccgattcggtttttttatttttttcgctgatattattttcgcatgcagccgatataggtgaccacatacgaaaataccattttcgcacgcggttgcgctggtcgcatgcgaaaatccgattttttgtagatcttttggcgcatgcgattgtgctggctgcatgtaaaaatgatttatgtagtagtgggacgtagctcaagattccattgtttaacaaacagggttgtatgcacgaattctttgctaggacgatttacaaatagttgagctaactccgcccgattggatcaaatagcttcccgttacccagatgtgcactgcctatatatattttttatgcatttcttgaactgctcatattcaaggtagtttattagccaatttgagaatatcaatgatagtatggcagctcgaactttgtaaaataggaacaacttgtcagttttgggtagatgtctaggtcgatcaagattccatttgtttcacaaacatagctatctgcaggtattccatgtcaagtcaattgacaattaattgagctacctccactcaattatatcatatagcttccggttacctacttcctccgtcccattttaagtgcagccatcagttttcgtgtccaactttgatcattcgtcctctttattttttttataattagtatttttattgttatgagatgataaaccatgaatagtactttatgcatgagtttttttaaaagttttttaaaaaatcaactaagacaaactatattaaagttgggcacgaaaaatgatggttgcacttaaaatgagacagaggaagtacatatgcattggctataattttttggcatttcttcaaccactctcatttactgtacttcagagtatttgagcaagtttaatactagtagatataagtgttgaatatataagcacgtaatgatttaatttgttccataaatacataaataaatcatgacattgtcgatgtaaactagtataatcacatcataggatctatacatgtaaacaagacagtaaaggatgaacagatcgaagatgcgaaacatgttgataccgatggttttggaaatccggttgctcggcaggaagaattcacggtaccgtcccttaacggtagcgcacagcacgcgagcgaagaggaagacgagccgtatgaacgaatagggagcagtcgcgtggagcgcttcccaaaaacccaaaaatcttattgctaccttcttctagtgcaaaacgtagaaggcgcaggtttcggagagctgctctcccgattgccattgagcaccggcgagtgggatggagtagactacaaacaacaacgtagtacggaggaggaggccaacccaagattgattccacgtatgttgcgaggaggtggcggctcaaattatatagagatatcaggacacttgatcagggcgcctacacgatctccactctgcataaccgaaccgaaccagataagtcacgcgtaacttatccgaactccacaccgtttcacacatcggattattcggagtgtttccaaaaaaaaaaaatctgaattttccgcagcaaaacggactccacaccgtttcactcatcagattattccgagtgtttccaaaaaaaacaaatatgaatttcccgcacatgcctcaagtggctaggagagcatcctctcctagaatgggctaagaccgatctattaattcaaacaataagtccatattaaacccgagttaaactgacatgtcaggagcacgtgttccccctgttctctccgcctcacatgcctcaagtggctagaagagcatcctctcttaaaaggaggtcttcctctcattgaataggcaaggcggtactaaactccccatgcatgatatcccatgaggtgggctttatgattttccaaagaattaaacttcgaatgggctaagaccgatctattaattcaaacaataagtccatattaaacctaccatatatatattttagttgtaatgttgccctatttttgttttcctctttttccctcgcctatgtaactaatgcatttgctttggagcatgcgtagagctagattttgcataagagctagcacttctcattttttttatctcgtcttggcataagctatagttggcttacactccctccggaaagttgaggtgcaacttttataacttctactaactccgttccaaaatgtggatgggtttcatcccatcctagattattatatatagcaaatctattctacacccctcccctagaataactattctacacccccctcccatgggccaatcccatctcccccaccattcatatggcccaaatctcccctcccacctcagtcaaaggctagtcaaagcctcctcccgccggtcaaacccgagttaaacccgcccattgactccctctcccacccaccactttgctgttcacgtctcgcaggaatcccgcagtaacataacggttatcgtgtagtaacaggacaactttctcgcagcaacaacatcgaaaaatagttttgttaagcacttttttacagaaatcatggtgcagacgaattagaaaaatactatataatgtgagagatattgctctctaaagattgagatttacttttttttagttctcatcacgctggaacggcgtagtaacgttacggtcaatgtgcagtaacacgactaccatgtatatttatttgtgtgataggacgattgagtcgagatctgctccctctaattcctctacgccctctcccatcaccgatgcgcctctcagctggcaggcttcgcaaggccatcgtcaatcatagccaacgacatgatcaccgatgctgacaaggctcggcaggcgctgccgattgctacggcctcctgcgtactcaggagcggtggattcaccgcctgttggtgggctctaggcacccgctgacaacttcaacctccagtggacttgggagtggcagatctgctgccgatagggtttgttaaacgatgacgacaattgtggtctcctaaaggctcataagcaaccggtccaccggaggttgcctcaccctgccttatcccctttcttccttcgcatccaccacaccactaccacctctagctagatccagatcaaggtacatggcaggagcgctgagatggaggctgatgatcaaggcagtgggagaaaggggccaatgctgagctcgataacggcaagctttgctgcagccttgacctatgttcacttcgcttttatttcgctatgagataaatgtgaatttgttatggaattgcgttatatatgtgttgagcattgttatggtgatgtggaagtttactctcgactttggatttgcggtgtgtctgatattgatttgcagtggtgtggatccgtagaaatgggacgagcaggaaatggcactgcatctggatatttttgagctatattatttgttttcaccgaaaatcacctcccaagttgctcggcttaacctaaccacctgcaaaaattgatttttacatgtggttatggcaatttggtagaggcgcaggtggctcatccgcatgtacacatatttttccgcctataagtccatcgaaattttgactaattattaatcttttagaaaaattattttgaaataaaccgtgtaaaaatcttcagcaaaaataacatgagctcaggggccgtatggcattgaggtccaatagctcagcatcgtccctgatcgatgccgctaaccccgtcaggcgttattcagcttagagggcgattggagaggattaagggggaataattccagactataataggtgtgaaataaatcccctccaattcctctctcataaggattaaccgaataaggcctcacggtgatgcgcgagaagatgcaatggattgaccaccataacgcttggcgctgacctcgtatactccaaaaagaagagtgggtacgtcatgtacatccacaagttgacaagttgtgtggtggttacattgttttgctatatatcttatgcacacatatcacctaagtttgaatctcacgtacgatggttaggtggttaggttcttaatttgaatggttagttattactagcgcgcgcgcacaaacactgaaaaatataattttttaaattgtgagtgtatatttagtcataagaatttgattcataccaaagcaataaatcaacttaaattaaactttattttacaatccattattacatacctaagtaattatatataagtttagatcctatatacctacaatcaaaatttaacaaaaagatattcaaatttagttcaaacttgtttgaactagctagtaaataagttaatgttcataactaaacatttttttaaaaaaatcagactcattagcattaggtacatactcaatttttaatcatgttggccgggccccatgaagccccagttaattttaatatatatatatatatatatatatatatataaagttaaatttgagttgttttgttgctaggtataggtatgaatcgaatacttataactagatatatagaaaattttgaaaaatttagacgaatttgtgtatttcatattatggtgcccgggtgcccatatatgtcctatgtgtgtgtatgtaaaccggagttgctcaaagtatatatactataaaaagagtgtgctaaatatattcaattaaaaaagaaacacttatcatagaaatgataatttcataggatcaactccgacacaataattttctcatcaatttaagattccatggttcaatataattatgctttagattttatatatgttctgtgaggataattagaagaaaatcgcgaagtgagtatagctcaacttgttaggtttttttggtagaaccaacccacccggttttatgtcctagactttgatacgcgggtgtttgtgattacggctaactattgttgtagtagtagccaacgtacctgtctacatcgaggcacttgtggtcaatttgtaaatcccaacatatgtcgtctcagtctttcaaaggtgctcgtagaggtagggtagtgtgcgtgtgtgctcgtaggggtcattgtgcgcatattatgagcgtgtgcatttgtactgtttttcttaaaaaaatcataactcgttaataagatagcaggttcataatatatagaatgaaataatatgttttttttccaaaaaaggtcatccacgcacaaaaatgcatatgttaggctagcaaaattttaagaaactttaaataagatgtccacgtttgtgtgcgcatgcttccttcctgtttagttagattacaaatatatttagttcaagaattacaccaatatattcgtatatatattaaagtactggtttttgcagctgaaaagaatatatcttatgagatcgaattgaaacttttgttcaaacttcaatgaatcttaattaaacacgttttcagaaaaaaaaatagtatcgtcacacaaattcaacggagatatattattgttaggaaaattggaaaagggtacaacgttctggcagacaaacgtgcagctcacccctataaataacttagctgcgaccatttgttcgaatcagccgggctgagaggcagcagctagctagcgcacatgcattttcgttgtggcgaacaagctagctgctagtaccctcagttataccaagatatacactacattcctagctaggtacgattagccgccggtgagtggggagatggtgacatcaacagtgaagttggaggaggttaggaggatgcaaagagcggaggggatggcggcggtgctagcgatcgggacggcaacgccggctaactgcgtgtaccagaccgactacccggactactacttcagggtcaccaacagcgagcacctaaccaacctgaaggagaggttccagaggatgtgtaagcactaatgagtaatcagttaatttgcatctatattatactagtacacatactgtatctagtctaaataagtgaaaggtgaatccctttatagaaattaaagtactgcgccatcacttctattataaaaactgatcatgtttttgtcggtattttggtatgtcatttttatttgagtcggtttgtaatttcgttcgcttttggaaatatagattcgtgtttgagtcaattttattgtttgttcattttttgaaatacaaaaggagtcgtataagaaatatttcttaaaaaaactcgcacattaacttgagacgatagtcggactcctaattgcagctcgtgattttctaaaaaaatttaagcgaatttccagagtaaatttcaccctatctaaaccgtataacaataataattaataataattaagattaaaatagcgcaggtgcaaattaatatcgcgcatccatgatatatgcaggtgaaagctcgcagatacggaagaggtacacgcatcttactgaggagatcctacaggagaaccctagcatgtgcgtgttcacggcgccgtcgctggacgcgaggcaggacatggtggtggcggaggtgcccaagctggggaaggcggcagccgaggaggcgatcaaagagtgggggcagccgatgtcgcggatcacccacctcgtgttctgcacgaccaacggagtggacatgcccggagccgactaccaggtggccaagatgctgggcctacccacgtcggtgaagcggctgatgatgtaccagcaggggtgcttcgccggtggcacggtgctgcgcgtggccaaggacctggccgagaacaaccgcggcgcgcgggtgctggtggtgtgctcggagatcatggcgatggccttccgggggccgtccgagtcgcacctcgactccctcgtcgggcacgcgctcttcggcgacggcgcagcggcggtgatcgtcggctctgaccccgacgaggcagccgatgagcggccgctgttccagattgtgtcggcgagccagaccatcctgccgggcacggaggacgccatcgtggggcacctccgcgaggtgggtctcaccttccacctgcccaaggacgtcccggagttcatatccgacagtgtcgagggcgcgctcaccgacgccttcatgccgctcggcgtccacgactggaactccatcttctgggtggtgcacccgggcggtccggccatcctcgaccaggttgaggagaaggtcgccctccacaaggcccgcatgcgcgcctcccgcaacgtcctctccgagtacggcaacatggccagcgccaccgtcctcttcgtcctcgacgagatgcgcaagctctctgccgacgacggccacgccaccaccggcgagggcatggactggggcgtcctcttcggcttcggtcctggcctcaccgtcgagactatcgttctccacagcgtccccatcaccgccgccgcccctcttattatgcagtaatactacttaatggtacaacttctggcgtaaactttactacactactttgtttaattattttaattgtttcgtgtcatcgttcctgttcacgtcgatcaggcttcaatttctacatcagtgtgtgtttcagtgtttgtaactgttgtgacctagcggccgtacgcgtgatcgatcctgggatggcacgatttcttgtgaactctcgggcggctttaaagtacacgttatgtcatatatatgcatgtaattggccccttgtttgcccattaataagtggagaatgataaacaccagaaaacggcgcagcaagcaagatcgcagccaaaaaaatgtctcagccttatttgtcttgtgttcgttcttccatgccgtggagttcataccaaaccattaatggtgtacgtattttcttcttcacaaatactaattaacggtcgtctatttttggtcttggtttcaaaagaaactacaatcaattattacacagcgattataggtcgaatatggttacaaaattataaaatcacaactcgaatagaaacaacaaaactaccacttacactaccagtactcaaccagcctaaagacaacaataagaaccctcatccatagagctggtttagttcccaaaacaaaaatttttacagtgtcatatcgattgtttggacatatgcatggagtattaaatataggcaaaaatcccaattacacagattgcgtgtaaattacgaggcgaatcttttaagcataattgcgccatgatttgacaatgtggtgctacaataaacatttactaatgacggattaattaggcttaataaatttatctcgtagttttctgacggaatctgtaatttattttgttattagattacgtttaatacttcaaatgtgcactggtggagaaagcgtttgtagtcccggttcgtaacccccctttagtcccggttttcaaaccgggactaccaatccgggactaaagtcgagctgaccttttttttttcatggccctgttgctgcatggtttatatatatatatatatatatatatatataaaaaccatgcatatatatgttttaatacatatatatatgcatataatatatatatatatattatatttatatatgtttcagtacatatacatgcataatatatatgtatttatacatatatatgttatgcaaatgcataggtatatatatatatatatatatatatatatatatatatatatatatatatatatatatatgaaagcacttaacattttatgtgcatatatatatgactaaaatatatatttacattaaagaaaatgtgtacatgcatatagaaaaatagacatgtattaattacaatctattatgatgtcctagctagctacgatttcgacgtagtagtagtcgttatctcagaagctaaggacctatgaattgtatttctgtcgtagtagaattcacccttgggatcaaggatttgttcattgataaatcccatgagttgttcttgaaccaccgcgataaattccttgtgtgtgatcaggttatccctcatgcgaataaactatattaatgtatgaaattaattagtaattaaacaacaaatcgatacgtacgcaatgaaatttagaatttatttgtacgtacatcgagctctcttgcggtgatgatttggtctacaaggcagtggcaatactcgcacacgtagcagctgcacaagttagttccctgcttttgctttgtgcactataaataaatgataaacggtgagagatctaattaatatacacttgtatgtatttgaattggagattcaatataaatgtaaagcatgtgtactcacaggaaaattgaacttccgcctaagtctttctctccatttactgcggaccaaatgacggaatcgataccaagccctacatggagtttaaagctatgattcgtagtagcaattaattataacaagattcttaattaacataggaacttatgacagtacctgtctataagttcgaaaaccttgtcaaacatagactcttttttatccattgagtcatatacgttgacggtgcaggcctccaggttgaagagtaaaaagacccagtggaatctgcaatgtgcgtgggatgcattacatatgaaacacttagcatgttcgtacggaatgaaatttggtataggaagacagtaaaattaaactaactctgtgttgtacggtaatagtatgaacgtcttgtaatgctgcgccttcaagagatggacgagattgtcctctgtggcttgcggatactggtcgagcattgcgacgtttactttccgagggtcgatgaatccagtatcgaaaaccccccgccgccgggccctttgaatctccattctacaacaataaaaggaagtatatattatatgtagtctacttatatacaaggacctaactaattaaaggaaacataataagaaatctaactgaacgatacttacaaaatccagcaactcataatagagacgtcgagggcatccagctggtatagttcgtagatacccttgaaattgatccagagaatgtcatctccttgcaagaagtccgtgtccctgatcctcgctccgatcatttctgtaccggtggcgctcatctccatgtacagttgatggaacttgtacatttgtgtgggtagggactgcagctgctcaggcttgacaagcggtttaccgagttcgtacatgtatttcacttccgcctttttgattggtgcacctcgtagcaattgatccgtagttagcccggtgtcattaataaattcttgtattccaaaatcttcatgttcgttcacgttcgttcgttcgttcacgttctcgttcatgttcgttcattcgttctcgttcacgatcgttcgttcgttcacgtggcggcagcggagcggcggcgtggcggcgcggctgcggcttggcgcggcggcagcgtggcggcgcggcatcgacgtggcgcagcggcggcgttgcgcggtggcggcgtggcggcgcggcgagggcgtgccgcggcggcgtcgtggtgtctcggcgtcgtgccgccgcggaggcgtggcgcagcccggcgttgtggtgcgcgcagcttcgtcggcactgccggcgcgacgtcgtcgccggtggtggcagcatcgaggtcagggttggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcgtaatttttaatcatacaaagagcatttaagtaattacccacatattaaattaatcattaaatggtctaattgtaattttttatgtactttgagtgtccaagtattttcaggatttttcttgaaattatttgagcattggaagtatttttaacaattcaaagatcatttaagtgattattttaattggaaaagtaataaaatcctcctcctcagcttgggccattttcggcccattccttcctttccttcctctctcttccaccggcccaacccgagcctgcatcctctcttttcttctcttagccaaagtctggtattgctccctcttctaaacaggctgagaaaagaaaagcccggcaagaagtctacttttcctccctgcgctactgttcatcttccagctctggacagagccagagcagagccgtgccgtgcctgttgccgccgatccccttccaaaatctcgcctctcgttgctcctttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtgtgccccctctcccgtggtctcccgtgcctcgtagcgccgccgccacgtgctccaccccgccgtcgtcgccggccgagctccatccgcgtcgtgccgccgcctccgtcgtcgccgccggccgccgtcaccgccgtaaggtacgccgaggtgtggagaagcccggccgctctctccccgctgttgccgatcaccggagccccgtcgccgccgtcgaccgaagccgcgccgccgctagacctcgtcgtcggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggctattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagcctttttcttcgttttgcgtgttagcttgtcgtttccgtcgttgcggaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgggctttatatattggttcagctagatattagttatgattgcttagccatgcttagaaacattagcacactattgggataacttatgactcactattatttaatgatggcttaatgatagttcacgatggtcaatcgtgattggttaattaattacttgccaactaaatcttgataatggtgggttgtgagcacatggttttgagagtcgtgctcatggcaattaaggaccggttcgcgagctactgttgtgaaacattaaccgtgccaaccacaagccagcgtgggcaacggctttacctttcgtatagcatggttcattgcagagcaccagactgagaagtggcggagataagcccacgggggtcgctgggagtccatgcctctggtttttgagggggtgattatgatccaggaacggtgcactgtggtgggttgtgttatgcaaggggtaatgtcacagctcctttccgaggtaccgtggtggtactgaggcacattgtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtatgttgttcagtgttgattaaaatttctgattaattactccactgttttacttctcttaaatgttttgctaaatgctgtttttgcaaatgagcctatattatgccatcctttggtatccttgtgcacttgcatatttgctgtgtggcttgttgagtatgtcatatgctaattctttcaataatcaatcaacctcagttgaagaaaatgatccagaaggagaagacgtttggcttataccccagttgagctgcctgtgggagtggagccggagcttcgctagattttattttccgctgcagttttcttcatggtgaggactaagtgcctcttaagtaagtatttatcgttttagctaatttgatgaatctgtatattaaattgtcagtttgtgtacctcggctgattcctggacgaggattttatgcacaaataagttcggaaattactagtgaatttccgggcgtgacaagttagtcatcatcggcgcggcggagtcgtgttcggccgcgacgacgtcggcggcggcgtcggcaacgaggcggccggcggctgtttggggagagagagagatcgaggtcggagagagagagggaggtggcggcggctctcaccccagagatgcgacggcggcggaggcggcaacgacaacgcgcgcgagacgaccgcgagatacgacggcggcgtcggcgcggggatgctctaggtagtggcggcgaaggagaagccgagagagaaattgattggggaaaaaacttctaagtgttggtggagaagacgaaggcgcgcatcgggaatatatatacctctagatctttagtcctggttgatgagaataaccgggagtaaagatattttcccgctatttccaatttctttttaaacccagttagagttaagaaccgggactactgataagcgcactgaatattaatttccattacatatgtgtttctaaaatagaaaataatgtgttcaaattaatgacaattacttcgaaaaattattgttgtctgtagtacattaagtggataaaacgtagtaagcaaatactcctatatgatttaaaattaataaaaattctaataatcatatatacttagcatatgaatgatattaaattaattgttaaaaactctaattaacatatgtatatacgtacgacatgcatgatttaaaattaataaaaattctaataatcatataaaatgagcatatgaatgatattaaattaattgttaaaaactgtaattaatatatgtaaatacatacgacatgcatgatttaaaattaataaaaattcaaataatcatatataattagcatatgaatgatattaaattaattgttaaaaactctaattaacatatgtaaatgccacatgcatgatttaaaacttttaaaaatcctaattatcgcatataactagcatatgcatgatttaaaattgttaaaaactctaagtaacatatgtaaatgccacatgcatgacttaaaacttttaaaagttctaattatcgcatataactagcatatgcatgatttaaaattgttaaaaactctaagtatcatatgtaaatgtcacatgcatgatttaaaacttttaaaaattccaattatcgcatataactagcatatgcatgatttaaaattgttaaaaactctcagtaacatatgtaaatgccacatgcatgatttaaaacttttaaaaattctaattatcgcatataactagcaattacatgatttaatattgttcaaacctctaatcatcgtacgtaattaacatatgccatacaacaattgatttatatggataatcaatacatccaaaatagattacatcgtgtacacaataattacggcaatacatcgaaggtgacggttgaccgcacgtactttctcctcattattgttccctccttgtgatcgctacgtgagtaaggggtgtcttcatttgatagaaggatgctagggtcaatcgtcaccgtgaaagggggttgcccatccaactgatcgtaatcctcgtcagttttgtcctcaactccgacaatttttcttttgcctgggagaaccacgtgacgcttcggctcgtcaggtcctctgcccttctttcctttgctagacatgtccttcacgtaaaagacttgcgttacatcattggcaaggacaaaatgtttgtccgagtatccaaccttgttaaggtcaaccgttgtcatcccactgtcatcaatcattacacctccaccagtcaacctaatccatccttggaatgtcgtgatcgacccagatggtccccccgccaggaaggccagttgtgtgacgccccacactctccgagaccgggccccgccaggaaggccagttgtgtgacgccccacactctccgagaccgggccctctctacatctagcagcttccctaggacatagactaccctcacagaccaacgctagtgttttctgcacactttgtcctcactcgtgcacactactagtgagtgttttctgcacactttgtcccgaaattgctccaggccaagcacgcttaacctaagagttctttcgagaccggcttccggaaaagaagttgcaacttgttgatatgagtattctattaatcctattaagccctaggccgggatgtcacaagttgttggttgatcgtctcgttacccatgagatgttgtcgtagccacgcggggaaagtatcaatgtgatgccgtgtaatccatgcatcggacttaccgatgtttatgacgcgaactagagccaagtgctcctcgatgtaaggagctaccaatgaagattgttgcagaaccgtgaaatgggctttacggaataaattgttgtctaccgccattattgctttccttctgagagatccctctccccatagtctcccttcatgtcgtgattcaggtacctcgattgggcaaaggtcttcaataaattttatgcaaaattcgatgacctcctctgttccataccccttggcgatgctttcatctggacgagcacggttacgaacatacttctttagaatgcccatgtacctctcgaaaggaaacatgttgtgtaggtacacaggcccgagaatactgatctctttgacaaggtgacaaagcagatgcgtcattatattgaaaaatgaaggtggaaatatcgactcaaaactgacaagacaatgcaccacatcattctgaagggcttctaatctatccggattgatgaccttctgcgaaattgtgttcatgaatgcacatagtctggaaggataccccttattacaactggtagcagttgtgtcatcaacaggtgacagtcatgagactttaggtttgtgaacttcttctccttcgtgcttattattcgcttgatattcgtggagtatccagacggtacctttatgtgctccaagcattcaaacatactttccttctctgccttgctaatagtgtagctggctggactcaagtaatggcttcctttctcctttggttctgggtgaaggtcgccgcgttgttccatatggtttagatcattacgtgcttctagtgtatctttcgactttccatatacacctaggaagccaagaaggtttacgcaaaggttcttagtgaggtgcatcacgtcgattgcgtggcggacgtccaagaattcccaatagggtaactcccaaaatatagagttcttttttcacatcgccgcgtgaccatcttcgctctctataggctggcttctatgcccctttccgaacactactttaagttctttaaccatagcaaacattgttttactgctgcgatgtttaggcttcgcacggtggtccgccttatgttcaaagtgattgcctttcttccgtaccgggtggtttgcagcaaggaatcgacgattacccatgtacacaaccttcctacagtgcttaagatacgtactttctgtttcatccatacagtgagtgcaagccttgtaccccttgttggactgaccggaaaggttgctaagtgcagaccaatcgttgatggttacgaacagcagcgctcgtaggttaaactcctcctgtttgtcctcgtcccacacgggacaccttcctttttccacaacagtttaagatcttcgaccattggtcttaggtatacatcaatgtcgttaccaggttgcttggggccttgaataataatcagcatcattatgtacttcctcttcatgcatagccaggggggaggttgtagatacacatcgtaacgggccaagtgctatggccgctgctcatctctccaaaagaattcatgccatccgtacttaaaccaaaccgtatgtttcgtgcgtcctttccaaagtctttaaaatttatttcgatgttccgccattgcgaaacatcggcggggtgtctcagcatcccgtcctgttgacgctcttcagcgtgccatcgcatcattctagtattccccttgttcctgaacaaacgccttagccgttatattatagggaaataccacattaccttagcaggaattctcttctttgttagctgcccgtcaacttctcctggatcgtctcgtctaatcttgtatcgtagtgctttgtaaacagggcatgcttctaagttctcgtactcctcaccgcgatataggatacaatcattcggacatgcgtgaatcttctgaacttccagtcatagagggcagactatcttcttagcctcgtacgttgtctcgggcaatttgtttccctccggaataatgtccttgatgagtttcaataaatcgccaaatgccttgtcactaaaaccatttttggccttccattgcaagaacttcagagtggtatcctaactttttgtgcccctgctcgcaacctgggtacaacaacgttctgtggtcctctaacatcttgtccaatttatgggcccccttttcacttttgcagtcctccttggcgtcttgcaacatctaaccaagatcatccgcaatgtcgttaccatcaacatccctttcctcctcgtccgtttgatttccttcaaatccagcgtattgaccaaagtccggaatattgtcgtcttccacttcatcttcttccatttcaaccccttgctctccgtgggatgtccagcagttatagcttggcatgaaccccgactcaaacaagtggaaatgaatagtcctggatgcagaatactccttctgattcttacacttattgcatggacaacaaataaaacccttatgcctgttagcttcggccattctcaaaaaataacgcacgccgtcaataacctctttggaccaccggtcagcgtacatccattgccgatccatctacatgagatgaacaaaaattgtacacaaataattattcttacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatataatatgacaaagaaaacattggagaatgaagttgctaaccttttaggcacctccgatttgtatataatcaccaaaataaattcactagaaattttggcatgacctcccctcttttttgaagaaattttgaagcttgctcgggcagctagaggaggaagaagacgaatatctaagggtgagactttagtcccggttagtgttatgaactggggctaaagatccccgtgatctttagtcccggttggtaacaccaaccgggactaaagatacttgttaccaaccgggactaaagatcccgggggggggggggggggcctgacaggccctgactcaaccgggactaaagatcaaatatgcccgttaccctttttaaccgggactaaagatcatctttaacgcctgttaacagtgaaatttggtaaacccggagtagtcatcggcttagagtcagcatcggcttcgaagtcctgcgattagccgatgagagttgtcaagtcgttagttgtcggattcttgctatattcggttaaggaaattgatctactaaaggaagcttatccagaaaagaccgagttcaaagagaatgcggcatggcaagttatctattaattagaaatagtttgttagtttccttttatctttaggaaagtgtgtttagtgtcctataaggactttatcttttccttttatctttaggaaagcttctttcttgtccgacaaggacttgtatcaacccatgggtataaatatgtacacccagggtctatgtaatctatctccacgatcaatacaattcggcgcatcgccaccttttaccttttctactttattttattgtccggcgggacttggcacctgacgcggggctgcatcggtgttcgatctccggctaaggggtaagtccaatgttccgccagcccaggcaattgtatcgtctacatcggcgtcgttcaaggctgcatcagtacattcgacctcttggattgctctggtttggatgatatacttgcctacctatttatcatatgtctctgttaatctagtcttagcatatcaatttagctctatcgactacttctcgttttagggtttctgccggtatcggctaaatcccgttgctagattagattagcttagacatctaccaccctgaaaactcagtcaacggcttgattgtctagatattatgtttcttttcatacttagtgctgtatcagttaagtttgatctactatgtcgtgcttagaaccataatatctagcctgcttcttgattgccaataagggtttcatcggggtttcagccggtgagttatctggatgttgcatcggctcataagaattgcatatacatataagttggatttagccgatgacaacaaaggcttcactgtttaatctaatcttgtggatgtcatgacatcggacctccagctgatgtatgctctaaccttcatatcaatgcttattctatcatatcaatgctagccgattggtttatactggactatattattgttatattttattatcagtagccgattgcctttatatagccgattgcttaaatcctatcgctatcggctggtatcggcatcggctattatcggcatcggctggaactactccatcggcttgtcagccgttcggctgttttgatctactatttgcatatcttgtcagttgcaggatcaaactgactggcacgcccgcatctcatcaatttttggacctgcacaggagctaagaagatctcccaggctggtgtgttcgattttttcgtcaacagtcctggtttttattgcaaccgggactattgtggaattcggccgaccgacgaaagatggtttctccaccagtggtgtgtctgtatattcgatataacaaccaatctcaaaaattttccccaactaaacaaggccatagttggcaagaatatgcataaccctcatccatagatggcaataagaacctcttgcacaagtcttatattatcttagaatatattgctcccgtagatattatcttacactaaattgtatccacttgccaagttgatataccgtgaatgcaatttactcctaaaataattagtgtttccttttgttaggaagcatgtgtggtgaataaatgatgaacaactcccatgttcttctgtatatgtcttgatgattcgctagctatctgccgtcgttctttacttctttaaactttgatatgacgagaaatatggaatgtcatgctaaggagggtgtccatgtgtcggccgcatggtggcactacctgcagggctgcgatggccagaggatcgccagcacggtgtatatgttgacggagtatggctatcgttactacgaaaacccctttttgcatacgggcgagaaggagcggttgccaaccgcatgggcaagaagatctgccaaaatgacgctcttcgcatgtggccggcgcaaccgcatgcgaaatgggattttcgcatgtggtcgcttataccagccgcatgcgaaaataaaatcacggaaaaaaaaaccaacaaacccgaaccctagcccgccgccggagcgccgtatccccgctgcacgccatcaccggatcgactaccccaccacccgccgtcgacgccgaccgccggccccactgttcgcgcgggtgagaagagcccttggcgccggatctgcgcgggacggcgccgccgcccgcgtcgccgcccactcgccggatctatccgccgcccccgctgtgcgcccgccgtcgtcgtagccgtagccgctccctagggcggcgccgctggatccgccgcccaccgatgccatctccgtccctgctcacggtcaccggcacccgctctcagagagggagggggagagagggagaggacagatccgtggagatagagagagagagggggagagtaaaaataaataatggcaaattttgctacatgacacttgttatatgtggttttagttctaggacactgcccaaactcacttttgggggaaaacactccataaacgtggtaatttgccagtggacaccgcgccgattaaaataatactttccggttgg

SEQ ID NO: 13224 - DNA, 5180 bp, Oryza sativa
tccgccagccgccatcctcgccatctttgccgtgaccgacgccaccccgtgcaagcgcgctctgagagaaagcattattttaatcggcgtggtgtccactggtaaattaccacgtttacggagtgttttcacccaaaagtgagtttgggcagtgtcctggggctaaaaccacacataacaagtgtcctgtagcaaaatttgccttaaataatagagggggagagagagaggagatgtgttgaaaaaaaattgaagtggtggaagggaaaagagagtggagggagatgaaaaaaattggggtggcatttttgcatgcggaccacttaaaaggtaagcatgaaaaaatctaagtagatttttgcatgcgaacctcttaaggggctgcatgtaaaaatatgagaaattcgaatcgaattttatggttctaaatcaactcatgtgaaaaagttgtcaaaaacaaagttgtagaaatcattgagatctaccatttttcttttggtcatttctctatccgagtttgattgaactatctaaaatttgaactttaaaatataataaatttaaataatttttcaggtagtaaatgatttcaaatgaaaaatacatcactaacaaggttgtataacttattaaaatatacaacttttgttttggtcatttttctatatgactttgattcaacaatttgaatttgaaattcaaattatgacacttcaaacaacattttgtaaaataaatgatttcagttgaaaaaaatcatcaacaacaaagttgtataactcgtcaagatctataacttttattttggtcatttcttcgtccgacaaattaacagtaacattgttcataaaatttacatatctctcatatggttttataaactataagagagatatgtaaattttgtgaaaatattactatcacttcatcaaatgaagaaatgaccaaaataaaagttatagatcttgatgagttatacaactttgttgttgatgacttttcgactaaagttatttactgcttcaaaatattatttgaagttttgaaattcaaatttttaatttataaaacgaagtcacaaggaaaaatggccaaaataatagcaaaagaacacaataacatgatagagtatgattttagaaacatttaggaaaaagaatcatccaatttagagttcatacgagtgagataaactagtttcaaatttttaaattttcaaattttattttcacatacggcttcttaagacgcccgtatgcaaaaatgaaggtcgatttttgcatacgccatcacttatggtctgtttgcaaaaattcatgaagtctagtatagaaaaatcgtttgtgtattagtgtattgcaaaacctgaaggtcccctctataatcttattttgtaacgaagggagtagcttgttactagctagcactagccagccgactaattaattttcacatccacgattgctgcgtctccatatatctgatgacaataataagtaataaaaagtggaatggacgatgttcctctcttctattattttgttcttgaaattcccctttttttgtaatgttcttagtaatttctattacgtggcttgttaattgtgaaagcggggactagtttcatgacctgtcaaaaagcatcccctttgccacccttgtagcagcacagtccatttcagatcttatcaagttcgccttggcctctctggtccaactgcttcttggacattctgttctttttcatgacgtctgtaaaagccatacacaataactttgtcatatactgcatgccagcaaaaaaataaattacaacgaagtatacatatagaaaaaatggctgcgatgactacacaaatatgtcaattgtgaaagcgtgaacaaaatataagtaaagctattgatatatatgttacttcccgttcatggaaaaatgctgttttggataggaggcaacaaaatcttgatttctttttaactcactaatatacacaaaaataaaatatgaatatttattattgttatatttaactgtcttttattaatataattatcaatacgaatgacaaaaacctatgaactggtgagaattaatgtgtcgagatggtacgtatgacgagtaaaaaaggaatacaatgagttgtttattttgcaataattaagatcatcgatcagataaaacaaatacactttgaaggacattaaactcacacccaagctaacaaccctcttgttttattttgtttcctttctcacaaaataacaaactctttcttgcccctcacttaagacctatattttgatatcccttatactttctttaaaaaaagggctggcacaaactgcaactcgacaggattatagcacaaattatttgtagcctttaatttgtatcattttttcacaaagtgattttgcgtacgtgcttcttctagccatatataatgccgtgccttgttaatataacctgttatccaatgtgcgcattaaagctatctatatatgaaatttgtgtttcagataactccaatatatatatgcttgatcaggcacgtctactgttgcagcttccagaggcattacttttaaaatatttgtttggaactattgtttttcttgttcaacaatttggatcaccatataagccatggaactaaagatcaacagattttgttaccatgcataactatgcgtcgcgtctgttgacaatgtgtgcattaattcaatttcttgcacggaagaatcaaaataagttgaaataattaaagagtgtggtgcatatcaatcccctttaaccaacttttatccgtgtgatgccagattaggcgtacgaataacaacaaaattttcattcaaaaccacaagctaatccctcatgaacagccaaaaaaaattgtctccatttcctgaaccactttagtctttatagctatatataaaaccacccatagatgggagagcttctatccctctcatacaaattaacaatcaagaatttctgcaaacaaaaaaaaatggcttccaacaaggtagtgatctcggcgttgctcgtcgtcgtcgtctccgtgctcgcagcaacgacgacaatggcggaccaccaccaagaacaggtggtctacactcccggccagctatgtcagccaggaatcggctacccgacgtacccgctgccgcgatgccgggcgttcgtgaagcgccagtgcgtcgcccccggcacggtggacgagcaggtccggcgaggctgctgccggcagctcgccgccatcgacagcagctggtgcaggtgcgatgcgctcaaccacatgctgaggatcatctacagggagagcggcgccgccgacgctgggcaccccatggccgaggtgttccgcggctgccggagaggggacatcgagcgcgcggcggcgagcctcccggcgttctgcaacgtggacatccccaatggcgtaggcggtgtctgctactggctaccgggaactggctactagccttctgtatgtagctagttattggctgttcatgtgtgtgatttggttactaaataatttgtgtttccttttatctggaagcatgtatgatgaataaatgatgaactcagatgttcttctgtttatatctctatgaagatttccttgctacgcttcattgttttataattttcaaggtgagaaaaaatgagtgtcaccatgacactataaaaaaatgtttgtgtagaccgccgatagctagttcgtttacatgggcattttcgaggctgactatatggcctgtaacgttgaaattcgcgagatttgtaaatatataccgacagccgtggagatcaatttcaacattgcgttctcttaagtactcgcccgtgcaaatgaatttccagattttaatttttataggtgcaaactaaacttgaaaaaaaaatttagtagacatggatgtatgataatgcgtgcatgtcattaggggtgaaaacggtacggaaacggacggaaacaacctttatcgttttcgttttcatattttttttcggaatcggaatcgaaatcggaaaccccgaaaacgaaaacggaaacgaatattatcaaaaccgaaaacggagcgaaaacgaaccggcgcggatacggtaacgaaaatttatcggaatacataaacccctcaaactgagtctcacagcaaaatatattcttctataacttcatataatttgcataacaaatattctaaaagaatacagcaaaacagaatggtataagcctataaggtatacacaattcaggtgctatactgctatcagcctatcactccaggaaatgggtttgagaacaacaacagaacatcagtccatcaacacttagttcatcaattgttgtagcagggtgcaaacaccttttcctccaattcggtcaaaacactacgaggttttgcaagacctaagtatccagaagggaaaacactcattttgagtggaaactacctttccaagaggaagaacaccttcccaaagggaaaataccttcccagaggaagaacactcattcgaatagaaaatacctcttcgggtgaagaacacctttttagggacattccataatcgctaatacaactacacatattttggacaagttacaatttcacaggtgttttccaaggatgaaagagaaggcaaaggggaattcaaattcccaggaggaagaagacggtccaggacggaaaaggcatttttcccaagagttcgaggaagagcactactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacatcaatcatcacagaacagcaatagttcatcaatcatcacagaacagcaacgcacatcagtccatcagtgtttcagta

SEQ ID NO: 13225 - DNA, 47885 bp, Oryza sativa
tcctgcagcccgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttggcaagagcaacggaaacacttgataagcagtgggcagagatggccaagacatccacagcagcaggaggtaatgaaacaactcaagaagaaagaattgctggtgcggtggtggaagaaacagggaaaacacccatgagtgatgtagagctggctgaattggtccaagcgcaaggggctgtcatggtgagtaaaggacaatatgaggaattgcaaaaagagttacaaagattgcaaaccctacacaatcagacagtaggagcaggaggatcaagtgatcagtgtgcaataccaggggctagggaaaagcaatcagatcaggcaaaaggagatgcccagggggagaacaaagaaggagaaagtaccaaagccacccaagctcaagatctaccacgaacccaagctcccagtcaagtacaaaacccatctcaggctcaaattcccattcttacccagaatacacctcaagctcaaattaccattcctactcagaacctagctcgaaccttgatccctagccaaaaccaaattcccattcaaacgcacatttctttccagccgcatattccaattcaaactcaaattcctaaccaagtacaatatcctcaaacacaattacatcaaacccacccagttcttcccaatcaaatccaaatcccccaacctcatatcctacaaagtaatatcccacgaacacaactcccacaaaatgatataccacaaatacaagttccacaaacccaaataccacagattcaaacatctttgcccaacttcacacatacgcaatcaacaaacactcaagcagctcaaaaccatcaccaagtcccccaaggtttttcccctttccatatgcaacaaccagagatgatgcttgaacaagggtacatcccacaaatggccaaccatatacaatatgcaggtcaaataccgaaccaggcctttcaattccagcccacacaaccctattttcaaccgaccagagcaatagatacaaagaatcccttaagtcaaaacctgcaaatggcaccttggccaataaacttcaagttgtccaacatcacaaagtacaaaggagacacagatcccaatgaatacctcagagtatatgagacagcagttgaagcagcaggtggagatgataccacgaaagctaagatactcccaacaatgctagaaggagtacattatcatggtacactaccattccaccaatgacaatctattcatgggaacatatgagagacacctttcgagcaggattcattggggcgtatgaagaaccaaaagaggcagatgacttgtatgccatgaagcagcttccaggggaaacattgagaagtttcatcgtgaagttttcaagggtaagatgtcagatcaggcatgtagatgacgaaatgctcatagcggcagcaaaaagggcattgctacccggtcctcttcgtttcgatcttgctagaaatagaccaaagacagcaaaagacttgtttgaaagaatggaaagttttgcaagaggagaagaagatgagttgagagtgcaagaggaagaagccgtctataccggaaagccctggaaaaggttcaagtatgactataaacaagatcagaagaaacaggtaaattttatcggagatggatccaacaatgaaagagaaaaaggaaaacatcaatgggacaacactcgcagagggagaaacaattgggggcaatctggaaaaggtcgaggacaatggtggaattcaggcagaggtagaggacgatggtggaacaatgaaagaggaaaaggaagagaaaataaacctgaccaaaccaaattttgtcaaacacatggaccaggaggtcattccacagaagaatgttacagtaagttttgtcatatacatggtccaggaggtcattccacagaagaatgcaggcaaatgactcacttgttggaaaaacacgtaaatcgatatgagaacaagtatgaaggagctcgtgatcaacgaggacaaaacgccatagaagcaccgcaagttatgaagatagaggcaattgaagaagtgccaaagagagtgataaatgccataactgggggctcttcgttaggaattgagtcaaaaaggcaaagaaaagcatatgtcagacaggtaaatcatgtcgggacaagctatcagtcaaatccaccagtatactcaaaaacggtaatttcctttgggcctgaagatgcagaaggaatacttttccctcatcaagatcctttagtggtctcagtggaaatagcacaatgcgaagtgcaaagagtgttaatcgatggaggaagttcagcggatgtgttgttttatgatgctttcaagaaaatgcaaataccagaagataggttaacaaatgcatgagtacctttacaaggttttggtggacaacaagtacatgcaattggaaaaatatctttacaagtggtctttggaaaaggcactaatgtgagaaaagaagagatagtatttgatgtggtcgatatgccatatcagtacaatgcaattcttggaaggtcaacaatcaatatttttgaggccataatacaccacaactacatatgtatgaagctcccaggaccaaggggagtaataacggtccgaggagaacagcttgcaggaagaaagtatgagctttaaggaacaccaagtgtgaaaggagtacatgtggttgaccaaaaacagggagaatacataaaaatacaaaagccaattcctgaagggaaaacaaagaaagtacagttggatgaacatgaccctggaattcattctgataggagaaaacttggaaaaacatgttgaggaagaaatcttaaaggtagtaaaagaaaacatggctgtatttgcatggtcaccagatgagttgcagggagttgatagaagtctaattgagcacaacctagcgattaagtcaggatacaagcccaaaaaacaaaaattgagaagaatgtctatagacagacaacaagctgcaaaaattgaacttgaaaagttgttgaaggcgaaagtcataagagaagtgatgcacccagaatggctggcaaatccagtgttagtaaagaaggcaaatggcaagtggagaatgtgcattgactttacagacctcaacaaggcatgcccaaaagatgattttcctttgccacggatagatcagttggtagatgccacagctggatgcgaactaatgagtttcttagacgcatactctggctatcaccaagtttttatggtgaaggaggatgaggaaaagacatcatttataacaccatttggaacttattgttttatcagaatgccatttggtttgaagaatgcaggagcgacttttgccaggctgataggaaaagtcttggctaagcagttaggacggaatgtcgaggcatacgtagatgacattgtggtaaagagtaaacaagcatttacccatggcaaagatttgcaagaaacatttgaaaacctgagaaaatgctcagttaagcttaatccagaaaagtgtgtttttggcgttagagcaggaaagttacttggtttcttggtgtccaaaagaggaatagaggcaaatcctgacaaaatcgcagcaatccatcaaatggagccgccaaaaaacacaagagaagtgcagagattgacaggccgaatggcatctttgagtagatttttatctaaatcagcagaaaagggattacccttcttcaagactttgaggggggcaaacaccttcgagtggactgctgaatgccaacaagctttcgaggacttgaagaaatacttgcatgaaatgccaacattagcaagtccgccaaaaggtcaacctctgttaatgtatgtggcagcaactccagcgacagttagcgcagttttggtacaagaagaagaaaataggcaagtgccggtatactttgtctcagaagcattacaaggaccaacaacacgatactcagaagtagaaaagttgatttatgcaattgtgatggcttcaagaaagttgaggcattattttctgtcgcatgacataacaataccatcggcatacccgataggagaagtgttaacaaacaaggaagtcgcggggagaatagcaaaatgggcaatggaactcttaccttttgacctgaaatacatatcaagaacagccataaagtcacaagtactagcagattttgtggcagaatggactcccaatgaggtagaacaacaggaagaagtcgaaaaaccatggatagtattctctgatggagcatgcaatgccgccggagcaggagccgctgcagttgtgaaaacaccaatgaagcaaacgttgaagtattctgttcaattagcttttccttcaacaaacaacacagcagagtatgaaggcgttttattggctatgagaaaggcaagagcgctaggggctcggcggttaatagtcaaaactgactcaaagttggtagcaggtcacttttccaaatcctttgaagcaaaggaggaaactatggctaaatatctggaagaagcaaggctgaatgagaaacatttcttgggaataacggtaaaagccataacaagggaagaaaatggagaagctgatgagctagctaaggcagccgcaacaggtcaaccattggaaaattcatttttcgatataatcacccagccaagttacgaaaagaaagaagtagcatgcatacagagagaaggagattggagagaaccgatcttgaaataccttgccagtgcacaacttccagaaaaggaagaagaagcaaagagaatacaactaacatccaaaaaatacaaggtggtagagggacagttgtataaaagtggagttactgctcctttgttaaagtgtgtaacaagggaagaaggcatgaagatggtggtagaaatacatgaaggcttgtgtggagctcatcaagcaccacggtcagtggcttcaaaagtcataagacaaggaatctattggccaacaattatgaaagatacagagaaatacatcaagacgtgcaaagcatgtcagaagttcggcccaatgacaaaagcaccacccaaagaactgcaaccaattccgccagtctggcctttttacagatggggaatagatatagtaggtcctcttccaagagcgaagggagatttgcgctttatcattgttgcaattgaatacttttcaagatggattgaggcagaagcagtggcaagaataacttctgcagcactacaaaagtttgtttggaagaacataatatgtcgatttggaatcccaagggaaatagtatgtgacaatggaaagcaattcgaatctggaaaatttcaagacatgtgtaaaggccttaatttgcaaatcaactttgcctctgtaggccatcctcagacaaatggagctgtggaaagggcaaatggtaaaatcatggaagctatcaagaagaggttagaaggatcagcaaaaggaaaatggccggaggatttgctatcagtgctttgggcactaagaactacggtagtaaggtcgactggcatgacccctttcagattggtttatggcgatgaagcaatgactccaagcgaagtaggggcacattctccaagaatgatatttgaccaaaaagatgaagaaggaagagacataactcttgaaatgctagatgaaataagggttgaagctttggagaagatggcatcatacacagaaggaacaaagagctattacaaccaaaaagtaaagacaaggccgattgaagaaggagatttagtcttgaagaaagtgctcaatgaggtagctgttggaaaactcgagtcaaagtgggaaggaccattcatagtcaaaaagaagacagaaacgggagcattcaagttagcatatcttgatggtgatgagttaaagcatacttggaatgctatttctttaaagaaattttatgcctaaaaaaaaaggagagagagagagaaagagaaaaaggagaacacgggagctcgagtttgtagtatactcactcagatgtaaatacgaatgatatccaagttaatgtatataaacaggacgtagggtttttatccataatggaggcccgaacctgtataaaaaacatgcctctgtgtatgattgcaatagaactccgcacgctcggagtcaaatacattcgactaacaaagtcgacaaaatagaactccgcacgctcggagtcaaatactctcgactaacaaagtcgacaaaatagaactccgcacgctcggagtcaaatactctcgactaacaaagtcgacaatagaactccgcacgctcggagtcaaatacattcgactaacaaagtcgacaaaatagaactcctcacgctcggagtcaaatactctcgactaacaaagtcgacaaaatagaactccgcacgctcggagtcaaatactctcgactaacaaagtcgacaaaatagaactccgcacgctcggagtcaaatactctcgactaacaaagtctaatagaactccgcacgctcggagtcaaatacattcgactaacaaagtcgacaaaatagaactccgcacgctcggagtcaaatactctcgactagcaaagtcgacaaaatataactcctcacgctaggagtcgaatactttcgactagcaaatttcgacctcgtcactccttcgaaaggtgaggaggacggcggttttcgaactattttgccttagtcctaaaaaccagctcaggaatgctcgaactctattctcgttcgagctcaaaaagcggaaaatccgcgtgacgagataaaatacgtttcgacctcgtcactccttcgaaaggtgaggaggacggcggttttcgaactattttgccttagtcctaaaaaccagctcaggaatgctcgaactctattctcgttcgagctcaaaaagcagaaaatccgcgtgacgaggtaaaatacgtttcgacctcgtcactccttcgaaaggtgaggaggacggcggttttcgaactattttgccttagtcctaaaaaccagctcaggaatgctcgaactctattctcgttcgagctcaaaaagcggaaaatccgcgtgacgagataaaatacgtttcgacctcgtcactccttcgaaaggtgaggaggacggcggttttcgaactattttgccttagtccaaaaaaccaactaaagaatgctcgaactctattttcccctcgctcgagctcaaaaggcggaaaatgcacgtgacgagataaagtacgtttcgatttcgtaacttcttccaaagataaggaggacgtagtttacctaagggtgcttgaacaattgaaataaagagcatttataaagaaaagaagaaaggaagggtttatttgatgttaagaaggtataacaagttacatacaaactctacaaagaagaaagaaaagagtcgggataaacaatgttgagaggagaaggcattactgtatatggaactattgaataacgccttttccatattctacgttggcgttcggatggttggaagttttgccaaaaggctttactagcaagagtattgttcgaacgccgttccctaaactcaagtacaaagtcacgtaaactgtcatgtcgatggcttcgttgccatcggaaaaacttaaaagcaaatatacaagtattatcataacaggcttcgagttcgtcatcggagacggcggtcctggtagaagaaagctttgcagggtctcgaaatgctaagtgcttcacatttcgagtaggcaaagtgttgttgcgtcgaatcacaagttttcgattcgagttaacatgcagcccccccaaagaaagggaatttccgtgaaaagcatgcaataagagatgaatttttacaataaaggctctcaaccataacggttttgaagcagcaaaatagcattgttttcgaacatacgaagcatccttaactattcttttcacgaacgtcacacctgtgcgctcgagctcggagtactactgtctttatcttgttggctcgaactggccggttgtgactttgatctcgaggcaagagatgctcggagagacctcagggtatcttcatatcctttcttcttccagtaaagcacttggaaagcctttacgacgggttgagctgcatctcgaagctgtgcaaatttggcctcatcattaagtataccttgtatatcagttttaagggtggtaaagtgttcacacccatttgaaagcagacaggccgaaaggctctccacagcagtcttcgagcagcgagatgcaaagggagtaacgctatcttttagcccaatggaaaattcctcgaaccattttcccacagctgctaaggtattttcttccgatagcaagctgatgtcagcccctagacttcgcaacgtgattcgaacggtctcgcaacttttcagaagaagttggcggcaactttcgctctcgagctctaaagcagatatcttctcgctttgatttttgcaggcgagttcgagttctttattcttcttctccaagacctcaacttgctccttcatcttgtcttctgattcagcgcgttgtcgtgcgacgtcttgatactcgatgatttttcgctcgaatgcttttacatgagcgagtaatttcttcttttcctcagtaagcaacttcttttcttcggaaagctctttcttttcgccgcttaacttgcgcacgagatcggtggtgattttcttctcgtcggccattcgatcaagtttgcagcgaagataatcccgatccttttcgagtttagcgatgcgatcaagtgatttcttccgttgcgtgcaaagagctcgaagagctttccgagcaacaccacgttgaagacgagcaaggctcgcagtctgcgcatcagaaaataggttttaagttaaaaagaaaataataataaataaataaataaataaataaatagataaataaaaatacctgtgcagcagatacatcaagtgctgtccaagaggacataagatcattttcttccaaaaactccttttcaagatcaggagtaatcagaactttctcgagttcatcaccaatcgaactcagggggtggcgatactttaggtcattcaaacacaggtttgggccatgatggctactttccccgagttcgttgaaattaggaagacccataagccaatgtccatcttttgcgcatcgttcgctaaaaccaccaagaacgttttgtatcagctctggggaaggggttgcgatgaacggcggtgacggaggtggagttgggttcgaactacctgtagttcgaacacctccatcagcagcactcttccctgcttcggacttttcggctgcactgacgggcgtttttgccttttttgcaaccaagtctcgatcagctcgaagagggtttgttgtctcaacagtatcacccacttgggtcgagcaatctttctcgacaaccgtggtggttggggcaacaacatacagtgaagctacttcttttgccgaaagggcaaaactagcatcagctcgaattggggtgacatggatagcagaaagatcaatacggatatcatcttcatccaactcttcatcactgtcaataacaagttgcactcgtttagaactcggttcaggaggaggactgctggcagttttcttccttttcaaatcagctaaaacagtaggaggaggaactgttttgctatcaccagattcagacaagtcgctcgagttgtcgctcgaactgctactcgagtcgctatcatcacccgagtcgttctcttcttcatcagctccttcctcgccttcttcttcttcagcattttcttccccaatttcttcgtcaatatcttccacttcaacatcatcatcatcatcagaggaagagggcttcacagatttctttttctttagtttggggacaatttcaggatgaacgcggacagggatatcggagcctagagaggcgaagacccgattttgccttttctcattttgaagtgtcaaaaatttcaaatgctcatccttggtataagggccaagaaattttcgaactgggcggaccatatcctctggaatcacaactacaaggaagaagataacaaagggagaaaataaatcttcttaactaaatcactttttcaagacaaacaaggtttgcagttcgaaaaggaaacttacgatcagacgaaaccacaaatggaggaagactggaagggcaattttcggggatttctccgagagtgatatcccagccgctcgaaagaggtctaattttgagaagaacaaactcttccaccaggtctcggcagctaaatttcgaaacaagttcttcgattcgaggttgtatggcagtgaactccggcgacaaagagactgatggctcggagacagttttcggtttcttcccagagaacgaaaaaggacaatccttatcattcagcaggctgagagggatttgatgataaaaccacttcgattgccacttgttcccccattttgctcgaatagcagacacagctggccatggacttccgcgcttgggatgaggagcaaagtttacacacccaaacttcgagttctgtttggtgtagtgccgagtacaatggaagtatgcaaagtcttcagctcgaggggtcccaccgcagcttcgaatcatccattcgaaaagcccaattcgaactaaagcatttggagtcaattgaggaaactcaagtctgaacaatttcaggacctcaaccaaaaaagtgctgcatgggaatttaaacccggcgtagaagaaatcctcaaacacaagagtgtatcccagcttgggagaaggccttgattctcccactggtcgaattacaacgtttcgaccagatatccaaccaacatcaacaagatcgtttaagtttttttccttaatcgaagaggcaccaataccacaagaagtatcttcgtggctttttgatttcttggacttcgacttttccgcagttttcttgtttttccccatgttgtgtagtgagaaaggaagaaatcaagcaaagcaccaaaactcgaatggaagaaggaagaaagagatttagttcgagtattttgtgatttcgagttgatggcagagcaaacgagtggtggcgtgggtcacgtgatagcgacccctcctggccttatatagcgcagggtggtaagggtcgcgggtttacgagcggacacgaaacccgaagcgacgcgaccccttgagcgcaccaatgaaataccggcacgtggcattcaaaaaaaaacacaataaataaataaataaaaatgaaaaataataagaataaaaataaatgaatagtaaacgtggcgtatatgcatatttgaatagtgtgtttcgaccgaataggaggacggcggttttccccctttttccataaactcaggcacggtttcggccgaaaacacacatcgcccttacccgtgaggggcttgttgtagcagggtgcaaacaccttttcctccaattcggtcaaaacactacgaggttttgcaagacctaagtatccagaagggaaaacactcattttgagtggaaactacctttccaagaggaagaacaccttcccaaagggaaaataccttcccagaggaagaacactcattcgaatagaaaatacctcttcgggtgaagaacacctttttagggacattccataatcgctaatacaactacacatattttggacaagttacaatttcacaggtgttttccaaggatgaaagagaaggcaaaggggaattcgaattcccgggaggaagaagacggtccaggacggaaaaggcatttttcccaagagttcgaggaagagcactactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaaaacatcttgaatacaaaagtaatcctcaaaagttgtgtttgctgttcgagctcgtttctaaggataggcgggaaaacacttctttccggcctatccccgatcttgttcgtgacctaaggtcacaacatcaatcatcacagaacagcaatagttcatcaatcatcacagaacagcaacgcacatcagtccatcagtgtttcagtacttagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgacggtgaaacggcgagacgcggtgggacggcgccttgagatggcggggaccgagcaggccggcggaggtgcgagatggtggcggcggccggcggcgaaacgacgaagagcaagggcggcgcgagatggtgggagcgaggacggcgggggccagccggccaggcgaccagcagtgggcggtggggcgccggcgccacgggcggtgggcgtgagggcacgccggcgccgcgatgccgcgatctggatgccgcagccgccgctccgcctccaactcgcgagtcgcgtctgagttctgagtctgacggtctctctcctatagggttagccggttagggtagatgccgccgcgatttgggttgggctgggaagctagggatgaattatggactattgaatctatggtatttttaacttcggaaattccgacaatttttccggaatgtttccgatcgtttccgggttccgacggaaactgctattatcatattcgattccgtttccgagaaaatatttccgttttcgattccgattccgagaaattccgaaaaaattccgaccggccgattccgtttccgaaaacatgaccggaatccggaaaaattccgtactgttttcacccctacatgtcatacacaacaaaagggttctcatatactcctttgttgagatagagtacagatagagtatatcgctgactgcacaaataagatcacttgttaagccattaaagtgttgcttccgttcacaaatagatgctgttttggatgtataggaggcaatgaaatcttgattatttttttaatcacttatagatgcaaaaatataatatgatttaatattcaaagatggcactcattgatttatcataaaaaaaagactataactgtagttatattgaactgtttattatgaatatatgattatcaataggaatgataaaaattaatgaattggcgagagagactatgtcgtgattgtacaaataaaaaggaacacaaggagtatagtatattttgcaaaaactaaggtcattcatatggtcaaaccaacaattccaaataaatatagattttgaaggacattaaactcacaccccatgctaacaaccctctagcttgtttctttttcctttgtcacgaaataaaaaacctcttccttccacctcacataatacctatattttaacctcacgtattttttactttattacaagtcgacaaagttatagcacaaaatattcctaacatttaatttgtatcattaatttttaaacaaagtgattatgcgtgcgtacttctcctggccatatataatgccgtgccttgttaatataaccctgttatccaacgtgcgcgtaaagctatctatatatatgatatttgtgtttcagaaaactccaatacttatatgcttcatcaggcacgttaatttcttaattttctgaaatctagtgatgcagctttcgttactgcagcttccagagcattctttttaaagtatttgttcagaactattctttttattgttccacaatttggatcactatacaagccatggaaataaagatgaactgattttgttaccttgcatgcaaaactatatatgtctgttgacattatgtgcatttctttaattttcttccacggaaggttcaaattaataaagagtgtggtgcatatcaatccacttttaccaactttagtccatatgatgcccacattaggcgtggatcacaattaatattttatatgtatacaaaaccacaagttaatctattagctcatgaacagctaaaacttttatgtcccttcttaaatcactttagtctttatagctatatataaaaccaccaatagatgaagaccttaaacctatccctctcatacaaattcagactaaagattttctgcaaacaaaaagccatggcttccaacaaggtagtgttctcggcgttgctcctcatcatcgtctccgtgctcgccgcgacggcgaccatggcggaccaccacaaagaccaggtggtgtacagcctcggcgagcgttgtcagccaggaatgggctacccgatgtactcgctgccacgctgccgggcggtggtgaagcgccagtgcgtgggccacggcgcacccggcggcgccgtggacgagcaactccggcaggactgctgccggcagctcgccgcggtcgacgacagctggtgcaggtgctcggcgctcaaccacatggttggaggcatctacagggagctcggcgccaccgatgttgggcaccccatggccgaggtgttccccggctgccggagaggggacttggagcgcgcggcggcgagcctcccggcgttctgcaacgtggacatccccaatgggacaggtggtgtctgctactggctaggttatcctaggaccccgagaactggtcactaggctactaaagctagctgtgtgtatgactctgtggggttgctaaataactagtgctttcatttgtcaggaagcatatatacatatggtgaataaatgatgaacttcaatgttcttctgaatacatcttgccaattgggtagcaatatttcgttgttatttaatttcattttgtgaaaaaaaagaatttcatggtgctcatgtcgaccgaatagcaccgctgctgggctgcgtcggccagaggatggcaggcatggcatccatgctgacggagtgcggattttgcaaactaagggtgtgtttgagaaggaggggattgaggagattgggaagatacgcaaaacgaggtgagccattagcacataattaataaagtattaactattttaaacttcaaaaatggattaatataattttttaaagcaactttcctatagaaattttttgaaaaaaacataccgtttagtagttcgggaagcgtgcgcgcgaaaaacgaaacaatatttctctctttctcctgcgctcgaacgcagcctaaaagtgccctctttaataatctgcactattttaatttggtggtgagatcgccaacaattaattgtagcatctataattttctcctcttatgtatgtgatagtactaataagaaataaaaaagtggaatggatgttcctctcttctttagttttgttcttggaagtttttttttatgtaatgcttttagaaattcttattacgatatattttcctaaagtatgtggaagaaattatgcatgacctcggtttttcaccaatcccaaaatacttcacggtttttcagattgtaaccaaaataaaccttaacaaatttgacggccgtccccatggttggatgagttgacgttggcaccgtcactacgcatctggccaaacattgggacttcagcttagatggaaggagagttaggtagtgggagagagtaggaaaagttggggtagctcgctgcccctgcacatggattgcactctggacggagattgggcctccggccaaggagaaggaagggaggtggggagttgagacaagagagaaggtgagaatttggggacatgagctgaggtaggaggtgatgactgctccaagcacatgaaaaactttaagtacgtgggcacttttctatagctgattttgaaatcatctctaaacttaggagttctatagcctagagacacattttagaagcactttaataattgcttggaactttttttattttagagacaaatttactttgtttgagaatcaatctttttggcactttaaaatttaccactctcttatacacataaaaatgcttctagaaaaatcacattgtgaatggagacattctataaaatgtttccccatttatagagattattcaaaaggcacttgtgcgatatttttgcaatgcctctatagtattaaagatgtctatgtaagctattgctttcgtgaagattcgtgccgacagtaaatagaagtatttctagaagagcgaataaccaaggttgttgcgaacgcaatcgcgagaggtgacccgatcttcacggtagtaggtttgaagcaaaagagcaccggcataaattgtacacaagagggtaactagctactcgtagctagaggataactagctttatacctgccaaggttggatgcgaccaagtggtgagtgtgagaatgatccgaagtttcctggactctgacccgtcaaaacgagcaattacagaaccacaatccagaactaatccacacaagaggcccgagggccaaaatcacgaactaggggacacaagaggatccttctcacaagcccaaaagaactcacgagaacaaaaagggtaagacttatgcagacttcaataatctctcatacatgaggttttcaattgaacaaaagttgtctaatggatgaattagaagtgtatttatactaggaacattcctcctagcgtaggtgtgaacataagaagccacgttctggtgatcaaggctaacataaatgagaatgcaaaaagttttctcgggttcacgcacagcccttcagctcctgcgcagtcctcagtaaaaatgctctaactttttattggaaagtgatattgagatggggtttgaagcattggaagctagacatgcccctctttccaaccatgtatgccatgcaacccgtaacttgactggctgggtcgtacaagccttggatgttgagcctttgtagcgtaaaccaactttttgttggcgtagacagctgctggtagtgcatgggctaattcctgctcggtgtaactcttgtcatcctcaacataacccatccttcttggcgtagtaatgatgtcttccgatgtaaaccttagcaagacaaaggtagaatatttaggtagtataaaattctcattaaaatttgggttaagttgagcaaagagtgagttcacctctagttgtattttcttagcatggctgtgcataattggaccatgatatgtttgatcgttcttactaagacgtaagccatcaacttggtttacgtcatcttcaaatttctccatgtgatgtataacgtaaccatcagccttgttcacgtcaagtgtagctgggatgtcctcatcaaagatcccgcataattttttccctcagagtctttcccaatgagtattgtttactttgaaataactaacatcatcgatatgataaaccgacattaagaataaatacatttatggaaaaacattaagctcaatccccaagctaacaatactcttttttccttttgcaaattagcaaacattctttgaagacaaaggaaactttgttgatcttacaaattacatcaaggtgttattacttcaagaccacttccgatatgacataacaacaaaatcatgccacgggtagctataaacataatttgctttgaactatccttttcgtcattaaacaaattggataaatataaatatcaaaagattttgttacccatagtactatatgtctgttgacggtgtgtgcatttcttttcttacacggaagaatgaaaatgagttcaaataattaaagagtgtggtccatatcaatccactttaaaccaactttttgtcaaaatatataatgctcagattagccgtgaataacaaaaaatatttcatgcaaaaccacaagcaaattgctcatgccagtcatgcaaaaccccaagagcatactaaccacgcatgaacagctaaaacaattttgtggccgttcttcaaagttgaatcactttaattagtctttctatagccacatatagcatttattttcttccacgtaaggatcaaacaaattcaaataattaaagagtgtagtacatatcaatccactttaaccatctgttgtccatatgatgccccagattaggcgtgtgaatcacaatagatgtttcatacagaaccacaagcaaatccataaatagctcatgaacagccaaaaaatttctatctgttcttgaatcactttggtctttatagctatatataaaaccacccagagacgaagagcctagctatcacagttaattaagatttttcacaaactaagcaaaatatggcttccaacaaggtagtgttctcggtattgctcctcgtcgttctctccgtgctcgcggcggcgatggcgaccatggcggaccaccaccaagtctacagccccggtgagcaatgtcggccaggaataagctatccgacatactcactcccgcaatgtcgaacattggtgaggcgccaatgcgttggccgtggcgcggccagcgccgcggacgagcaagtctggcaagactgctgccggcagctcgccgccgtcgacgacggctggtgcaggtgcggggcgctcgatcacatgctgtcaggcatctacagggagctcggcgccaccgaggccgggcaccccatggccgaggtgttccccggctgccggagaggggacttggagcgcgcggcggcgagcctcccggcgttctgcaacgtggacatccccaatgggcctggtggtgtctgctactggcttgggtatcctaggaccccaagaaccggtcactaggctactatagttagctgtgtgtgtgtgactatgtggggttgctaaataattagtgctttcttttgtcaggaagcatctatttatatatatgtggtgaataaatgatgaacttcaatgttcttctgaatatatcttgctggtttgctagctagccttcgttgttctttaatttcatgatggaaaaagggaatttcttgttgaggagagcgcccatgtcggccgaatcgcagcctaaaggtgccctctataataagctgccgtatttttttgtgatctgacaattaatagtaacatctataatatttgaatgttgcatttcttattcactccctccattctttggtaccacactataagtattcatgcactgattactttgattcccatcatttcagtgattgcataggtaatcagattcttgtaaatgatatctaaataattcaaaattcaaaaattgacaactgaagtgactaaaaatgaatcttttgatataagtattcgacaaacacctgataaacaacatagacacatccttatattcaaaacgaaggttgtacataaaagtccctagatgtggtggtagtgaatctgccacccccactgttttccaaataggctcctgtttttttatattatggaatagtccaaatatatggttcaaacaagtaaatactgtatattcaaacaagtaagcaagtggcattaatatattcgataatttttaatatctattacatattataatatattttcttttatccatagcaaagcacggccattttactagtaagaaataagagtactccctttgtttctgattataagtcgttttagttttggtcaaaatcaaactagtttaaatttgactaagtttgtatacaaatatagtaatatttacaacagtaatttagtttcaattaatatatatatatatatatatatatatattaaatatatttccataatatatttgtcttgtgatgaaagtgtaactactttttttctataaacttgtcaaacttgaagcaatttaactttgacccaagtcaaaacgacttataatctgaattgaaaggagtagaaacgatgttcctctcttcttttagttttgttattattcctacgcttgttttcatcaaatgtgtcacccgataagcaactgacaaacagtaggattggtttcatgacgtgtcaaaaaacatatggtagtcacaggtctatacaatctatgcgatataatataatctatgcgaataattgcattcatagatttacaataaatatacttgtgttgttttatttaaatatgtcggatgaatatacgatcataaacatgaacggcaacaatacctatatggattggagactttgtctgacaagttaaaagaatcacaaatagtttatagtttttttcgcgatagttaagatcgtaaatggataaatatggtaaatccaccatttcaaagtaaatgcatttgtgaaacacaataaattaactcgctctcccaagctaacaaacccggcctcgtttttccttcaggaatgaacaaacctaccccgctaagagatttttttaatctcctttactctttacttataaaataagggaagggttggtgcaacactactagaaatctcattttgggcgtcgtaaaggatcaatcttcgcaggcgacgcttatatggcccgcctgcaaagatgcccctatatagtcttcttcctccccgagccctgttcattctccccgacgtttctctctcctaaagtgacttaaatataggggggaggttttgaacttcaaatcttcgggggatttttctacggtacttagatctactcatttccacactaggtatgcattttttttaagcttttagaccttaatttgtgatggatttatgcatccaaaattttgaaggaagagctccatgttttttaattttatttcttgtcatttgtttatgttagatgtatgtgtaatacttgatgcctcttgttgtagtggtttaatgtggtaacataaattcttgttttttaattttttgctatcatatccaccacctagttctagatctagatctagctcttgtcatgtatagagagagaaaaaaattttaaatgtctatttattcagtgcaatcaaaaaatagttatagtattttgtaatatgccgatgaattgattttgttagattttcctaatgtgctaatttggcatgtctgtgtaaaaaaaattgaaataaactatgattttttattactttacaacttaacctttagttaattagttttgaatagctataagttttttcaataaaccctacaaatttggtattaattgtgcaaatattttacgtgtattttttagagatatagaaagtcgggaatggatgtatcattggccgaggtttttgtctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttggtaactcacggatttatggacaagtacgaaatatggacacgtcatggcgaagaacaagtggacgagcctgaaaatgtagttccgacacaagttgaagacatggtgcatgacgatggttctgttgaggacaaaatcgacctagagaaaatgttacgtaatgcagaacccgaggtgctgatggggtcggccagagggctaaataactttgaagctttacagaaggcagcaaaggaagttttgtacgatgagtcgaagggctgtgacagtgatttcacaacactccggtcagttcttgaacttatgaggttaaaggcgagacatggatggtctgataccagtttcgacagtcttttagaactcctgcagaaaatgctaccgaggcctaactcactaccatccagcacatatcaagcaaagaaactcatatgccccctttcacttggtgtggaaaagattcatgcgtgcgtaaatcactgcatactgtataggaaagagtacgcttctttggatgaatgtccaacatgcggtgcaagctggtacaagtcgaatagcaatactagcctagaaccctctgaagcaactgagggacgacagagaaaaatcccgcagcttgtgatgtggtaccttcctgtgaaagaccgcattacacgaatatactcaaacccgcgagatgcggaactaatgcactggcatgaagaagggcgcaagaaggatgggatgattcgacacccggcagatgctcgtcaatggagaacctttgatgcgcagtatagagagtttgctaaagacccacggaacattagatttgccctgagtactgatggagttaatccttttggagacatgagcagttcacatagtacttggccagtgcttctcaccatgtataatcttcctacctggctttgtcaaaagcgaaaatacgtactactctgtatcctcatacagggaccccgttagcctggtattgatatagacgtatttcttggaccattgttggaagatatggccgatttatggaaagagggattgaaagtgtgggacgagtacttaagggaatacttcacagtgaaggcaatcatcttcgtgaccattaacgattatccagcaatgtttttagtttcaggtcaaattaaaggtaaaacaggatgtgtgatctgcttgaatggaacgtcctataggtatctcccgggttccaacaagcttgtgtacatgcggcaccggcggttcctacgcacaaatcacaagtaccgtaagatgaaggcggagttcgatggtactgaagagactgatcctgcaccaaaacctacatcgggagaaaatgtgtgtgcaatgatagagaaaattgtttgcgagtttggaaaaatgactaagaaaccatcaaaggggacaaagcgcaagaaacccgagaagaatacgaagggaggggatagtaagaagcaagatgacagttcgaagccagatgataaactccctcccccattcaagaagcattccatattttttaagtacctcccgtactggaaagatctggaggttcagcatgccatagacgtcatgcatctagagaagaatgtgtttgacaacatagttggaacattgttggacatgccgaagaagactaaagatggtctgcaatcaacgatggacctagtcgagatgggaatcagggaagagttacaccctcaagaaggagaaaagaatggcaaagtatatcttccaccagcctgtttcacactgacacctaaggagaagaagtcattttgcaactcactccgtaatgtcagactgcccataggtttctcatcaaacatcagtcgactagtttcaatgaaagatttgtcggtatctggttataattcacacgactgccatgtcttgctcaccgtgtttcttgcaattgcaataagagccataaaaccggagcatttaaaggttgctatcacaaggttgtgctactttttcaacgcagtgtcacagaaggtcattagtctcgaagagttaggaaatctccgtacattcgcacatgagacccagtgccaacttgagatgtgtttccctccgtcattttttgatatgatggagcacctcattgttcacattgtgccgcagatggttgcgcttggcccattgtacctccatcaaatgtggtcatacgagcgttacatggcggttctgaagggttacgtccgaaatcgtgcacatctagagggatcaatggttgaggattatagtactgaagaggttgtcgagtgctgtatcgattatctcaaggatggatatgcaattggagtacctgtgccccaacacgagggcagattgagtggcaggggaacgataggaaagaagagattcgtcacccatgatcacaaatcattccaagaagctcacttcagcgtgcttcatcagtttgctatcgtcgagccgtacatcgatcaacatatcgaactaatacgagctaacaataagggtcgctccaccgagtggataatgaaagaacacaagcgtctcttcatagattggttgcgagacctagacttacctgagggagaaactaccgatgaaataactatgaagcggttggcttgtggtccatcaactacagtaaattcttggcagggatatgacattaatggatattcgtttagcacaagagcccgagataataagacctgtacacaaaacagcggtgtccgtgtggaggcaattgatgaagccggtgaaaaacaatcatacttcgggtttattgaagaaatatgggaaattgactatgggcacacaatgcaattccccatatttaagtgccagtgggtaaaatacccgaacagggtaaatgttgataagttcggtcttactgttgttgaccttgcgagagtgggtcacaaggatgatccttgggtactcgccaatcgcgtggcacaagtgttttatgtgaaagacccttcaaatttgaagaaagatatagtgctaccagggaaacaaaagatattgggagtggatggggttgaagatgtcgaagattacaaccaatatgatagtatgccactttatagtcagtttgtacagaagattaagaatgtcgagacatctactcagaagaccgtgaagccttacatgcgcacggacggtgtgggcaaaaatgttaaagggtaatgattgttgagtggcatataaacatctaagaagttagtagttatgtaatggtcgtatgtgtgatcgtatcgcaaattgacgaacaattgtactcaacattttgcatattaatttctaagtactaatttttatgtgcaattaccatttgaattgtgaaaatttagttaaaaaaatttaaagttagtaatatttgaaaagtgtaaatatttttatgtgcaattactagtttgttgaaaagatcttcgcaggcggaccgcccgcttgcgaagatctttgccctatataagggcaagcccgcggcgccaaaatttctaagtccaggcgggaaccctaaaaaatttggcgccgtcaggctgccgaaatttttcaccgccgcacgcctccgccgtcctccgccgccgccccgcctgcgaccttcgctctccgaccgtcgtcctccgccgcagccgaccgtcgtcgtccaccacgctccaccgaggcagccccgtcgccggctcatccaccgccaccgccaccgtcgagctcatccaccgctgccggctcatccaccgccaccgtcgagctcgctctcctccgccatcggctcctccaccgccgccggcccctccaccgcgcgcacggccaccgccgccgttggcccctccaccaccgttgcccacccctccgctcgcggctgaacggcttcatcggccgatcgtcgtccacgagcgaatacgtcctcggccgcgaacgacgtcttcggccggtcgtcgtccacggccgaacctcgtcgtaggccgttcgtcgtccatggccgaacctcgtcgccggcccttccttcgttgtccacgaccgaagctcgtcgtcgaccgttcgtccatgatttctacggtcgaagcacatgattttgcttcgccccgaaaccaaagaaactgagccagattaccccttcgatgacctcaaggagaatacaccctgcagattggacgttcccattggacgctccggtaaaactcttgaggccgctacagccattgctatccctggtagaacatacaatgaacagttcttacccgatgcgtatgccaaggtgcagccacaagtggtccacgaagggtttgagtcctacgacattgactacccgactgcagatggtatatccgtacttggggatgcggtcgatcttgtaattctctggcataagaatgacatattctttggattgggcaccgacgccggggaaaaacctgtgttgcctaaaccgggtttgggaaaacctccgaggcctcctaagaggaaggtgactgataaggcggatgatcctgaacttggtaaggaaaatccagtgccggaagtgccaccggagattgcattgccggagacagccatggagactgcaccgccggagacagccatggagattgcaccgccggagacagccatggagattcaagtgccggatgtgcccatagagattacagtggcagaaccagaggtggaatttgtggcatcagtcgggtcagtcaaagatgaagtaccaggattggaatgggatggtacagagccagagatatttgaagacccttctcctgcgaaagaacccgaggtgccacgagtgattaggagccacgaatccaagtccaaagatgcgaacaaggagaagttcatgctaaccgtcttcagagggggtaaggaacgtgccaagctcagagatgacgacccccagaaggcttctgtgctagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttgggcaatataatagctcgatcaccggcagattgtttcggcgaagaaggttacgtatggctagatttctcagatctccacgccatatatcgtcgggataagatggacgtcaactatgtcggtgtttggtgcatgtgagtacgaattttaattaattagataaaaaatatgtacaatacaactccatgtgattgctactaacaaacttcttatgtaggatgcaatacatggatgctaagaagaaaaaagaacccatcggcttcttggatccaactcagatctgccaaacacagcataccgttacgctagatccagggtcagaccagctgaagggcaagaatccgaaagagatagcagaatacaagaagggcttgcacaaggagaaattgattactgtcgcacagtacattggacgagccttcttgcactttcaaaataagagagtcgtcatggccgcttataattttaagtaagttcggtacatttatcttgtacacatatgtcttattttagctgttactaactaattataatgttattaatatgtagcgatcattatatctgtttactcatccaccctaaagacggaaccgtggtagtcttggatcctctcgattacaaacacaagcaatacaaagaatttctaacaatcttacagtagtaagttattatgactcttgcatttgtatatggatgtattacaaataaatatcctccttactctgaaatggtatgacattcatacagtgcataccaatactacaagttcaagggtggagaacagacacgaacacgggagaagctgctagtacgtacctattggccggtaatactccactcactttatgtattccaatagtttcactaattgcaaattataactacttttttctatgatatgtccttcagtgtcacaagcaaccgcgaggaacggtcctttgcgggtattatgcgtgcgaattccttagggttaatggacggtacaggactaacgcggaggatgtaagtctctatactatttactagacagctcttgatatttatgatactaatatattgattaatttcaatgcatgcagttgccaagattagaatgtcgaacaagctttgacgatacaggtatcacaaatgtgcagcgtgatctgtgccacttcatccaccatgagtgctgtcatgtcaaaggagatttcttcgacccagagggtgccctagcggcaagtgacgaattcaaggatcttcgggagtggaacactgctatgccataatgtaactagatgacgttatttgaagtgacaatgtaaaacaatattgtaatatatatattttggcaacacttttgatttatgcaatataagtagatttctcagtaccaaatgcttgataatattccaatatatgtacctgcaagaatttctaataaataatttaaaagtaatttacggccaaattatatttaaatttcaatattttctacctatcttcgcaggcggaagttttcttttttgcaagcggacgattcctattttcgcaggcggaccggactagccaacgtccgtctgcgaaaattatcttcgcaggcggacggcctccccgcctgcgaagatcggcgatcttcatagtcgttggcttacaggcggacggccgccccgcctgcgaagacccttttcggccgcttgcgataatgcttttcctagtagtgcaaattgcaacgggaaaagttatagcagacaatatttctagcctttaatttgcaacatttttcaacaaagtgattatgcgtacgtgcttcttatgtccatataaatataattccgtgccttgttaatatatctctgttatccaactgcctaggcctctcaagattgcagtacaacaaaaaaaaaaagtaggtgaaagactgaacgtgcacatcaaagctatcttatatatgaattttgtttttcagaaaactccaatatatgcttgatcaggcacgtatatacagagaacgcacacgttatttaattttctgaatctagtgttgccgctttctttactgcatactttgtagcttgcagagcattctttttaacaatatttgttctgaagtatcatttttttgtttatcaaattggaccactatacaaaaagccatggaaataaagatcaaaatatttttgttgccttccataactatgtgtctgttagtagtttatgcatttattttcttgcacggaagaatgaaaatgggtttaaacaattaaagagtgtggtccatatgaatccactttagccaacttttttttccccagatgatgcctagattagctgtgaatcacaataaatatttcattcaaaaccacaagctaatcactcatgctaaaagttttgtgtccattcttgaatcactatcactttagtcttagtagctacatatataaaaccactcattgaggattgagaataattaaaattttctgcaacaacaatagaaagaaaatggctttcatcaaggtagtgttctcggtgttgctcccggtagttgtctccatgctcgtggcaacgacgacaatggcggatcaccgtggccaggtggtttatacccccgggcagctatgcgctgccggacggggctacccgatgtacccgctgccccgctgccgggcgctggcgaagcgccagtgcgccggcggtgccgtggacgagcaagtccggcaagactgctgccggcagctcgccgccatcgacgacagcttctgtaggtgccccgcgctgagccacatgttggttggaatgtacaaggagctcggtgcacccgctaaagggcaacccatggacgaggtgttccctggctgccggagaggcgacatgaaacgcgtggcggcgagcctcccggcgttttgcaatgtagacattcccattggcattggtggtgtttgctactggctgagttatcctatgaaccccgcgactggccactaagaaatagctaccttgtgtgtcttgtgtggtacctatataattagtgtttccttttgcttggaaacatatatatgtggtgaataaatgatgaactctgatagtcttatgatgattcgctagccggctcggatttttctttaactccatggtgcaagagggaatactgaaatttataattactaggctaaaaaataagcaaccaaccaaatatatattacagttaatttggaataagttcatctgaggtcccttaacttgtcaacgaatccgattttcgtctttcaaccggaaaaccaaatacaacatatccctcaactattaaaaccgatacaaaataagtcccaagacggtttgatggcagcttattttgcaggaggaggaggaggagataaggaagagagagagaacagatgctgtaggagagagacaattagcctcggttggtatcaccaaccgggactaaagtttgttgagggtctaacagctattcaactaggagtaaagatcaaaaagtacccctaggtttttgaaccgggactaaagaatatctttagtctcggttcctactcgaaccgggactatgtgatttttgtatgactcagcaaagatcacttctccagtagcgtacgctctaacagatcaccaaatgcaggatttttactggaaaaagaaacaactggccaccggatctgcaagttccttggtcaccgctgcgggagcgatggaagaatcgatgggaaatggcctctgcaaaaaccctaggctagcagtgaggaggaggaggaagaagtggtctcattttcactaatgcggtgattttactcaggcaggtggagcgagatagcatggcttgctcaggcaagattcatcatgctagaatcctaagggtagcaaccaaacatatgctaggcaagttacaggtttgaccttaggcctggcttgtttgctcagggtcttaccctttagtggccctaaacagtgtttatacagagtttaaaatgcctgaagaaaatttcttatacatatcaggcatattttaaagtgccgaaaaaatgcctctacgagataagaattaacaaaatatgttgaaaatatataaaaagtgtctctagagtaaaaggttttctgggcagtttttaaagtacaaagtgcctctacgttatagaactcatgattttagaggtaatttacaaactcctctagaaaagtcctatataaggtttttgttgtaaactcctctagaaaagtcccatatgaggtttttattgtagtgacatatgatttgtaacaaaactaaaacaacaaataatttaaaacggagggagtagtttattttacaatgattaagataattgatatggtaaaaccaagatttaaaaataaattaatacatttccgatagatattaaactcactccccaagctaacaacgctctttttattccttcgcaaattgacaaacctaccacacttcagacctatttcttgtgctctccttactctttacttaaaacatttctatgcaaattgcaatacgacaaggtaataacacacaatatctctagcctttaatttgtaatgttttttttttgacaaagtgattatgcgtacgtgcttccctatataattccgtggcttgttaaaataactctgttacttagatccaactgcccagtcctctcaagattagagtacacaataaaaggaaattaagtgaacgtgcgcgtcttgtgtttcagaatactccgacataatcacacgtttcttcactaaacacacgtttcttaattttctgaatctagtgttgcagctttctttactgcatgctttttagcttccagagcattcctcttaacaatatttgttctgaagtattatcttttttcttgtttaccaaattggatcaactatatatagaaaaagccatgcaaataaagatcaaaagattttgttaccttccaaaactatatatctgttggcagtttgtgcatttgttttcttgcatggaagaatgaaaatgaaaagagtgtggtccatataaaacgaagggtttttttttttcgaaatgatgcctagattagctttgaaccacaataaatattacatgcaaaaccataagctactcactcatgataaaaattgtgtccgttctggaatcactttagtatttgtagctacatataaaaccaccattgatgtagcgcttacctgtacaccctctcatacaatttgagactaactaaaattttctgcaacacaaagaaaaacaaaatggcaccaaacaaggtagtgtaatttcaggggttaacgaatatggtgtgatttccgggtttttctgaccgaaattatttgaatttttaacatattttgactgaatttaaataaattttgaccaaaaaaaccaaaaaattcagggagatttatgcttgccagtggagaatgaaatttcaaattatactatggttcttagtgttgctctcgatagttgtctccatgcttgtggcaacgacaacaatggcagaccaccactgctaggtggtgtatacccccagccagctttgccagccaagaatagactactcgatgtgtacccactcccacgctgccgaacaatggtgaagggccagtgcattggcggtggcgcagccggtaacgtggatgagcaagtctggcgagactgctgtaggcagctcgccaccatcaacaacaacttatgtaggtgtccggtgctcagccacaagttggtaggcatgtacaaggagctcggcacggcggctcacgggcaacccatggacgaggtattccctggctgccggagagacaacatgaaatgcatggtggtggcgagcctcctggcattatgcggtgtggatatccatatcggcatcggtggtgtttgctaatggctgggttatcttaggaacccggcgactggccactaggctatagctactttgtgtggtgtggtgtagttactgtaattactgtttccatttgcatggaaacgtatgtatgtggtgaataaatgatgaacttcgatgttcttatgttgattcactagcccgctcgaattgttctttaattcctttgtgcaagagggacactgaaatatataatataattactagtccctagggacaacatgcaatcagaaaaaggtaaaagaaaaaacagccaaccatatatagaggaaacttttagataatacgtaccaagtaaactttcagataatatggttcaggggccttgaaataaattgcatatttgccattgttgacccttttttcagggaccaatcaccacgatgtaccaccgagagccttaggatatgaatataatcgctaataaccgtgatctagaaaaactcctgaccaagatgataattgagatcaaaatcggctagcatattaaatttagacaaattggggtaaacacccatcaggattaacagattcgcacttttacagcaaggatggatggttaatttacaatgcaaaccaataaaaatggacgaactagagtaaaaggtagttacagtacgaaaaagacgattccaagagggctagtacgtattgatttttaggttaattggatccatgccattataaatatgttgattcagataaatgctactacaattcatctatttgtaaccatgccattgaaaatttacaaaattggtaccaccactgccatcacattttccatccatctccttccttctccatcttcttcctcatctactcatggaacccaccggtcagatcaatcttcttcctccatccacccttttcttcgtgaggcaaattgaaaccgaagtattagtccttcacgccaaagttaactatttttacaataacctttttatagaaacttttattaaaaaaacacatcatttagtggttcggtaagtgtgcgtgcagaaaacgagagaatagaggttgacaacttggacattagaagtcacataaattgctttacatggtctcaatgataagtatattttaatacaaatgaataaatgctatagtaaatagtatactgatgaaatggcggtatttttataggcggggtgagtggaaacacaaagggagaggtagtatgcgggcccagtagtaagtaaacccttccggagccatcgtttcgctgaataagcgaaacgacatatttgcaaacgaaaagtaatttgtgaattaaacttttatatacgtgttcttagcgatttaaaagcaaagattgaaaaataaacttcgatgaaaaaatcttaaaatcaaatccaaatttaagtttaaaaattcaaattttgtctgataagaataagtataagcgaaaagatgagaccctttgtccgatcgagttgagattcgtgcaggtcccttttgggcccaatctttcacggcccattaagcaagtaggcagcccggccctggaaatgcactgatgaattcgttttgtttaatttggacgctaatcccttacgcccactgacaattcccgcgcgcgccatgcacgacgccctctccacgtagcttcgcttcccggcaaattcaaaaaaacaaaaaaagcaactgttcgtcttcctccccacgcttccatttctctccctttttccaaccatctaaaatctcaccaccccccccccccccaacaacccaaaccttgcactgctcatcgatttctcttcctgacggcgacaatggcgtcgaagaacagcaagctctcggtgtcgtcggtggcggtggcgctggtggcgctgatggtggtggtggtcggcgccgtcgtcgcggcggctgcgggcggcgaggagtactacggcggcgtcgcgcgcgcggcggatgggtgcgagccggggcagggcgtggtgcccaaggacccgctgccggggtgccgggcgtacctgctgcggcggtgcggcggcggcgacccgccgggggtgcgggcgcggtgctgccaccagctgagggaggtggcggcgcgctgccgctgcgacgcgctgcgcgccatggtggaggtgctcgtcgaggaggaggaggcgccgctggcgtgcaagaagggggccatggccgccatcgccgaggggctccccgggcgcgacgagtgcgacctcgacacgcgcgccgacgacggcggatcgcgccgttgccacttggtgattaattgatatctgatgctgtttaatgataaataataatcgccattgttatattctagattatttatttatcaaacgaataaaatgattatggtcgcgtgctatgcttgttcttgcaacggtgtgtaattatcatgtgatgggcaataaagagcaggtgatgagtagtatttcatatttttaccttgtttgaacaaattgaaacaacgaaccgcgcacaattttcttttctttatttttgaaagatcagcacaattttcttttcaagtgtaaatttgatgataagtcagcacatactacgtacatacagtgatgaatcaaaagaaaatcgattcgctttggtattgtaacaaagtaataacttgttaattatacctttctagaagaaaaataaactcattggtcatgcttaaaccatgatattaccttctaggtatacatatactaatttaaatgaaacaactaggtgtgatgaatggtcaatccgcatccatcactcacaccatcaactccctgcacactgttgtgaagggaaaaaatggagtttgtgcgtgggggccaaaggacccgcctgttgtgccgagaatgtattaatgacaatgtttccttaattctgatctaacgcatggatattatacgctagtaaatataaataatatagtgactttaacccaaacacttcagatccacttcttagacttctacacatgtagctcagttacttggaagcaaggtaattaatatagtgtttgcagtggccgtaatggcgaccgctataatgttggtagtcctctactgctagcactacaaagttagcggacccaagataatactccattcgtttctaaatgtttgacaccgttgactttttagcacatgtttaaccgttcgtcttatttaaaatttttttgaaatatgtaaaactatatgtacataaaagtatatttaacaataaatcaaatgataggaaaggaattaataattaattaatttttttaataagatgaatggtcaaacatgttttaaaaaatcaatggcgtcaaatatttacaaacggaggaagtatgttggaacatactagccgctatagcactctctatacacaatctgctatcaagagattaattcacgaccaacccgctatatattatctatcgcaatgcttgaaatccggaaaataatcataggagattaggagaccctgctttgaacataacccaactttttaagcagggtcacctggtccccaaattattttcctaatgacagtgagggacctaataagatctgggccactggatcatgacttttggcctagtgacagcaggccgacccagagcctggcccaaatttggatgagtctctgacccaacaatccagagaacttttctttttttctaaaaaagatctagagaacttattagtacttatcaatattcaattaattaagaatagctactgtagcatagagaggagatgatggaatcaactcaaatcttataagccggaactggctcagggaagcaaacacaatatgtatgagaaatgaaaaaaaaagactcacatgctgtacaaaaataaataagtcaacaagatattatttttcgagtaggacttgggctagaaaaaaaaaacgatgaaaaaaaaatgcttgcaacaatttaagattgggtttgaaaagctcaacaagccaatggcttatattgtgacaactgttgatggagtcaaagatcgattatttttttagtggtagatgacataccaatcgataatgagatgtccgtgtgtgcgtttataacgtgagtgtgcatgttatgagcgtgtgtctgtactgtatttctttaaaaaaaatgattaatctgcatttactcagcagtagaaccttttctgttcaatgtactgtgctgacctggagggcaggtgtttttcgacgaattgacgatgagacaaaactgaagaatacttgtatacttgtccaaatcccctatctaatcctctaaccaaacagataaagacgattggataaaccaatttggatgaggatctcctccaaaattcctggtcagagactcctatgtggcagtctccagttggttcttgtgcaggttggtcctaggtgtttcttgaatttgctcagttgggtcagtttgacagcgacaggtgaaaggcaagagtttggggaaagcaagcaagaaacttgatggtgtattttctaaaaaaaattatttttcctgtcttatctcttcttgattccgtctaaatttaaggatctatccgtccatggtttggtagaatctgagggcggaagcaaagggggaaacagtcccactctgaagagtctgaagattccccaaggtctatttggtttccaatcttattgaagcaggagaagaattgtacgtgctggggtggtgaaacacaagatcctgattcaatcactgccatgggtgaagggttcttgcaaactggagtcgattctgttgttgcatggtgaggtgaatttgccatctcaggattatacagaggtaattgttctgtgccttgtcaatcccatcgattagaagatggaatcaattattggagaactagatagatctaacccttgttcacctccatggcatcttgtcggctcactcatgattgggggggggggggggggggcaaactgttgggggttccttgtgggcttgcaggctaggtgtttgtggaattgcctccctggaagcagctgtagggaaaggctggagaggagaggaaattgagggagaagagtgcgaggatgacgatgtcgtgggggcttgcggctcacattgtggacatggtgtggatggtgctcgccggctgggtttcaacgtgcctggtgatcgccggtgagatagcccgcggcatgcggaacggggagatcagcccctttgttgttggctgaatcctcctgggccattcttccttcattcattgatgcaggtgattgcctcaggtccttctcttggttgtttcttgttgctcaatagccatggatgttgaggaacttgcacagcacaatgctttcccttaaagaaaatagattcagtgctatctttctcaccttttatgttttgtacttttcactgctaagcaatgtgagtactcactctgtcccaatatgtagcaagatgggtctaatcccatcctaggactacgaatttggacataccctagtcttaggatgggtctaatcctatcctaggttgctacttattgggacggagggagtatttcgctgacaacatttcaaattttcgattgttcaatctaaaatttcagctatttgtagtttgcaatgagatataggtttggctattctcttttattaagaaagaggcaggttaatcatgatcgttcagacatatgcctcatggttctaaggcaatagccacttactaagctaaagtgccatttcttcatagagtagctttgactgacctgcacaatgaatgagtgggagtaactgatacaatttcgctatacacttttaaatttaaacatgttgttgagtatgttaattttttgtagtcattacaggtcccaacaaaaattctcaaaatatacaaattaccttgactacttgaaatctccaaaccatctcaatgacagcagctagaatagtacaatggtcattaacttctttgtgtatgttgaaacttgaaaccattttatttatcgaacatgtggttgattcttactaaccttccagaattaagtctctttcgcttggcacaactattcttaagctatcaaatatcactgctcatcatgcttgtttgtgaatgatgtttacatgatcagtttaaccatattccacatgcctatttactactacttatcttcacttcgtcccttattatgcttctgatcatttgatctgattagtaacaatttcattgttttttgcagatagattttgtcgaatccagtccttcaatacacattgcattatactgtacagagcccataaatctcgattagcgttccactgattgccttcaggcgtaaacagaagtggtagactctaggtcattatcttttcattcttacattttttttatgtcatgtaatcctgtaaacatttgtgcaactacatatgaacaatcatgtcatccctatgttctttttcaccctctcagcaagggtactgaactgttttgatcgatactcaaatgaagttccacagattatgctgcattatcaggctatgaacaggaaatgtaaactaattcttaaaggagagaaaaatctctctttatttttgtgaatttgtttttttttcgaaatgaaagttctagggaagaactctcgaaggtacatgttgcttggaggattatcatgaggtcatactgcaaagtgcaaatcagcagcgttttaaagttctgagtcagaatatctgatctgggctactgatgtgaaagtgaaactagaatgccagtaaacagggactccaaagtgctccaattgaggaatccttgcctgacagacagacagcatacaaatttgatcgatttgtacgatttgtacaacatacaatagttgcagataagattggaagctgtaacatttagctaccaaaaccacgttattcctaattaacgagggtgtgatttagtcatcatgataataaatacacaagaccaacgagagcactaaaatctaacatatggctttgtatcaacactccgtgtgagaagaacagttctccattccacacgatatcaagtttttggtacaacatgtttcaagtgagaagtaacagtagcaattagaagctaacatgtttcttgtgtacattttttatgctcagcaagcagaacaatcactccctttgccgacttttgtgatggtggtggtggcgatgcttagatttcttcttgtcttttttcttccttctctctttcctgtcctttttctctgaactcttttccttcttcttctcttttttcttgtggagttcagggctggaaggttctccatctagtgcttccctacgccaatagtcatcaggtgatcttgatctcaaagacactggtttctccgggccttgtactcttcgttcccatttttcttccacctgagtatcagcattaggttcgttctcttgactacgagatgcaacattaaggtatggaccaggctcatccatcctagaaccaacggcccctcgacctcgcttcaccctatagcagaccaaagttacatctctgtcagcaacattgcagatagctacttgtgtaaaatgttggtactagaacaaccaaaagatagaaaatacagacctcgaatgaagaaacttctcaatgtcatcgtcccctagaccatcctcctgatccgaatatgaactgttataagctatgccttcttcttcaacccttggactggaactctggtttctcaagtcacttttgcgtttttcacctctggcgtcaccaagacctctactccttttcatcttagactccagttcaagttccttctctctggcacgccacatttcattgacctccacaacacggttcgctgtaggtgaacagcacatatcatgccaattcagtaagtagacaaccagaacaccgctgatatctttggacaagaaaattagcaacatgagatcagctatacttatgagattgtcattacttgctatccagcgaatcattcctagacaaaggaagtaagttttacacgattggtttatattttgtgtttaaccacacctataattctcctttaagacatggaacagacatttttttgggcaaacaataaaattaatatgttctataaaaaataattcaattccagataaaagtctaccaaacgattaacaatgagtcaagaaactaagaaattattatagttgccttggatagctaatcaatcaacaggaggaggtatcaagtatggaataacgataaatcgaaactacgatgctaaccttgctgaactccacgaactgtggccgtaaggaagcgcgaattcggacggtgccttacattgggctttcgcagatatgcgtgaacaccttccctgtcagcctccgcctgcaacctcctcgcctcctcgagaagtaaagaagcaagacgattctccgtctccagatccatcgtctcaggggcggatccaacttgggacatttgggggttcagatgaacccccaatactgttactcttgtatcaaaaggttgaggctctctctgaaattaagagatgagcttcttccagatctacaagagaaagctagggttaacgaacgcacacaaagcgaattccagacaaaagtaggggtgggagagagagagagatgaatccatgaatcagaaggaggatgtggatggatgctgctcacctgcaggatcccctcccctccgctgctttgctcgagcagatggggatcggcgcctctccctccccctgttcttgtcgcaaggagcggaggagacgggggatttctcttctcctttttacgccgaaggggggagagactcgactacggattcggattcggagtcagagggagggaaatagcggggagatggagcgcacgatctgcatcggacggcaaccagcgaggttagcaaaaacgagcgggctcacctggcccacggcgacaaaatccggcccatagaagcactgtctccctcggcgcaggttcggtacttcggttggagggaggctgcccatggtaatcgtgcccgtttgcccatttacccttagataaaagccctattatcacggccgctatgtttgcataaaggagttctttgctgtattggagaggaggggggagggaggggtgaaataggagaggcgaaggaggaagacgacgactcagagagagaacgggaatggataagatcgaatcaaggggtgaaaataggacgggtaagatcgaatcaaggggtgaaaacgggacatgtatttcccgtctgtccatattaatctgtaataatttcagggtaaaataatctacccatatgtttacataggtatcggagccgaatccaggtatttctttttggcggatacaaaatcgtattgaaaaaatgatatcttgaatcatcattttatatactatttaaatttaaattatcataaatcacatcaacttactttagtttatgttgtctagctatgttacgcattattttttacttatattattataatactaaactcctacaataacacgtagggtttcacctagtttctaaaataaaagcatttctacggtgatatttttagattgcggtgcttgtaaattactatcttatttttaaaatataaaaatctaggatataacagaatgctttctcgttttacgaatctgattctaatttcgcgaggatattttaggacggatggagttcatttcctggtttttctgttgaggaaaagatcgccccttatccggaaaacccgctctcacaccgccccaacggtaaaggttttctccccccctccaccacccgccgcgatgtcttccgctccgccgccgccgcggtcgccggctgcgacgcccgacgcggcggcgccagcgtcaccggcccggacgcgcgtggtccgcgcgcccccacggccgccgcggccgcggctggcgcacccgggcgccgcgccgccggggtgggcggagcgccgccccgccgtgtccgtggactacgaccggggccggcgcgaggcccgcgccgaggtggagggcgtgggcgccgcttcgctccccgcgcgccaccgcctgcgcgtggaggggagccggtggcagcgggactggaaggtgtcggaggccgccgcgcgcgtgctcgcgctcccgcgcgccgaggcccgcgccgtcgacgccgtgctcaactgctgggccggccgcttcgcccgccgcaacttccctctcctcatccgcgtaaggccatcatccccacgctctgtagcatttcatgaattgaaaattgctgatgatatacatcaatgtggctgccatggttgccttgcgtggaggcactaatgacaaactggttttggggccaaaatgttatcgattgcttgaaattacaaaaatcatgaacaattcaatcgatctagctgtgttgttatggtagtaccagctgcacatgcaaattttgtagacgaggctcaaatctctcgatttgctaacataaaactagccttttcaggtaataacgcgcttacacatgttgtatcacttgtaggagatcacaatttctgggaatttacagcatgctgtccatgtgttctgctggatgaaaaatcaggataactactgtgctcgtaacgacatttatggcatgatgatacgactatatgcgaggcataaccaggttgatcaggcacgtggcctgttctttgagatgcaggaatggcggtatgaatgttataacatatatttctgacataaggttttaatttggcttctgcgttccttcaaccatcaaaaagagttttgcctgatattactaaaaaaatttatcacctcataattgagtaattgtctcgtcggtaacttgtctatatacaaataacatgtttgtgttatggttcaatttgtttgagtttgcaaatccaaaatcttcccagatcatctagggaacagcgcaagtgatggttgctgatctcgcatgtaggaaatttatactttatcataataaactgtaatatgtgtaatactaagtgcaatttccatgtggttgctatttctatattttgttttccactactgtgataagaaatatatcatttttcattatctgtcatttccttctctttttttttttggacaaaatactgacatttataaccttaggtgtaaacctgatgctgatatatacaattccctcatccatgctcattctcgagctggtcaatggcgttgggccatcaacattatggaagatatgcttcgtgctgctgtcagtatcattccttgaaacataaaccctatattcttgctttctcatcttgcaaatgcctaagttgatgtgtttgtgtgttttatttttcgaagtaatacaaaacattaacttttgtgcttttaaccttattcattttagataaataattttggaaatgcttcttctttacaatgagtacaatgcgtttattgctttcctcatttcgctataaccattcttgatattgagctaatttttcatctataaacccaatagggtccttctgttttctactatacatagtaatggctatggtagatttagtgcaccaaagaaaataatgaagagttaaaaaataacaggaaaaacatgttttgcaactaccagaggttcagagcgagaaatgcaatcctgttttaagggagtttgttgagtaaggtaaaattgcttgattaagggttgaagtttttctctctaaaatatgggttgaatttgaagagaatcttggaaccatataaagtttttggctccatgcactcactttgtgcaaggacacatcactgttgattgcctcatcagtccttacgttattgaaatgcaaagagactattagaaaaccagcaaagtttatatatttcatttttttagtttagttgccataattgtttattaaagaaggttgtgttccggacttttgctgcagatacctcctacccggactacgtataataatgtgataaatgcatgtggggctgctggcaactggaaaaaagctttagaactgtgtaagaaaatgacagaaaatggtgtgggaccagatttggttacacacaacattgtcttgtctgctctcaagaatggagctcagtactcaaaagcaatatcttattttgaaataatgaaaggagcaaatgtcacctctgatactttcacgttaaatattatcatccattgccttgtaaagattggacagtgtggggaagctattgaattgtttaactcaatgagggagagaagaaccaaatgtcctccagatgttgttacatatactagcatcatgcattcttattgtatttatgggcaagttgaaaattgcaaagcaatctttgatttgatggttgctgaaggagtgaagcctaatattgtagcatataattcgcttttgggtgcatatgcctcacgaggtatgcatagagaggccttggcaatttttaatttaataaagaaaaatgggttacgacctgatatagtttcgtatacctccttactgaatgcatatggtagatctgcacagcctgagaaggctagggaggtctttaacaagatgaagaagaactcatgcaaaccaaataaagtcagttacaatgcacttattgatgcctatgggtctgcgggaatgttgaaggaagctgttggcttgctgcatgaaatggagaaagatggcattcagccagatgttgtttccataagtactctgttggctgcctgcggtcgctgcaggcagataacaagaattgagacaattcttgaagcagctaggtcccgaggtattgatctaaatacagttgcttacaactccggcattaaaagttatttaagttttggagattatgagaaagctttggagttgtatacatcaatgagggagagcaatgtgaaaccagatgctgtaacctacaatatactcatcagtggatctagtaaattaggaaagtatacggaatctttgagattttttgaggacatggtggactccaaggtttcttcaaccaaggaggttactcttcattgatttattcgtatatcaaacaggcaagtgttgctcttattttctctgttgtttactctaaaaagtttgctatcctaacaatgatttgtattcagggcaaactatctgaagcagaatctactttcagttctatgaaaaaatcaggctgttttcctgatgttttgacatatactacattgatccaagcctataatgctggtggtaatattcttttgttattatgattaattgatttagcttctcaagaattaaactgatcttttagttcttatggaccataaggtggttggaagagagcttggacctgttcaaagagatggaagtaaatggtattccaccagatgccattatatgctcatctctcatggaagcattcaataagggtggcgaacctgaaagagtccttcaattgatggaattcatgaagaaaaaatccatcccgttgaaccaaaaatcttattttgagataatagcttcatgcaccatgtacgtttactgatgtcttaagtcgaacaggcaattctaaattggtaacttaggtctattattattatctgagcagtgtgcaacatctgctgatctagtaacactataaatatgcattcacacttgctttggtatcatcgtgtttatggcttttaggtgtacatgactcagtcatcttacctgtcatgtgcagctttgctttaggattattttaatcaggtgaccatttgagtcacttacaaacatctgcttgttcttcttaagcaaccatgcgatataaaagataagtttttaataggtaaaaacagtatgaagtttcaagtttattaagatagcagggtggaatgttctgtgtagtgttaattcgattccagtaattgacaacttgaatcaattgaatgttggggttactgtattggcaatctacatttgttcgcttacacaattcggattgtagctcattgataatttcattttccttgatgggctacagcaacttgccagtgagcctctgctcctttcattatcactgtttgtaggtttagataatcaggctatcatggcatgctgccatgctttcatcatgtaacttgtattggacttgtgatatattggtggtttcaagtgttgagcagaaacaaattcctttttaccgcacacatctggtgttatgttgtttacaagcttttgatgcattgaataactcaatattctattttgttctgcttcctcataacaggatacgtgactggaaaacagcaagtgagatgattgaatatttggattcttcgctctcatccatttctgttggaacactaaaccatgttttaaattttcttggaaaatgtgggaagacagagaacatgatgaaggtatagttggccttcagaacatagttgtcatttcagaacatgcttcattactctgtttttggtgtggtagtttatagttttagtggatatctttctaagaacatagttgtcattccagtaattttagtggatatctttctaagacccaaagaaagatatccaacttctgcagtgcaatggatatacatgcttcattactctgtttttggtgtggtatggtttttagttttagtggatatctttctttttaatgcaaagggatgcagttctcctacatgttcagggggaaaaaactatcgatctgttcatttctataaaagtgaagtccatatttggttagatatggaactaacggccttgccacactgacacaatacaatatatttctcccaaacatataatcatttaatatgtttgtcctcagcataatg

SEQ ID NO: 13226 - DNA, 2560 bp, Oryza sativa
cagctgttttacaagatggtgacttcatgttctactgtgggtctttctacttatgcggttgttcttagaaatctcctagttgttgggaaatggagaaagtatattgaggtaacaaggccccttctcatttttacatcatctgatcatctcagaataccgcttgcaacaagctagattcaagagtaataggtcaaaacctgatatttatttgagctttattttttgtgcctgtaggttttgcagtggatggaggactctggagttcatccaacactatatatgtttcaaaatgtccttccctatatctggagagaaaatggcatggattttgctgctactatgcaagaaaaaataagtatgatacgtcctactctaattatcatttcaagaagactatgaatttatcatgcaataatataatccctccgtttcatattataagtcgtttgactttttccttagtcaaagtttcttaagtttgaccaagtttatagaaaagattagcaacatttataacaccaaattagttcattaaatttaacattgaatatattttgataatatgtttgttttgtattgaaaatgttaggatatttttctataaacttgatcaaacttaaggaactttgattaagaaaaaaagtcaaacgacttataatatgaaatggagggaatattttggtatctcttattttgtttctgttttgatgagcttgcatatattacgagccccatcggttgccctaataagccaaagccaaaatttgaattttcaaacttaattttgaagttgattttaaaatattttcaacgtagttcttttttagtattggcttttaagtgtaagaacacatatataaaagttttacctataagttagtttttattctctaataagccgttttggcttattagggaatatgggcaaccgatgggacctacatgaatcattgttatggatgactcatttgagcttaatcacaccaggttcattgagagacaagcaaacgtgagctctcgatgtttacatctctctgatgttaagcaggaaatacctcggctttaaacacaggtcttccaacacagaaacgcctgcctccttcagtggtaacacatatgtgctgacaaaaagaaatttatggtatgagaactgttctgtttttctctctttgccttcttctttttctttctttttcgcttttctattcttaaatcaaagttcaaacaattctaggtgttattttttctgaaatttctggttatcgcccagaatctatttccaaaatgaaactgggaatccctggtttgaagtccattaggcccataactgaaattgttggaaaattccttacgtgtcactagaaatttccagatcctgaaaccaaatccatgttttgagaaaactggcggttcccgaactagaacccaaaggaaaaggatgccaccagatttttgcttctcccatatatggcactcctttgtgaacctatgccggaatatgcatcgggcggtaacacagtttggcccaaacgtactacttgtcatttttattccaagtggcacctctactctccatctgattacacataaacccaaagaaagaaggaaactctacatccgtaattgacacatcccatttcttataaaggatggcaaggtggcattcacacatccaaagggaagcacctagaacagggcagtatgaggattgcatctctccacctctaatgctcatctgggtgatcgtgtcgctggttaaggtttgatatccatcaatctggcaaaagtttgcatttcttgccacctcaacataggatgggcaacgagtgcgtaaccgcacctctgatatgctcatctggggtggtcgagccactgctttgataattgatatgcatcattctgggaaaactttgcatttcttgccacctccatgtaggttgggtaatgcctgtgcagcctcacctccactgcgtacatcccagtgtggctgttgcagttctggtccacaagcctatactatgggcttggtgcctcctcattgctgtcacgagtgcataacaggagtgagcatgcacaaggtgtcctggcgctgtttccactccgtggtcagttacgggtgaagttgtgaaaaacagtgcccctggtaattcctgaccgactggctatagttcatgatttgttaccgaccgaacggtaatcgttcatgatttgttactgatagaaatggaaatggttactgacagacacaaaaatggaaatggtaaaaaaaaagagtaaaatccatcaccggtccctaaacttgtaccgctgtgtcatcccggtccttaaactcgcaaatcgaccgttcaaatcctcaaacttgttcgactgtgtcatctcggttcctaaacttgcagatcactcatttaggttctccaacttgttcagttgtgtcaccccggtccctaaacttggatttgaatatcatctggatcaaataggacggtctaaagactttatatttaaaaataattcataaatttttcatgtgaattctaatgaagacaaactttatatcaaa

SEQ ID NO: 13227 - DNA, 2104 bp, Oryza sativa
  unsure (1)..(2104): unsure at all n locations
tttgtcccaaaatgtaattgtgaaattaaaatttcaaaatctataaacatgcaacaatattttgagaccctaaatggttttaattcaaaaacttttcaactaaaaagttgtaggtcacgtcgagggctacaattttgatataaagtttgtcttcattagagttcacatgaaaaagttatgaattattttttgatataaagtttttagaccgtcctgtttagggaccgaggtgacataactgagcaagttggaggacctaaacgagtgatctgcaagtttagggaccaggatgacatagtcgaataagtttgaggacctgaacggtcgatttgcgagtttaaggaccgggatgacacagcggtacaagtttagggaccggtgatggactttactctaaaaatagaaacagaaatggaaatgattttgttgttttaccaaccgtttccttggttatcgtattttcgaggaaattaccctttttataatatggtaattaccctttttctaaatacacagtacttgtgtctcatgtctccgtttggcccatagcataaattgttctttttatgttcttgacttcttgtctctaatgatttcagatgagctaccaccatcatgagtgaagaacagagtatgtcgttaagtttgtctaatacaggatgggggcataaatcatcattgcgttcctcagtacagcatggccaatgtccacagcatgttttggcataagatttggaaatagtaccataaatgggagaaacaaaattcaagggcatattcccagtggcacaagggagattccctccagcctccaggtagataatgagtttgtactttgttaagatctactgaagcgttgttttggtgcttcaagaatgaggttgacacttgtggatgatatagcttgtaggtagctaatacagtgcatatatattctctttgagggtacatagacagtgtggatgacaaatggaatatgaaagaaaaatgcaaagcgtttctcatccgctcttttgcagctcaccccgccttcccatttgtctctacagaacgactaattcatcacatatgaacacaatgtaattgagcatataattaagtaaactctgaaaagtagcccggaaactgcatctcattttgatgattcaaggggagaaggtcaagatgtgcttcataggggaaatggggaattttgattatcaaggggagaaggcaagggtggagacgaactgcataccttcaaacagtatataaaattctgaacgtttgcatgatcatattttgcgtctccaggctccagcaaactaagctaaacgattcatgctcaagttggctttcatgcattagtggttaataaagcaaatgtgtattgcgaaagctgtattattatgtggcatatttggtctttgagatatgcacttctctactactttaaaatacagttgttctcctttctccgtgaaagttgtgattttatgtggcatttttggtattgccatatcagctggccctactagttagagtggtttcttcctcctccctctctctttcgactcgctcacccctcaccgagcttgaggccgccatggctcactcttttgactccctccctcaccgagcttgagtcggccatagagatctcgccatgctcgagagaagagggaggttggcggtggccatgacgaggttgacagtgagattgatgcggtgcccacccccttggccatgctcaagggaagagggaggttggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13228 - DNA, 1134 bp, Oryza sativa
atgcacgttggtaatctgacgcgtggtggacaagaatgaccggtctgacactggtcgcgtcagcaacgagcaccacgatcccacgttgcgcccgtctccgccgggagtggaggtaggtgtgggctgtcccatcgaagtgtgattcgacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtg

SEQ ID NO: 13229 - DNA, 5426 bp, Oryza sativa
  unsure (1)..(5426): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaaggcacagattcctgaagggattatggcacaatagaagagagagttccgtgcgctccagcaaggaaccatgtcagttacagagtacttgcatgagttcaaccgccttgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagagggctgtaggaaagccaggaccctgcttcaactgtggcaagcacggccactttgctagcaagtgtccgaagctgaatcgcactggacccaggttcatccaggcccacgccaatcatgtgtctgcagtggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcagaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagataaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttgtaagatatgttgagagcttgtgcacttgactttggtggagcctgggataaaagtctaccgtatgcggaattctcttacaacaacagctatcagtccagtttgcaaatggtaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtacccttcgtgtcactccgcttcggggagtacaccgcttccaaaccaaaggcaagttggcaccacgctttgtgagaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggccgagattccgtttaagggggtaggtttgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtggaattttcagagccttggaaataattttaaccaattaaaatgagcaaagtgcaatattaaatccctggaaaatcttttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccccacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccctcccgagcccatataaaccatccccgcactcccctccacctttttcctctttccgccgctctctcccgtgccctccatcactcccgcaccgatacacccgccggcgccgcctttttcactactccggtcgccgctcgccgccgctggagccgccgccgagccaatttgccaccgccattagcttcgccgccgccaaagctaccccgggcgccgcatccccatccaatcccgccatcggggcccgcttctctccgcgcgccggtgagtaccaccatagccgccgccgtcggccatggctctcgctcgtcgtgggcaccctctctccctctaacccctcacacttcctctcttagggtgtcccggagctcggccgccgttcgccgtcgcccttcggtcgctgaccgtcgccgtttgccgtcgtttcctcccgcgccggccgaaccccggtgagaactccctctctcttcttcccgcgcgcgccg

SEQ ID NO: 13230 - DNA, 20787 bp, Oryza sativa
cccccccccccccccccccccccgcatgcgcgtcgccgcgatgcaccgtcgcccgcgtcgccggccgccgtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggtccgtgaatttctgggcgtgacagttgacttgttaaaataaagatgttaacagaaaaaaataaaagaaaaatatttttagaagtgggccaacatgagaaggcccataaacccagcccattagttctcccctaaaacctagagagaggggaaccgaatcccacctcccctcatagtgccgccacccctctccctggccggtgcctccttcctcctctcctcctgtgttcgcatctctcccatctacagcaaattgctctccctagatctccaccttcatagcttggatcaagaagcgaagtagaaaaacggaacgatgaggagaggagtagaaggaggggttagaccggagtctcccctattgtctcctcacaagttctctaaagaaaccctaggtgaggcttatccccttgttgtatcagtttttctagcatggctttagtgcattaattcgtggttagggaaggctagagaaggagtttgggtatttgtggttcggtttgttgaagttctgcatgtgggcagatttgcagtgcttcagtgtttcgatgttttggggctctaaatgttgttttcttcaaaagtgtataactaggaagttgtatatatgttcggatatatcttctgaccaaagggcgcgatttttatctcaagtggtttaggagatataatttttttagtatgactgttgtttttgtgtcataatctggatagtagtagattgaactatttttggaggggctaaacagtagaatcagcccggctgcctatagacaaagttgtagaggtttttcttagctttccatattggtaaagtacaacctgattgggcgcgtagaactccagttatggttgttttagtgtggacagtctgaaattctggacagattctaaagcttgctttcaagcgcaaattagaccatttaaatagcacaataaaaatatgctttctacatgaaagttgtaggtattgctctgtagattttcaaaatttatacattttccgtcatagccttttcatatttcgagatataaaggtttgaagcagcagtcttgtgtataatccaagtggtgttccttgttattgagttttgatgggatggggcagtaggttcacctttttattgttttatacgcatgtttgaatgtgtttgctaaggttttgtttgtgattaggtggtggtccatcagctcgtgcatgataccaatccttcgttgaaggcaagtgtatgacgaactaattgtgtgattcatggattgtttactctatctatttatttctgatatatttcaacgtgataagtaactgcttgtattcatattattgttcatgccatttagatttcaagttgatcttatgtgtacgatcttattcttgttttaatattctggattctgattctgcttaaataattcaaattccctgcttgccatggatgtgtttcaatttggttctttgattccggtttcaattattcaagtaccatgtgtagtcatggtactgcaatttggttctttattcaagttcccgtggataagcgctgatcacgcttactcggctttgccggcaaatgttaggatgtattcactattgtccggaatggaaactactatttcaattcatgtctgcagggatgggaactactatctcctttgacttggtgtttggaaatgtgtttcctatcaaagaaagaaaatcttctgttcatgctttattgtcaatgatgtgtatatgtgttttctagttccatattgtacttgctgattatttttatactcttgtgttttatttggttttaggtacgcattgagaccgacatgcatgggcgggaagtagcacccttatattcacatctacttgcacactatcaaactatattgcttaggtccataatgacacttaaattatatcctggtttggtcttataataatcttttagatttctaatagttttttctccatggattataaggatggatcgtattatgggaatgatattgttattagtttaacttataattgcctgttgtggatgtccgtatttgcaggggtgactctgccgaaatttctaataattttggaagttagtggtttgagtgtttttttggtgtggcactctaggtacgtggttacctggggtgttacacttactctctcccttatcattcccataacaataaagtacactaggtcctcttgtaattcatcttatgctttggtgtgtgtgaatgagggagaggagaggggtatttataggtggagagttgccttgggagagtggagatgctccaagcatcctatgagcatattccttctagcttcatctcctcttgacaagtgtcctctctatgacggtttccaccggtagaaaaggacacaaccgtcattgggatgaggagtacaatcgtcataccgaatatgggctggattgggccagctgcgggttccgccgatccaggggttcggccgaaccctgattggctcccctggcccacatctttcttcaggatgctgacatgtgggccccacttcatgatgctccatgttttggtccaaataattgcacattttatatgttgtagcttaaaaccatgtgagttcatgagagcaaaatatgtttccattctttatgctcattctctcccaactttggtggttgatcacctgcatacaaatatacaccaccactcgtggaaattgttagaaataaatcctaccactatgttggaagtttcacatttgtggttttatacaggtattgacgacgttattttggcacttaacagccgtcaacaggcgccgtggagctccaggcggcgtgtctcccctctttgcgttgtctgccgcgttcatcggcatcagcacttgatgccttgagctgaccaactcagtggctgctggcaggggaagagaggtgaggaagatgatgaatcagtctgacatgtcactggtggagaaatgatttgtgctcccgattggtaaccctctgtaaccccggtttttcaactaggactatgaatccgggactaaagaccactatctttagtcccgattcaaatacccgggactaaagatcgatttttagtcctggtcaaccaggactaaagataaaatcgtctttagcccggattaatgttaccaaccgggagtaagggattttttttcttttttgttttttttgcttccactgctgtttttctatttccatctcgagcacaatcgcacaaaaatcacatgcataaatcatttacaaatcacgcacaacacacctaaatcatccacaaaaatcatttacaaatcatacacaacacatgcccatccacaatccacaaatcatccccaaatcaacaaaaaaatctacacatcaattcacaaaataaaaaaaagctccacaggaccacaaccaccacccgaccacctcccctcccggatccggtggaggagagtccgccgccaccctcgcaccgccctagtgccaccgccgccaccccgccggctagctcgccctgccgcctccccctcccagatctggcggaggggaggccgtcgccccgccgcttccccggccgcctcccctcccagatttggcagaggggaggccgccacccctcgccactttcccggccgctcggctcgccccgccgcctcccctccaggaccggcggaggggaggccgcccccgccgccccgccgcttcccttcccctcccactgccggctgttgctaagagggagggagagggagagggagcggcttgatatcgagagagggagaaaaatctctccgcagagagttgagagaggacaatgcggagagatttttctaagtgttgattatataatctggttggtaacagggcggggagaatgacgcagagagggctgatccggatttttcttttgtcccggttggtattaccaacggggactaaaaatagtataagcatgacaccagcctgacaatttgtcccggttggtaaaaaagtaccccgggctttttgaaccaggactaaagatttagtcccagttcttactcaatccaggagtatagtggattttggctgaccgggcaaagatggtttctccagtagtgagtgggacattaattattttcaaatatattttattgacttagatatgattgacacatcagcgccacattggcgaaaccacaatgtttcaaacttcgaacggttttaaaaattgaggggtgtattatacccggttttgaagtaaggggtgtatttcagacaaatgctatatagttgagggtaaaatggaccgaataaaatatgtttgtccgtcgctaatgacgtgcttaatgaatttacgttgcacaattaacaaaaataatccatataaatcgagggtacatttgcaacatttttttttggttttatttgccttttcagtttttttttttggtgttgccatatttctttgacggttgcactgttctccactttttttttcggtcaaatacgatgcagcgctgcacgcttctctcctgctgggcagacgacgcctgcaggctgacggcttttgtcagcggcccaacggcgtcgtcaccatcaccttgcgtccgtccatccggaacagtgcactagagcagttgaacagtgcggggttcctaaccacacagcctagcgctgcgaaccacaactagcgaactagccttatcatttccgttagatgtttggatcaataatgaccgcaaattcatagctgttactgcagctgaccctggaggcctggacgccccatgtcttggaaaaccgtgcacgctttgtatataatcacatgaagcccccgcgtcctgctagacccttctcacagcgccagattttgaagcttgcagcagatcgagatattcgagttgggtcgccagctaggtgcacttcaccacttccccttttctcatccacagatcgagttcgattaatttatctttattagttttattttgtttcaaagctaggaggaggcgctctccagttaaaatggttagtcttttgttttagttagtttctaacggcaaaacacccaacttatttgtcaaataattttcatttccgctggttatcaaaagagagaaaatacgactatacgagcatttgcgaatttaccacttttttttcaattttgcaagcatgccgctcgaacaacagttcaagttgaattttcgcaatgttctagtgacagtcttgcaataacgattcaaaacagtggcaaatttataattaccccaaaataagatgttgaagattcagcaggtttagtgttggccgaacgacagcgattcctcatagtaagaggaacataggtcatttacatataggccttggtagaatctctattgttagatttttttttctaaaaggtatatggaatttttatattgatagtattgatgtctaattcggaatttttgttgggatgatgattatatcattgttcacgtgaaaaatcatgtacgttgctttcttatggtctagcgagaattgttaagcaattaggagtccgactttcaccccaagttagcatgtgagggttttaaaaggatttcttatatgactccttatgtatttacaaaagtgaacgaacataaaaatagacttaaatacgaacggcatatcaaagtatcacagaaaccatctttaatttttgagcactgctcccgtccagcaaacggtaccccaggtaccggtaaccccaggtacaaaacttaatctgaccattgaattagagcggggcacgatcgggattgaacttaatgtagacccccgtttttataacggaatcactcatattaatagtaccatttccctggatcaagtagtctggtactcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcgagcaaaggcgcacgacctctctccgagtgtgagcggcgacgacggggagctgaatccacgccgtcgagctcgtactcccccatctcctccgcgcccaagccctaagcagggggaggcgcttgagaaggtcgacaagtccatggcatcaccagtcgcaggtggtgcaggaggacggcaagatggggagcgccgcctcctcgtctacggcgacggcagcacgcctcagggtgcgcttcaggctgctggcgcgctcctacgacatccgcctgtcgtccatgacccggagtctccagcccaacgatggctggaagatgtggccaacttggtcatgacggcacagcagcgcctgggtgctggtggacggtccgccaccaccaagacctccggtgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccttgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccagttccggagtggcagcttcggccgcccccggatccgccgctcagacagggcggcgtgacaggaggaggaagaagaggtcggaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaggtcgcgctcgcttgcatggagcagcgtgccgaccgcctcgctgctgcatccaagcccgagggtggtgacgagaggcctggcccctctgcccccaccgccccgaggcagcggatcgctacatgcgacgaggtcccggtcaaggaggttgccttgggcgacggcccatccaagaccacacggatcggtggtctcctggatggcaaataggaagacgcgctcgtctccttcctgcgggcaaacgctgacgtcttcgcatggagaccagcggacatgcccggggttcccagggaggtgattgagcaccgtctcgccgtgcggccgggcgcgaggccggtccggcagaaagtgcggcggcaggccccggaacgtcaagtcttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagcagaacatgccctcactcggttaaaggcatatctcagctctcccccggttctagtcgctccagagccaaatgagtccctgctactttacttagcagcgaccccccaagtagttagtgcagcgttggttgtggagcgcgatgaggacaatcctcatttcgtgcacccccattctgtgctaacttggcccgggagcaagcagggaggagaggcccccgagtcaaacggtggcctaaggcccctgacgaccggagacggccctctgcccgctcgtcagacggtgctgggtgcccccgaccctcaggaaggccccgaggccactgcgggaaggccgcacttaacgccctctgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggtacagaagacaagtgcgccccgaaaggccacttgaacgaagaacgccccggggatacggcccctagcagagaggatcggccccaccgaagggtgcagcggcctgtctactttgttagtgaggccctccgggacgccaggacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatagagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaacaatatggcagagtacgagggactccttgccggactcagagtggcagctggactggggatccgccgcctcttggtgttaggcgactcccagctagtcgttaaccaggtctgtaaggagtaccggtgctctgacccgcagatggatgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgatcccttaggggagacggatgtgcctgaccggcccccgaggcccgtcggagtccaggcctcgggacccgaagggagcgcttcaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgcagacatccatgagggcgagtgcggagcccattccgcctcacgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagaggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtgtctgtgccgtttttccttctgaagaatcttaacttgaaataaggtcactcgtgctcaaccttgccctagggggctcagttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgtggatctccccgggcactggccccgacccgagccattcgaggactgggacttgggcacgagcccttatttcaagctaaggcgcaaaaggaccatggcacagatcatcctcatcgcatatgtatagcaaaataaaactaacacaaaaatttttcatcatttcatttctgattgcagattaagttaatttgtacaaaaaagaggtatgaaggccttagaagaaagaaaaagaaaaaaagattggcgggggcctgggggctcattccaatgcgcccgggtcgccggcctcgtcgccgccgtcatcctcatcgctggcgtcgctctcctcgtcggagctgggggcgaacgcgagcagaggggccgacccctcgaagccgtcgacgatatggtcggcagcatcccggacgcgcgcgcgcgcgtcgtcctcggttccgggagggaactcctccagcgccatccagggagagaagtcggggtcccgggcctggtagctcgccagcacgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctttgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttttctttccttttcttttctgttttttttttggtgcggctttttttttctttttttttgcacctttctgcctttttttcacttttttcttgattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacgtctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatgtatagaggtgggaggacgaccaaga

SEQ ID NO: 13231 - DNA, 26427 bp, Oryza sativa
tcgccagccgttgcgtcgtggcctcggcctcctcgagagctcgctcccgctcagcgagtgcatcctcgcgaaagcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaagatgcgctgggctcggggatgtcccccgggcccgtttgatcatgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggtggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggctgctggatcttcggcctcggactggccggacttggggtggcgggaggaatgcgacgggacatcgctgaagcagaagaaaaagccagaagacgaacaaagtgagcaagaaaaaacttctttttggagaaagatggttgcaatgagagtgagacgaacctgcgagggggtcggttgaatgaccaccttggaggggaaatcaggtttccccggcatggttccgtctcccccgtcttacggagccgcttcttcttgcgcaccccctcgggctgcgatgtcggcgcggccccctccgggcgccgactgctggcacgcaccgccccgccccctcggggaggagatggcggaggtgttcctcccagcttcctcttcccctgggcgacggcagggcggctgctccccgagcccccgacgcggggcccagaagcacgaccccctcctggggcaggttgttccccccggcggcgctcgcccgcgccgtcgtggcccttaggggctctctcctctgaggccccgacccccatcataatggttagaatggagacgcggtcgggatcgctgcagagggggaggatctcttgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgtcggcaaggggggtgtagaaccggtcgctcttccagtcgtcccacttcttgcggaggacgcaggggatgtagcggttcaacactggcccccgcggctggaagtagcagccgccaaccgctgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccatcgagcagagcagagccccgtgccatggcggtggaggaagagatgattgggaacgagcgcgtgtggcgaaagtagggcgtagcagagaaagagttagagctcaggcggcaaaggcaagaggaacaatggcgaaaggaagggagcaaatccttttctcgatgcttttatacccttgccatcgctgggcctggctcctcgtttctcgcgcccactacctcgctccctcgtatctcgctatcccgctccctcgtttcctgtgcccacgcttccactaatcccattcgcccgcttacggcgcatgaagtggatatgcggttgtggcaatcgaaacggattgtatcgtgcgcgcgttaattacgctcgccaaccgaagcggcgttaccgtatctccgagcgagacaaatctgctcacccagattcgcgcgctgctcaagtgatgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtttgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcagatagtgatattcaaagtatggccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttagagtctagccaagtgtaatacatgtcctgatgctcaatatccgcgagcacggctattcgaatagattggttttactcacactgcagtggatgtacactttacccgtactccgcgacttgcccaacacatgagcctacgtcccaacgaatgagacttgccaaggcaaaacctttcaataacctcacgttggcagtacccgctccatgaacttgcatcctcatgcactccatgaacttgcatcctcatgcactctaggtgtcatgagtttctagcagtgagaggagttctggcgctcccgggaagggaagactcacacatgcattaagttttagttaaattaaatttacacatggcagtcctaccgatggcggcaccactataggcactcgcccctcgcggccccaccaatggctgtcccatcgtaggccctgactcccacacaccaagaataaccactatgcagggatactgccttcgctcggctacgtactccgctaggtctatacccatacgagaagtacggttgtacgagggtcgtttcatgcttaactttacggctcggtccttaactgaccagggacggcactagccttttctggacaccacccaagtaccccagccgccccggtcgaaaacagtgtttagttttgtttctcttttcacaattcatgttatccttgtcatggcaatgtggtgcccatgcctccacatgccgcatctcaactaccttccttaaggtagttgcccaagcatatagcacttgataaatatgagaatgcatgattctaattagcatgactaagcatttgttcaatatcgactaagtacacacgttagcagggtttacaatggtcatacagataatcaatatcaaggcatggcatatttaacaagtagggcattcatattcacatatgtatagcatgtaattttattaaatcaacataattttcgcaataggttcaacatgctcaaagattagtgatgacttgccttgatcgcagtcttgctatccctgctcctcaatcgactcaacaattccctcggaatctaaatttacgtgcgaaagatcggatttgaactcaattagaattcaaataaattcaccaaaattcaaacagtacaaagcatattgagaaaatgttatcaccagatagatcttgattttagatgaatttaggttcaagtttcattcaattccgagttaagatgagtgagttatgcttgtttaaagattcaattttgaattaattcaaacaattgtgaaatggcactgtgcagccgagaggggcattattacagtggctgacatgtgggccatccccctattttatttctggtttttatttttttaaaggaaatcctattgtgtcattgacaggtgggtccggccccctgttgaatctcctgtgggacccgcatgtcattgagacattcacttaaaacctaatttaattagatttctaagcatccgggcctacatgtcataggttcataataatatcattagttttagggattactgtacactaatgaagtggggtccacatgtcataatctctccctctctcgtgccttctctctctcccgtcgtcttcttcctcgtgctcgcgacgaagcagaggagcggcgcgcgacggtacgacggcccgagccggaacggctcggcgcacggtggggctagcggcggcgcatcaccggatgcccgccggcggcggcggcgaagcgcggcgaccgtccggcgcacggcgcgacggcgcgcgacggcgccgagatcccaaaatcggcggcggcacgatgaggaccaatgtgagcgcaaccaacaacgattcaaccatctagggtccacatggagtatatagaagcaaaaatctagcctaggttgtattggaacgaagtccccccacggtgagctcggccatggcgcggcggcggccggagtcggcacggttacggcggcgcacaccccaaatcgagggggccgttggtttctaggtgaccaggcgggactacaggcgcgagggcttaccacgaagtggcggaacggcgaagttcgacggcgagtggcgcggtgcggtcgaaacaggggcagacggcggtcggcgacggtcgcaagtgttcgatgctcgtactccctcgcgtagcggctcccggctccctccaacagcagcaacggcaacgggcacacctcctcaacacaccccgccacccacaccggccgagaggccctgcggcggcggcgcaacccccgcccaccaggtgttcgacacccggcggcggcgcgattttgttttctctgggatggagcaagaactccgggaaaggggagacgaatgagggttcgattttggataaggtcgagctaaaggcgagcttataacagcgagagggagggcgattcctattggataagatcactcgatgactcagccatgtttcgatctctcctaggttcgattcaatgccttgggccggcatgattgcctagacgatagggtcccaggagagggatcattagctgtgggaggaaccccccctattatccagcggtctcggtggggtgcgacaggatggcgacgcgacggtgacaagagcgacggcgacggacagagataacgacttggatagggggcgccgggctatgccctagggtgacgcggggttgtcgtggcggccgttatcactccatcccgagggcgacgtgtgaggggacgggatgacgcgggcacccgtggcggcgcagcctttggcgcgggcttttggcggcttggtcggcggcgggcccacgcggcgtggcatgacgcggtgcggcgcacgggcacgactagtgcggcgcacgagtcggaaagcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataaggaaaaaggaagggctaatctgcaaaatggcttggaattgagttgtaactctatctattttggattcaagaattcaaacatttgatttgaatatttatttggttattcattagtccccaaatgaatttgcttcccatcatcccaaatacaaatattttaatttgcatttttatttatttattcatatctctaccaaatgatattactctatattggattattccaaaattaacttaaataattggggggttttgatagtcctaaaattaattaaaatattcaatgggtccattattaatacaatagcacattggttgaacttatttgcataacaaggtattcatgtaaattgtaattattatttagatgcgcgtctttactttgatttttccattgagatgatttatagtttggcaagcaatatcaaccataacatccatcatgatgcaaagttttaaaaagttaaaaattgtagtgatttttattatcgaggatttttaggatgttacacttaatctcgcgaggactcagtctcctgccacgcgttgcatccgcatctgaagtctacgccgcgtcaccgccgcaatcctttcgccctactccgacgcggtgtccaagtgccgtcctcttccggcctccgatgcggtgtggcggctcctcctttggccgcagcttttcccctcccctcggtcccctcctcccctacgcctctcggctgcccctgtgcggtgcggcagctcgtcctttgtccatggccacaacttgtcccctcccctccgtcccctatgcatctcggctgctggcacctacgcagtctccggcacaggatcacgataccctgagtttctttatggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaataatagtaaaaaagaagtagatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccagggatagaacgactcccagaagtcggcggcggccagacctggaccggctataggaagggcaagttgggaatgggcaggttggcgacggctggttgcagtgagggaggaagcgaagtccggcgagattggctgcgccgctgctagggatgacggaaggggatcgggaagagacagattaccgggttggggacttgtaccgtctctacaaaaattgactaaccacgcgaaaatccaattctgcccttccaccagttccatacacgtgaacaaagggggaggtaccccgcaccggattcccgtaactcgcggtaccgacaattgtgggtcgtttgatctggctgaatggacggttacgattgcagtaccacgcggtaccaaaaattctgctggacagtaaaaattctcttaatttttataattgtagataagtagagatagagatagagattgaccggtctaacaaaaggtgtagacgtggtacacttgagcgcgtgaaactccatgatgataaggttcgattgttaaaatcctaaggcaaccaagattactatttaatatctattaaaagaaaattacatataaaaattttttgaaaattttatatagatgtagctgtgcaatttctcaattggttagtttctttacagctaatccaggccacccatgttcaagtcctaaacttattagcatttacggctaattattttttcagtcgtagtcctaaacttattagcatttacgggtaattattttttcagtcgtagtggtaggtgatctaccgtcgatagcaagatatccgtggtgacgtcatcaattttaaaatatgttggtccggtatttcggaggtgctcataggggtagggtatatacctgtgtatgtttatagggatgagtatatgtgcctgcatttgtattttgtttcttaaaaacatcatcaatttcgagatatgctggcccgatattttgtagatgctcatgtattcatgcgggtagggtgtatctgtgtatgttcgtatggacgagtatacatatctacgtttttactataccaatcaggttttgccttcaaacctataccaataccaatcagcattggattcgtcagcagatgtgttgatttgcataggtgaccgtctacacggaggagttagcactagtccaataacgaatttcccgtgcggtcgaaagtgattttcgcgtgcggatcttccacccgtctgtaacgaagtgcctgcaaaaattgctatttttgcgtgcgggtggcgcacccgcacacggtggttatgttgcccgcacgtaaaaatgaaaaaccgaaaaaaaatccaaaaaaaaaccctaaccctaaagttgctgccgccaccctcctcgtggtcgtcctcgtcgttgtcgtcatcgctgttgccggatccgccgcctccccaccgtccgagcccgcccacccgccgttaccgccgtgccggccaccactgccgccgcatcctggcaggggacggctaccgccgccagatccgggttgggggcaggtgcctccgccggatccgggcaggggccggtcgctcgccaccgtgcgcacgccatcgagcccgccgctcccggttgcctaccgccaagcccgccgctgccggagccgaaggaggcaaagaggtcggagccagaggagaaggagaaagtggcgctggcgccggtggtgtggcctgcaggatgcgaggtccacgcagccgcgtggtgctagcttagcggaagtgaggagaatattgagcggaggagaggaaagtgtggagaagatggagggggggggagaggagaaaggaaatttgattttttttttgaacaggttcatagggaatgagtatttttccgtgcgggtctattaggaggcccacctgcgaaaattgatttttgcatgtggttttcacacagaaccgcacacaaaaatggaggatgattttcgcagacgcgactagttatctgcaatctaaatgggtccctgtacaagaacattgttttttaagtagtgtagcgaacgtccttctatcaagaagaagtgggaagactataagttacccatctatgctctaaaaatactataagtactccttaatttattacccatcagctaaagatttacgatgttaatagagtcaccaaccatctcgatctagagaactctaaatcaatatggggtttgggataggacaaaggctgtgttcagatgacccttttcccaacccctctccctcattttccacgcgcacgcttttcaaactgctaaccggtgttttttttttacaaaaagtttctatacgaaagttgcttaaaaaatcaaattaatccatttttgtaaaaaaagcaaatacttaattaatcatgcgctaatggattgctctattttccatgatcactgttccggatgggaacttgttctagcgaacacacccaaaatccactaacggagccaatttagagatcagaccaacctctaggtcaatttggattgatttgaagttaaccatctgtctcgtgggcgaatcagaagctttttgagacaaacctatagagcgtatatcacttgtcgacgagctatatctatctatggtatttgtagagtatgaggattgttagtgctagggtatgcacaagattgaggaataagagacagaatatatcgatttttatataggttcggaccccttaactgacaggtaatagctcttctcctgttgaccggagtcattgttgcctttatatattagtctcacacgagtacaacatttgagttgacctaatctagtccctatcgatctagcagcatggagctctcacatgtgatcgacgacttgtgcagtcttattcctcaaacatgaactcgacgaaattgaatatatctctagatccctcatgtccacattgggtttgtctaaatttgtcctcgtgtctctttccttctagggagtcttgtatttatatcattgagtatcctcttatccaagtagaactaggtaactgatacaaacacacccgcaaggggaggctcgatcttcacggtagtaggttttgaaccaaagagcaccggtgtaaaccgtgcacaagaggataactagctttatacctgcaagggttggatgcgaccaagtggtgagggtgagaacgatccgaatcctcttggattccgacccatcaaaccaagcaatcacagaaccataatccaggactaatccacacaagagggggtaagacacttatgcaatcttcaacaatcgtctctcatctatgctttttataaagttaaagcccactaagtataaagctcaacatgcaaacatgctaccttatcattcactagcaacaactaattatcaaatagttcatacaaacatgcaatatcatccatactttatttaattctacaaatcagaatgcaaatagatccaatcatcacctctctcatcatttccataatatttcaacaaatatatccatcattttttataatacttaacatacatacatccatatattctgtatcaaagcgaagatattatttagtttgtttcatgtttactactaataaatcctaacttttcatttctttttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtggggagcaggacgcccgcgccagcatcgagcgccggcgtaatgaccgaagtgctgcccacgcaacggaaggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaagggacaggcgcggggttggctaatgaacctgccccccgcgtcggtccactcctgggaggatttgtgccaacagttcaccatgaacttccagggcacatatccgcgccccggtgaggaagcggacttgcacgctgtacagcgaagggacgacgagtcacttcgatcgtacattcagcggttctgtcaagtccgtaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggctgcttcggccgcccccggatccgccgctcagacagggcggcgtgacaggaggaggaagaagaggacagtccgttccgacgacgagggtcatgtcctcgctgtcgagggcgcttcgcgggccacccgaaaggggaggcctgtgagcgacaaaaagaaggaggccagtgctcccagcagggagcgccccaccggcaagtggtgcaccgtccacaatacctccctccatgaccttgcggactgtcgcgcagtcaaaaatttggctgagcggacaagaaagtgggaggaggagaggaggcaggagcgccgggaaggcaagtccccggcggttccttccggccatcggcgaagtgaggctaagcagaaggcccccgccgaggacatcgatgatggcgatgatgacctaggtttccaagagcctggggccaccattgccactgtcaatggaggagcgtgtgctcatgtttctcgccggagcctcaaggctatgaagcgagagcttctggccgcggcccctactcataaggcgacgcgccgggcgcggtggtcggaggttgctctcactttcgaccagaccgaccacccaccgtgcgttgcccgaggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacctgccaatttccgcacggagcgggtaaacttcgatgtggcggacctcagtctgccctacaacgtggtcctggggaggcccgcgttggtgaagtttatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggctcatctgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccgtaggaacttattgttatacgacaatgcctttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaattgaaccccgataagtgcgtgtttggtgtacctgcgggcaagcttctcgggttcttggtctctgcccgaggcatcgaggccaaccccaagaagatacgagctatagagcggatgcgcccccccagcaagcttagggatgtgcaatgcgttaccggttgcatggccgccctaagtcgtttcatatcgaggctgggagagaaggcgctacccttatttaaactcctcaaacgctccgggccgtttacttggacggaggaggctgaacgtgctctcactcagttgaaagtgtatctcagctctcccccagttctggtcgccccggagccaaacgagcccctgctgctctacttagcggcgaccccccaagtagttagtgcatcgttggttgtggagcgcgatgaggacaatcctcattccgcgcactctcaccctgtgctgactaggcccgggagtgagcagggaggagaggcccccgagccgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggtggcctaaggcccctgacgaccggagtcggcccttcgcccgcttgtccgacgacgccaggagcccccgacccacaggacggccccgaggccactgtgggaaggccgcccctgtcatcctccgaccccgaggtcatcggcacagaagacgagtgcgccccgagaggccacttggacgaagagcgccccggggatacggcccctagcaaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgagttacggtggttacgtcataccccctcggccaaatcttgcataatcgagagggtacaggacgggtggtaaaatgggcgatcgaactttctgagttcgatttgcattttgaaccacgccacgctatcaagagccaggccctcgccgattttgtggcagagtggaccccggctccagagcctgtctcaatccccgaggtcaactcggacccctcgcagccgccacacaccggccactgggtgatgcagtttgacggctccctgtctcttcagggcgccggtgcgggggtcacgttgacctccccgactggagacgtcctgaaatacctggtccgcctcgactttcgagcgaccaataatatggcagagtacgagggactccttgccggactcagagtggcagctggactggggatccgccgcctcctggtgttaggcgactcccagctagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaaggcgtgctggattgagcaagctctcaccaatgtgggagggtccgtatcgagtgatcggcgtcccccggccgggctccatacggctggccacgggcgacggcactgagttgcctaacccatggaacatcgaacaccttcgtcgcttctacccctgaggggggggtcgggcgtcaggtttcgggctcgggccaaccccgcacccccccctcgggagtgcagggttggccgggggctgccacacatgcacattctcttttctcttatttcagtatttcaataaaagcagtttcaatttcctaagggctgtatctgtgccgttttttcctttttgaagaattttgacttgaaataaaatcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgagggctgggacttgggcacgagtccttaaatcaagctaagacacaaaagaggaccacggcacagatcatcctcatctcatttgcatagcaaaataaaattaacacaaagaaaattttcatcatttttgattgcagattaagttgatctatacaaaaaagaggcctgaaggccttagaagaaagaaaaggaaaaaaactggagattagcgggggcctgggggctcaatccgatgcgcccgggtcgccggcctcgtcgtcacggtcgtcagcaccgctggcgtcgccctcctcgtcggagttgggggcgaacgcgagctgaggggccgacccctcgaaactgtggacgatgtggtcggcggcatccctgacccgcacgcgcgcgtcgtcctcggtcccgggagggaactcatccagcgccatccacggagagaagttggggtccctggcctggtagctggccaggacaagctccaccgctccttgagcgaggtccctcgaggatgacttgatgatcttctcgagctcctcggggagctgctggagagctccggccatctttgagaggtgctgagcgaggcctcccaagttggtggagtacttcatcgtttggcccttccagaggcccgcctgccgaccggcgcgatccagacgggagactgcatcccaaagcatgccgggccctatctcgcccgccaagcggagggcctcggcttccccggcggatgaatctagcgcgcgctgcatgtcggtgacgatgtgttcggcatctgcgaggcgggcggctaagtcgctttcgcccgcagccgccccgccgatgcgtgccctcgcgtccagctccttttcccgcgcctcgaggtcggcagcccgctgctccagcgtggctctctcggcgcggacggattccaagttgcggcgcgcctgctccgtcagcgctgcctcacggagggacaggctgtccgccaaccgttgcgcctcggcctcggcctcttcgagagctcgctctcgctcggtaagcgcgtcctcgcggaggcggagtgcggactcctcttcggcgcaggcagactcgtgcgccgccagcgttgcctcccgggaggtgacggcggcctcgcggtccgccaggtccttctccgcgacgcaggcgcgctcctccagcgccatggcgcgtgcctcgagggcctcttcacgccgccggagcgccgcttcggtctccgttgctcgctgctctcgggcagcggcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacacaggagtagggtgttacgcttctcagcggcccgaacctgtatacatcgcttgtgcttcatgctctttcaataggtcgcgatctttccacatacacagagagcttgggatctcaccctgagcccccggccgaaccggcaaaggggggcccgtgcggtctcccggtgaggagccccacgctccgtcacattggatgattcatcaagggtgtaaattgcacctcttcgcattatctaaattgtttttaggctttggatgatttatcaagggtataaattacatctctccccccccaaaaggcataccatacaacccaattatttataacctatggataactgataaaggtaaaaaaataaacacatgaaaaaatcatatagtagggaaaaaagaaaattttagaactcatatatactatattatcacacaattctcctgcagcaacacgtggggtacccatctagtacatgaggttttaattgaacaaaagttgtctaatggataaagtagagtggtatttatactaggaacatccctcctagcttagtgtgaacataagaaaccacatccaagtaatcaaggctaacataaatgagaatgcaaaaagttttctcgggttcgcgcacagcccttcagctcctgcacagccttaagtaaaattactctaacttcttattggaaaatgatattgtaacccttgagaacgttctcaaggtaacctatccttcttggcgtagtgatgatgccttcagatataaaccatagcaatataaaggtagagcatttaggtagtataaaactctcactaaaatttgggttaagttgagcaaagagtgagttcacctcttgttgtattttcctagcattgaggtagtataatttaaaaacataaaaagataaaaaacataaattacatttatcattaaaaaatacatccgcttcggtctccttccctcttttctccctgaatagatgagatcacaattattattagtgaaaataattttaagttgactttataaacatagattgtatatattatcatatatacgtaactaaattagctccacaatgtttaaaaaagaaaatttataaaatcatattattttacccattatattaacaattataattcttagttaggtgcaccttttattttgtaccattaaattagcaatttatgatctatataaactaatttataacccactattttgaactatttttaataaaaaatattttgctatgataatagaccatcaggtctatcttttgttctaaaaaagcctctaaagatctctttccagtctttgcacgttgcacattgtgtccttgcctagtgggcatatgacctagtgctctacctgaagtagctaagttgatcacaatcgcccataaactttattaaaaacatttcaaaatttataggcacactacacatactaatatatttttactcttatttcaaataaatattgttttgaacaaaaacaaacaaacatacaaaaaagaaagaaattagctgcaaactattgttgatattttggactacaagccaactaattgtgtaggtgaattgtttcctaacataaaacgccttaaaaattcattagaattatggagaaaaaatatgaaaattttaaacttgtacgaacggaaaaaaaatccaaccataattttcatattatattaatctggcttatagattatactaatctattatattatactaatttggcttatagattagtatattagattatactaatctggcttatagattataataatctatcataataatctacttatttgttttagcttatatactcctaataatttagattataataatcctaagctaaatcaaacatggcctaaatcataccttgagttccttaccgtcctaatttttccttttgacaatattgaatggtatgcatgataattgcattctcgatccaaaggttggttcaaaagtcatatgagcttgatctatcttgtaagtcgatgaattgtttttagattcacccgacctatagtttgccctatgagatatgatttttgaacaaactataatatcttgttttaataatatgaatgcccacgtgttgcgtgagtcattcctagtttttctaacaaacgctgtatataagagaattagtattaaaataagagggataccaatcacacagtgaaaaaagtgaatgggatcaagtaaaactatttaattatatgtgatgcgactgcataataaacagttcatttgaatgttttgatcttcttgttggcttatcctagaaattctcatattaataggagagaaagaaaaacagagcccatatagaaatacaatttagaaagagttgaaattcggaattaaaaaataagaaatattggaagaggataatagagtccatatagaaatacaattaagaaataatagaaattcgaaattaaaaataaggaatattataagtagagtacagagttcatatagaaatacaattaaggaataatagaaattcggaattaaaaataaggaataacagaagcagagcatagagtccatataggaatttaaaagtaactaaaattcggaataaacataatacac

SEQ ID NO: 13232 - DNA, 10306 bp, Oryza sativa
  unsure (1)..(10306): unsure at all n locations
tgggaagaagagtataaagtaatatagcaatacaatttagaagtaaaattcgaaattaaaaattaatgaatattgaaagatgagtttaagtccacatagaaatataattagaaataataaaaattcagaattaaaaaaatattattggaagaagagcctagagtcaactccctacgtcccaaaataaatcaacttctacaattcaaactttgtccgaaaataaatctacctctaccttcttatctactctcggttcacaaatcaaaaaattttattcctttaataccccttacctacctacccaccaatactaatttactaatattaaggggtagtttggacatttatcctctcctttagtgatgcattgggatgctagaatttgtctctttgtggaaaagagggagtatatagaaatacaatttacagataacaaaaattcagaattaaaacaaagaaatattgaaagacgaatctagagtccatataggaatataatttacaaataactaaaatttaatattaaaaataattaataactaacatgtatgtaaaatacaatataaatattacacattagtagtttcgtaaagttagtacaaaatttaaaattatgttgtcattttaatatatttgaataatacattgagaaaacatgtatgttattctatgagagaaaataccatgcgttagtattaaaataagagggataccaatcacatagtgaaaaaaagtgaatgggatcaactaaaactatttctgtagggtatctaatgaacagagaaggcagtagtcttctttgtaccgccggacgtaacggccatgttgctgttgctcgagagcttcttaagcattgtccagatactccatactgcagcgaaacaggctggacgtgtcttcacgcagctgcatactctgatcgcatagagtttgttcggtttgttctggggtcagaacaactacggcatctcgttaacatccaagataaatacggacgaactgctctgcatctcgcagcagagaagcttaattcgaggataatttctgctttattgcttcaccaaggcatagacgtcacactgcttaacaatgacggtcagacggccacctcggttttaactgaagctttagctagcagaaaggacgatgacatcgaccacatctgggtatgtacttccaccatcctataattgttagtatctttatagtatttaaaagttatagtaaaatagttatcactatgatagtgctacttgtcatatcaaccacttcgaattcaaatttctccacattctgcctataaccaccatcctacatctaactatacattatttattataagcggtattatatactccctctgtctcaaaatataacaacttttggactctgacacgatcttcgatatgctactttgaccaactatatcaataaaaataaaatattttaaataaaaagatttgcatattatgatagcttgtctaatgataaatctagaaacatcaattttatatgattgaccttttttattttttttctattaatagtctgttgatgcgaaaaacatacactggcctggaagatctgtttaactcctgtgcaggttcaaaatctcgcctttagattcgtaagcgtgccagttgatttgatcttgcaatcaataagaaagaaagataagaaaaacacggttaaatctatagacgatagctgatcggctagttgccgatgatatatcatttatctctgagccgatgtcatatctgaatcgatcggcagtcattaatgaatgaaataagactaaatctactcgatcggctatagatattaataacatataatctctacttcgatacatatttaaactaagtgattgggatagatcggtcgctgtgccgagacagtataaatcacttaagtcgaaatatatactaaagtattaattatatagatgtttatagcatagccgatcaaaaagatctagcatgtaccagctaatactccgataccactctatactaagatattagaacaagcagaatatatcaaacaagaagcctaatataccttaatgcaataagatcttaatataaatggcagatttagcatatcaatcgaacatataggatataaagtagctaaatcaggtaagatcggctgaaaccccgatactatctctattaattattataaaacaggctagatatcacaattatagatagaacttaatagatcgaactcaaacttaaccgatgcagcattaagcataaagataactgtaggatctaaacaagatgatgaaaacttctaagagatggtagatacccgatacaatccaagttaacaacaaaacatagccctatcggttacttcttaacagcaagaactagccgatgacaagttatatagcacaactaacaaagattgtaaagtatatatgataactcgacgaattacataaacaagattagagtgtcataaagatggaagcactaatcccgagaacgcaaaccgccttgacaagtttacctctagttgaagatcgaatcaatgcagctcaacccgaaagcaagaactcgtcgaaatagaataaaagggtggcgatgcgccgaaagtgttattgaatgtgtgttatttgattacataggctcgggtcatatttatatccgagattacaagatatgtccttgccggacacgattcttatctctaacaaactctaagataccataagtctttgcggcagacttttgcccaaacatatctctaaagaatttacatgagatatccttattaatagctacaattgactttctaaaagctttttctccatcgtggcaatccttatgaagcacgttaattgattctaggaatagcctcgaagccatctttatcagaatcggctataccaactctatcggctgtatcggttatcctctgtccgatccatctcagccgattcagactccagccgatgccttcacagccgacgcatacgctgttcttcaaatctaactctttgccgaatccgccgaatccgcttcgattccaacgtcgaacctaattcatatcttaccaaatttggtcgttaacatagtcaaagttaaaaatgtttgacttgttactatgctaaaaatgcttatacttacacacacatatatatacatatatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatacatatatatatatacatacacacacatagacacacatatatatacatatacatatgtgtatatatgtgtatagacactaaaaaaatgttcgtgtgttacaacgggtaaatgtgtttttttccagtgatacaatagttactaagaattagtatcgctatatattataattgaaaccgcgctgcctcctacccctcttcgctctgtctgcctgtcttaacttccggaagaaagtttcgtgcctgtacagtgccgaagccgatcttcctttctcggtctcccaaattgattgagggcttttgatcaacttgatctcttctttcaatttttcctaaaaacgcagcgaatccacaaaactcagaggataaaaacaaccggggaaaaatcaccggccgagcatcattcactaccattaaactgagttgaaatctagtgaattaaagccaaattgaaagggggaaatcatgggggaaaggatgattgaggagtggagaatccatttttttaattaattagaggagaaaatgcatgtggaggtagatcgatgtggcggctgtgttagggttcggctcgggcggcacggcggcggctggaggcacacgacaatggtttagacacgtagagacgacatatgaaatcaaatgcatggaatccttgcttatttttttattaggtattaggtattaagatagattagagataaagataaatattagaaaatcaactaaaatgcggatgacgtactaaaattttagcagaaacatcttcaatttttataatatttttataatagtttatatataccccctctcctcctggtgtgcgcctccctctgctctcccatgcccttcctcctccctctcccttttttctttttttctcttttatagaaaattaaaaaaataaattagtgaattcaagatttgaactatgatctcacagtatataccaagttattcttaccaatacatccaatgatgatatttgttttaaggattattgtttgtttttttatcttactttgtgagaaaggaatatagtgatcgattctaatctctttcactaccaccataaaacaaaacatatatattattaggaaactcataacattttactatattcgtgaagtataattatcgtaaaagtacagtaacacgtcacgctactgtaaaacatataggacattactgcacttctgactgtaacactacggtgaaattatagtaaactaggaatcaaagcaaaaaaaaatattgtttaaaacatcttacttgtaaatattgttagtccaagtagcatctcaaagactgtatcaaaaatataaaaatgcttatatttttagtcggggagagtggtaaccaattaatgacacccaaacaaaagtttagagttttcccagctgacatgtaccgctaatccacatccaacctcctgcacgttcgcatccatcgttcgtgcaatcgtgctcattcattgcgcttgacccgactggctagacaacgaccaaacctctcctgacaaaaaaaaactgctcgcgttgccacttctgatcagctatctcatcatttgtcaccttgccttatactaactccatattttaacgttttgtctaacgtttgaccattcgttttattaaaaaatttacattattataatttattttattgtgacttgatttatcatcaaatattcactaagcatgacataaatattttcagattttcataaaaattttgaataaaacgaatggtcaaacgttggtcaaaaagtcaacggcgtcatatattaaaatatggagggatatattaaaatatggagggagtatcatttatcaccttgccttatacccctccgtccaaaaaaacccaacgtaggtagcgatgggacataatacagtataatgaatctagacatgagaatacccagattcatggtactgtataatgtcccatcactatgttaaaacgttggtttttttaacggaggaagtagctcttaaaaccttctcctacctaccgctccatcccatgaaactgaagtaaaaaaaaaaatacccctccataaaaaaaaaactaatcctaacttcagctggtaaaaaaaaatacccgtccatccttaagattagattttttaactttacaagtgtttaacttgtaattattacaagtgattgagtagtactactttgctaaaaaaatctaatgtgttcagagtttgtctttttagcaaaatagtacgtgtaaaaaagttcaggatacccagactgatacgaattggattggaacggaaaaacgagccatcccagatggtactgttgacacgaaaaaatataggtatggaagatctgcttagctctagtgcaggtctaaatcttggtgagatacgggcgtgatagtcagtttgaccctgcaactgacaaaacatacaaattgaagatcaatgagctgatcggttgacaagccgatggagtgattccagccgatgccgatactagccgatagcgatagagttttgagatgtcggctatatgtccaatgtagataatgatacttgagtaaataatgatataatgcaatcggctgatgataatacagtataacagtcatataatccaatagaaaccaatcggctaataatgatatgataggataagtactgatccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccgaaggatggggtcttcgccataacaagcccaactttgaagaggccaaaggggccatcccagccgctcaggcctgttcgccaattggcccattagaggcccatgtatccaaattacaatgtatacccaatcaaacgtccctttcataagggcagccatgtaaattcccctgtaaagcctaaatcctaatgggggaacctttaataggattataaatagcccctagggacatgtgaagtggggaacccaaagaaagatctcaaaataatacatgtactttttccaacactgttgagtaaccacgtccttcgatgtacgcggttgtcgcttcgacaacagctggcgccgaccatggggacctctgagtgaaaccactaagagcgaatgccaccgaagaatgtcgcaaaggagaaggttgctaggcgaatggagtgtgaagcaagaggcgagatggccgccgaagaggtagtagagccttcggcgcccgacgttgaagctggcgtggcaccatcggcttcggcacctgcgctgcaaccaccaccttcggctcctgccgcttcgacggggcaggcgccgaacacggctgcaacagcaagggtgctccagaccagggcggagatcctttcaacgagccaacaggtggcgccccaagctgcttcgccacagcaggctccgacttcgaccgcgctcgccgctgcacaagtcaaccccaacctcgacgcgcaggccgaagctgacatggaggccatgcgtcagaacatggcacgacttcaggacatgcttcgtcagatggaagggcagcagcaggcgtacgaagcggcccgacaagctaaggctgcatcagcacccattctctagtactcggcaggctataacccacctcaagtctatccgcaagcgccgatccaggtctttccgctgcaagtcatgcaagcgccagcgtgcttcgcctgacagccttcagccgtaaccatacacccatcccctcacgtacaagcacaagttcggccggttgctgcccaagtgcatcctccgctactggcacagacatcacaggcgatggtggaaggggtttcagcctggcaagcgcagtttcaagctttccttcaccagctcaactaaccccacaatatttcaagtacaaccccttcgatctgaccggaagggaatgcaagtcagggtgcacccagttggctaccgtcgaaccagcctggtccaggggcttcgccttggagccaaggaccgcagttcgaccccaacactgccattcaagcaccgaccgtccaaccacaggcgacggcaccaagcttcggaaccaatcaagcgccgaaccaggtcgccatggcttggacacagcgtacgttcgacctatccatggcggttccccaagcgtcgccgttcgggaccgggcaaccgaacacgatggcccaacctcatgcgcaagtcatgacttcacccttcaccacaccatatccgcagctggtgccgaacaagccagggggtgagaaggggctaccgctgagcaggggaatcaagattcatccaatcccaccccagtttaagttcccacctgttccgcggtactcgggcaaaacggacccgaaggaatttctgtccatctatgagtccgcaatcgaagccgctcacggcgacgaaaacaccaaggcaaaggtaatccatctcgctctagatggcatcgcccgttcttggtactttaatttaccagccaatagcatttactcatgggagcaattgcgcgatgtttttgttattaactttcaaggcacctatgaggagccgaagacgcagcaacatctactcggcattcgccagaggccgggggaatcgataagggagtacatgcgttgtttctcgtaagcccgatgctaagttcaggacataaccgaagcgtctgtcatcaacgctgcttcggccgggctgctcgaaggcgaactcaaaagaaaaatcgccaacaaggagccgcagacacttgagcacctgcttcgtatcattgatgggtacgcaaggggcgaagaggattctaagcgatggcaagcaatccaagccgagtacgataaggcctccatcgctgctgctcaagcccaagtacaagcacaggtcgccgaaccggctcctctcaccgttcgccaacctcagctgatgaaccaaggacagccgccgaggccaagtcaagcccccatgacttggaggaaattcagaactgaccgcgcaggcaagaccgtgatggctgtcgaagaagtctaagccctccgcaaggagttcgacgcccaacaagcgggcagccatcaacagcctgttcgcaagaaggtcggaaaagacctctactgcgcttaccatggacgttcttcgtacaccatcgagcaatgctgaaacattcgacagcgtggcaacgctcaagatccaaggcctcaacaaggagcagctgtcgaagcacctcgcgaggctgctcaagaacaagtacccccggccgaatagcgccaagacatgaagcgcagagtaatccaagtgattacaagggctgactcgccagcttagccgtcaaaactgcagaagaagatgtagctgcgaatggtgcacaacattgcttcggccgacgaaggggctccacggtacttgaatcagcaaatctctttcgggccggaagatgccgaaggagtgttgttcccgcatcaagaccccttggtgatcttggccgaagtagcgggcttcgaagtccggcaaattctggttgacggaggaagctcggccgatgttattttcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13233 - DNA, 784 bp, Oryza sativa
caactccactccaaactcaactcctggagttatatttaggagttggagctgtaccaaacatgccctatatatgcacatagtgagagaagaactatacctcactgggtggaccaccctacccaagaacaaggccgagaagatcgccgatccgacggtctgcgtcgggctaaagagggagaccaccacgggccctttcttctccagcgcccatgtctggaacatcacgcacaccgagcttactagcccgccctgcatacatacgcctccatgatccatccatcaatagtcacccgtagcatccttattccttacactaataaaacaaacattaacatgcatgactcatcattgccagttcacctcataatgttttttttctcctttttctaaagtctaaaccggtatgtatcaacagtgatacgatcaatcactactgattgctcgctaccggataataaggaacgatagtgatgctggttatggaattgagatttgcttgatagtgcaatagtaaaggtgtgtgtggtagtgttcaaccctaagatcccccattcaatctccaatacactcataatttcttcttaaaaaatatttggaaaacgtctctcctttcaaagctcgtttttttttaattatgctgattgcgaggtggtggtggccggttcaccgctagcctaggcaagcgctagtgttgatcaatttgcatattcatcattcatggtttaatttgatgtgttaactagtatactccttccgtactcgtaaaggaagtcgtttaggacag

SEQ ID NO: 13234 - DNA, 2718 bp, Oryza sativa
  unsure (1)..(2718): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatagaaacccccagaacccaggaaattaaaatagaacaaataaagtcagaagaaccaagagaagaaatccagaagtttgataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggtaggtttgcataatctagataatgcaatggaagctatggaagtagatttgggaacaggaaaaaggaaaagatacggagagagttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaatagtgatggggctatactaaatctagcagcacatgatcccatagactggccaaatatcattagtatttggaaggggttaatagttcaaaaatacatacaaaatcagcataatatagggaataaggtggaggatatgataacttatttagaaacatttttgggtgaatctgctaaagtcctatgggaacaatgggttgaaaagaatcctaataactacgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattctgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcaccattcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaatagagagttttaattatagatagcataaatgaaaatatattagtatgtgacgatgaaataaaagatgacgaatcaatatattatatcatagaaacagatgaaattgaaaacaccaatgaagagtatgaatcaaccgatgaagagttaaatttaattgacgaactagccagtttaaaaatagaaatgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtagaactagagaacctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaattgcctttcaaagaaattttgggaataagaataccggtaaaagtaaaactatcacccaaggtatcatataaaattctagcactagtagacactgggtgtacaaaaaatattattcatgataagtactttataaaatgtccagagatagttcatacaattgatgataataaggcagaagtctctacagacatgtccggaataaagaaaattcataatcagttagctcataatgttgaagtatacattaatggaactaaatatataatagatgagattacaataagaaacttatccatgataagtgatgacatgataattggcctaaggtttttacaacaatcggtacaaaccacagtaatacatgagcagggaattacttttattccatatcaaaacaatgtaccatat

SEQ ID NO: 13235 - DNA, 8365 bp, Oryza sativa
aattcctgcagcccatgaacttagtgagaatatagacatctattatatatcaaattccaatatagagtgcataggattacaagcatttgcaccaaattggtatagggatattaagtctaaaaaggatatagaaaaaattgttcaaagattagaggatattcaaattataggagaaattcctatgaaatattgggagaaaaacgctatcgagtgtaaaattaatatattaaacccagaatatattattaagaccagcccaatagaagcaactccgaaagatatagaagaatttaagatgcatatagaagaactgctgaaactaggagcaataagagagagtagaagtccacataggtctgcagcttttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtgatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggaaatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacgctaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaaccgattgtgaagccatctgtagatactataaccagcttaatagcaagaaaagctcaactagaagatggattttatttgaagacattattacaggaaatggttatagagttatatttgaacatattaaggggaaagataatagtttacctgacatgctttctcgtttacccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggacaatttctggtaccaatacaataataaaagggaagaaaaagggtatatgttatcaatattgaatagcctctctgaatattttcacctaataaatgggtcattaatgcctgccaatgaagatcatgaagtaatccaacagaagcctatatatgtagtatttgatggaagctccctggggtctacatttcttttgaagaaattgtggctcaaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacaattaaagaaggaattgaaggaagaaatacttaaagaattaaaacaagaaatggatcagaaattcgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaaattcagaagattacccaagaaagaatccagaagaattcagaagattacccaagaaagaatccagaaggacaccctataaagtataaggggacaatatagggtgcggtgaatgacatatccctgtgaagaataaaactttcggtggaaaggcctcgactttagccagctcccgtgaagatatagtagcgaagagataagcaggaggcacaggcgacgccatccctggcctctataaaaggagacgttggcattcactccgaagacacacaaccacgaagacaccattcagagcaaagcttccaagcgcgctctcaccctctattccacctttcttagtagtagttcctctagcctaccttgcataatatatattgaagcagtgagttgtaatataaaggtttgtaaggtgagaaaaacttgtttgtatctaccttcggggttcccgaaagggaaaaccgtatgtaagcctatttgcttaatatgaagtaattttctttaagtttccccgtttgtttgctctagataagcgtttatgctagggaccctataggagaaacctctcggttgttctcgtttttagcctgcatcttgcatatgcgtctggagaaccagtatccgtagagaagtgttcccctcgggtggaactgcctggggagacggtaaacgcttagctagttcaaatatgactagggatacctgaagttggttgcttaaataggcagataagtgaggcatacggctagtaccgagtaggactttaaaatttctaaatcaagcgccggctgtttttggattcgccaccctgcaaagatcctaaaaatttaaagaaaattttcgagtgaacagtaacctgtgaacagtatttctgtactcataatagtgaattcagcactaagaatagtagtgaatagtaatgaattcagcacatatatatttctgaataataaagttaataataatgtgctatatatatatatatgtgtgtgtgtgtatatatatgtatatatatatatgtgtatatatatgtatatatatatatatatgtatatatatatatatagacacacacatgtgcatgcataggcagccaatcggcaaaatggatcgtgggggccgggccgggattagctgatgccggcttctacctgtattaattctgccaggtgaagtgacacactcatacgtgctgtttcttccttgtcgggccccatatgattaatttggatgacttcacatatacgggaatttaactatttgccacaattatccaaatacccttcagctctttttttccctcttagatagtggcttcttaactatttaccacttttacccacgtgacataccaacgtggtaactcaggtgaaaaaacgatgtagggcccacttgtcattttctcctctcactgacctctctcccccccaactgtccagccggcgatgccggcgaagaggactagggcggcgccggagtggaggtcgacaaccgctacggccctctctccaacacgtgcccaatcgaccttcatggcgccgttcaagttctgcagcgatggccgaccgttgatgcgggacaacggatctatcggagtgctcgccgatagtgacccacgtgagcttcggtcagctctccgccgccttctcctctggcctgacgcccccagtcgctccgtctctatatatatatctatccacgtcggcatcgggaccctcggctcccccgcacgcgcgccctttttcctcaccgtcagtggcagatgccgctgtggagaagagcgttgggactcctgctgtgtgacacgagggcaacgagcacgcggtgttccacttcggccgacgaggacccacttcgcgcgccgaggagagtgccgccgcggtcgtcgaactccacttcggccacccccaacgccggcgtctgatagctggaggagagagatgagtgaaggggagagaattacaagtgggaccacaccgttttttcatatgtgttgccacattggcatgccacgtgagcaaaagtgacaaatagttaagaagccaccatctaagaggggcagaaaaataggagcaaatataagaagggtatttggatatgccaaacctaaagtggcaaatagttaaattccccacatatactgcctccatcctaaaataagtgtagccgtgggtattcatgtccaacgtttgaccgtctgtcttatttgaaaaatttatgaattttttttaaaaaaattatcacacataaagtactatttatattttatcatctaataacaatgaaaatactattaataaagaattctgggatgagttgtcacacgtaaagtctttacatctaacaaccaatgtctcatataagggccgacaaatattttccgtccccctcatcactccatccgctgctgagaattataatctggttcactcgataggagacatttggatcttaagcgaatttcgccttgtctggcaaggtttagtgtttggtaccagaatgatccaaacgcaccctatttgcgtgatttctgctttctcacgtactccctccattttttttctttttaaaaaaggagaacttttagaacgtgtttagactcgttttcaaaaattaaaaggtatacttattatacacgtatttcctcgaaacgactgtctgatttaggggtgcaagaaggtttacccgcgaacccatttaatcacaaaaatagtacgtaacccgccggtttgactagcgggttaactatgaatttgacttataaatgggtttatagattgattcacttgtatatttagatgtggcaagacaggccgtgacacgaaaacccataaattattatttatttaaaactcgtggatcggcccgcttgcacctctagtctgattgccctccacaccgttagcccctgtctactgtgccttcaattcacacggcacgacaactaattcgatcgttactctctttcctgtcgctacttttggaagtgagctcactgctcacacctctatagaggtttgtcttcagcacactagaaaaagaaaaaaaaaacaaggtaatgccttggtgagggtggttgctgacttgcctgtcagctgctatgctttagccaaatcgagaaaacggagttaaacacgacaaatgcgtgatcgagaatacgaccatgcgttatacaggggacatacataggcagtgacgcaactgcacggtattaagtcatgttcggcacaactcgtagatgtcagatgcacgttagatttgcagtttatatgttaaaattatgttggtttaaaatttcaaattttatctaatatagaaacaaaataatttatctaaatgttatgaacgtaatagttgtcatccctaccccaatctaacttgtgcattcaagtcctccacgattttaggccagcacggttctcatccaacagctgataaaaccatcaccgcacgaaacatatgggtgcatttgatagggcttcaaattctatgattctgattctaattcaccctaaatcgtataaaaaagagaatcagaatcaattcagttagctgcttggcaacaaatgttagcactatattactcttgtgataacaaggccagagattaacataaatatcatcggatcttcgttccataatataagtgattttgattagatgagaaaatctcttatattttgggacggagaaaaaagttaatgtaatgctaatatttattagaactacttaaaataaaatcttggtaactttggtggagcctatgggtctgtttgggggagcttctagctgttgcagctttttctaaaatcagattttggcttaaattatgagaaaatatagttgtagaatccagaaaatgaaatataagctagaagtggaaaaatccaaacagtccctatgtctttggtttgcgcgattctcatgtggagcgaggtttctgcttgtgccgatccttgaggagctagcgcgttgcgtttttattcgtttggctgggaattccaccgatttttcgataatcatacctcggtagttcggaaaaatttttgggtttgattgtcacatagatatacggacacatatttaaaatattaaacatagtctaataataaaataaatcataaattccatcagaaaactgcgagacgaatttattaaacctaattaatccgtcattagcaaatgtttagtgtagcatcacattgtcaaataatggtgcaattaggcttaaagattcgtctcgcagtttacccgtaatctgtgtaattatttttttacctacatttaatgttttatgcatgtgtcaaatattcgatgtgaaaacgtaatttattttttgttctggtattaaacagggcctcagattctagcagctcgtaaagccagagaggtctccttggccctcccaactcccaagttccccactccgccgcagcttctgtgccggccggacccccgttgtgccccgatttccgcggccgtcccgcccccgagcggcgctgccatctcgcattgccgccgccgccgccggtatggccacgggtgctgaggccgccgcggcgttatctcctccgggcgccgccggtgccgccgtcatgggagtcttcaagtacaacttcggtgcgtgcactctctccctctcccttctccgatccaagtctgaggttgatttcggggggtgggggatctaagtgcggcctcgttgttgcagcggcgcagttcctatccagggtcacccccttcctctacaacagctggttcgtgcgccagctcagcgccgacgactgcgcggtgcgggatcccctcccctcttcttgctcgctcgctcgctcgcttgattttatttctgtgcccagatgaagaactgaattgtgcgtttactcaccgtagtaaagcaaatgtggcgattttgttggaacccaagttgttgatttttgtagcaagctattgcatgattttattgtagggggttttaatagtgtgatttgggtttattttgaagttttacttggttgaactaaaagagaactgctctgggaatctagtccaccagcaaccgactgtgagaatccagtagatatgaacaaatcaacgttttgataatgctgtgtttcttatgtgcttcactttgttcaaatatctaatagaagcttaaactcctttatatgtcatctatctggcaggcatacgcgttacagcttcctctcttcatcaactgcgtcctatttttaagccgggaggggtttcggcgtgcatgcttgcgtaatgattctgacaggtattacaataactttatatggactttctgaagcaatttaggagctataagccatatttataatttctgaagaaataactaagcagtaagtctttttgtttagactagtcatagcatggatttatttattttaagcgagaaaatcaatctttaaaatgaccaacgtgctatagaactatagatactggaaagtgataaaaccccggtcacaatttcttgacctaacgcaccatatactctggctatagcttgttagttttaaaaagaaccatgtgaaaaatttgtgctctagtttcacttgtgcatacagaatagtaaattcaaagagaaatgaaccctttataatttggtagagtaattcaagaaagagaagaaataaagaaaagaaagaaatgtacctttattaggcacagttgatttctcataaagagttaattgtaggaagaaaggtaaaaggaagaacgattgcaattgatgccacaattgccttataaaccaaggtagacaaatttgaatttattagatgaacaactatgtgtttcatggacacacgatccatgatttgataaagcccaacacttatggggaatggtcatatgatttccatactctcataacagcacttctttattgttactgtgtgct

SEQ ID NO: 13236 - DNA, 15361 bp, Oryza sativa
ctgctgagggttttaatgcaacaactgtgagctaacctgtttgagtgaaatgaggacgaaatcccatgtgagttgctctctgtccgcaggcttatcttgcatgcgggctgtgcacttgtgaatttgagccctagtgtgctaaaacttaattatttctttataatcaaccaaaatcacattcttattttgcatacttgtgaaaatctattttcatatacatattctagataaaccttagaactgtacttgtggtagaattacacaatttcattcatttcttacaagtcctaacgtgtcatctcagcatactgttcaaacggtgagcaaataattgctttctattagtagtttgtatgcactattaattttttttctcaattttcaaccacttgaacatgttgaaacatgctctgggattgtaaaggtctttctagcaattgcattggaatatactctttaaatgatgatggttaaaatatttatattacagtggcaatgcgataagtgatgaagagatactaaaggtagcttggatgattgtcccatttggcatcttagtttcctttatcagcagcttatttgtgttgagggtaaagaaattgcggttatccgatacctatgctaaagctacattaattatcggtaagctttgtattaaccaagtttctgtacaagctttgtgtatttgtcctgaatatggtgactgatatttcatttagtataaattcgtcagagtgaatgagtcagttgattgaggataagctctttggaatgaatgaatcagttgattaagttagaatattccacatattaactcgttagtggtgctgaaatattatatcttccatgcaattgttgaacacctggctcttgatcaataaaatggagatgagcattcatgcaagcatacagttatttgtagcatttcaagatggtccttttagacatttatctatttgtttttctatttggatatgatctataaaagcacggctatgaatggctttgtctttcctgtttgtatgatatcactccacatgttttgccttatttttttcatattgtgtgacttctgtccactttcctcacgttgagagctaatgtatttagttgattcaatatgacagcatttgcttgcgtactggagctactggcagaacctctgtatattctctcccagaggaagaaatactatcaaataagagtgtatactgaacctgtggctactctgctgcgttgtttaacaacttttatcttcataacaaaaggacattctaaaatggtaacagcagaggtttttactctattgacgttctattcaacttattatgcactttctgtctcagtttgttatcactgataaaataaaatgcttaagttcacattgtttttgttgtttacacctgatactggtatagccatctatttggttatggttacattgtgaaagctagcaaatcaaaaagttccattgccaatttcatattgtgttcttttggtccatgcaccaaagaaaataacttggtgtgagatttctctcttagctacatttgttcagggttaacaggatgtgggttagagaggattaacttaatcaggttgtgacattttaactttattaattaggattaagttaacccacaaaaaaagtgaatatgataacatagaacaactaaacctctttagagttctatttttccaaatataagtgtataatctggctaaccatctaatctagccaaacaaagtcttagactgaccattctaattgccaaatcgaacaattaagctatatgtattttagacttatagtgttacttaatctagttattttcaactttaagcagatcaccttatgtttttttggttggttatgcctccattgtaaattccatgttaagttcgtctttgacaataataggactttacaaaacaaaaatatgaattctgctgagtgatatgtccaagtaatcttttctttctttacttttcaattaattggtgttcatctcatgtcattcttttcttattcaattgttgatcaacacaacacaaaaacaataatttatttcttgcaggaaaagttggttgtatttgctttgtcacaggttgtctatgcagcttgcattttctttggatattggacctattttcttatatttacaaataccaaaatttccgatctccttccattcaggttccttctatgtctgcctttgcattgtgttgtatcattaggttttgtttgatccatcacatgtttatgtttgtttccacttgatgttaaaacaaacaaattgtcaggttgtcagccatgatggactgcgataaacagttgttgcacatgtgcatgttgtttacaggacagactttcaggaaactgatgctccaagaaggcgaaaagtttgttcttgtttggtttgatactccatataaccaggctgcctatggtcttgtggataaattaggtaagtatgccgaccgctgtttgtttcagatcctttttatcttctaatgttgccgggtatgtgcaattcatgttttgtttatttgcagggagtctggttgttagaatagttttcctgccattcgaggagagttcttatgctacatttgcacagttggcatcaggttcttctgcatttacttcatttagatatgagaatcacattccttatccctttggtgtctgaacttgaaagtttctctgtgaagttttgtctaacatctctttgattggttattcaatgaaaattaacctatgttggctgggcaggcattgcaccaaacatggcagttcatccttttttttttttttaaaaaaaagagtttatttttttatactcctttcagaaattgtaactttggtatgtttcttgattatttgatccttacaatttagacttgatcattttccatatttcttactgcctgaaaatatatcttttggtattattgttgtttcatattgcagctttaagatacgataacttttccttgaaatgttgatttgaccaacaccagaattcatagcaatattgtttatttcaaaacaatatgttccacgcatatgtttagatgtatatttctgtaaaagctctaataatgggccttttatccacaggacaaaatccccagaatatatccaatttggaaggttctttgctcggagctcttaagcttattatgctgataggtttgttatccaatgttgaatgctatattgattgcatttgcgtgtgttatttactgtgtcctcttagggagtaagaagcaagcaattgcagtacatgtagtgtacagtaaacatgtttagtagctaccaactttattctctacgttctcattcgaatacagtcatccttaaagtgtcctaactttgcaggcttgggggtcatctcatttggtccaagttattcatatacccttcttagactactttatggggcaagatacagtgatggagatgctacagttattcttcgttactattgtttctacgtcatatgcttagcaatgaatggtttgtacttactacttctatttaccagttatatcatagtagagcaatgtttttgtacagtattactgtcttcatgcttaaattatgtattaaaaaaaatctgaaatgatgaactgtagttgacctttttgaattgagttagtgtaccaacaagtagcattgcttcttgtgttgatcaatagttagctatacttgatgatgtgttctatatttaaaaattgcacatattagcctttatacaaccatgtaattgggcatgagtaacacattcaattgattcctcatgaggatgcaatattgagttgcactgattatgttaatgtgtactttcaggcacatctgaagctttccttcatgctgttgcaaatgaagacaagcttaagcagtcaaatgatatgttgctcctgttctcggcaatttacattgtgctaaatgttgtcctgattaaatctgctggtgcagttgggttgattgctgcaaattccatcagtatcctttggttaatcactaccatcttatttcctttaaagtatcttttaagaactttctttgtgccttgactgtttgtaaagatatgctgctgcgaatcacatattcagcggcattcattaaagactatttcaaggtaagaggttcggttgatgtttcacatagtttgttttagtttctgttctaacaaaaatacctgatgactttattttacagggctcattctctttccgccactgcttgccggcaggctggggtgtgttgctcatttctggcctgaccacagctttctctgaaaggatgtttctgaatagaaacaggttcaagcagacccttcccattcacatggcgataggcataatgtgcctgggtttctcatcactcgagatgtaagaacaccatttcataaaaaaaaaatgtctcgctctttttatatgctataatataataatcaccttggcattcgtttctcattcaacagataccgtggtgaaaagcagttcttgacgagtataatcagatcattgaagagccgcgacaaacttgcatgagtctaacaacattcagggttttgcgagtgtttttagcattcgcctgataaccgcattttcagaaagaaaacatatacgatgccgtaaatataattgtacattgcatgggttgacgacagaagataattatgccaagcggctggaggacttcactgaacatggatcaaactggtcgcgttctctactggagtcgggttaatggtgtgtgcagcagaacaactgttcactaaacggcaacagaaagcatagatcagtggcttatataggcaatttattatcttattctgtagtaactgctgactacaccaaaatctaagggtgttaagagaaaaattgattatattttgttacagctaaaatatactccctctgtctcataatataagcgattttagagggatgtgatacttcctagtgatatgaatctgaacaagatagaaagtgtcacatccctctaaaatcccttatattattggacggagggagtaatgaattggaaaagaaaatttaacacatcgatgtaatataattttttttagatattttttatgatatttgctacttcctccgtttcacaatgtaaatcattctagcatttttcatatccatattgatgttaatgaatatatatatatatatatatatatatatatatatatattaatatcaatatggatgtgggaaatgctagaatgacttacattgtgaaacaggggaaatagttgctatgcatgaaaaccttatgtgcataagatatagtcaatcgtagagtacatatacgagcgttgcgtgcttcctttcatctcccttctcacgcttgatatgaaaagcgtgttttggtgaaggctgaaaatgcccatttgatataatcgcattttgagttatccggagcccctctacctcttgcctcccaaacctctattcgttgatgcagctataaggggatgtctggttgatgcctaactttgccataactaagtttagactagttgtggcatggtggtacaagtgtaacttagaaatagttggccacaagtgtgacatgcttagctctaaatttgagagcatgatatgtggatctcaaagtttagaaggtatgatacaattgtggcagcaaaccaaacacgtaactaagaaactgtagcatgactaaaatgtggcgtgaaaaagtatggcaaccaaaaaatatatgctagccttgcaacccgtttctaggaactacccgaccccgttcatggtttgtacgaggctagtgggggggagggggtgccctacatggctacatccatacgaccataatccatacatgctgccagctgtaggagagagaaacaaaaactcctttttacatatatttttcttctcatgtcaagcggcctgcagcatagccgtccttgagattctgcaacgcttcccggatgtagtcatcgccttggttggattgcttcaagcagatgagccgttgcgtgacctggtacgccatctggagcgaccggtactgctcgcagttgtcgtccttcctcaccatttcctgcaggccgggatcaaaacaggtaaacttgacttgatcaatgcgctcgagtagaagaaatcaaatccagcagcaggaacgagcaaggctgtgcagtcaaaaaagaaaaggacccaagtagaagaaaatgggcatacaatttgagttgcataatgtaatctaagcagtcacacacactgtgttatcaacatcagctctaatcagtactgagaggtttacctgttctgtgatccgtgaagtgatgcttgctgcagtgtcgatcactgaagaagggagaccagccacctttgccagcaaaagaccatagtgtggtactttccggacaccatccttcaaccggaactgatgcagagggattgtatgatccatgatgttaagagacatgaaaaaaaaaagtcatgtgactgtcaacgattcaggttataccttgaaatcgaggcggtcgtttctcaggtcgacttcaaaatggaggatcttcacgtttggatagatggttgcaagttctgacaagctctccatgtgcgtggcaaacaccgtgtagctgcattgggtgaaaagacccgacagtgatgcttctaagatagtaggatttgctcaacaaggatgatatcttgtcttaaaaggttatatctgtaactaatagaccatattgtggttggcaagattaaccaaacatgaccagctgcattcagcatgtcaagcacccccaggcactatgctgaacttactgctaatatctaacccaaaatataacaacttctagctatgtatctggacaaaagcgtgtcaagatacatagccaaaagttgctatattttgggacggaagtagtaggttctgtgataaatatgatatctgaaacttgatggtagcacggcctaaggtgagcacaagacaagtagtaaatgttcttgtactaaccattatcacgatcaaatatttgattcaagatgagaacatatggatatggttgaataaataggctacaaaaatgttggatgaggtaactgaataacagaagcctagacaacacatttagaaaagcatgcagtttcaaaactattgacaagaaaacatctgctgtgaatattgatactccctccagtcttacaatgcatattagcttcctcttcttgttcaaaaatagtaagcatgcatgtagaaaaatggtagtttatctcttctgcccttatctatttcattgtctgctaagaatttaagtatgacaacgtacacaaatcatcatctctttttcagaagcactcaattaaaaggcacataagttatttcatacagaccccaccaagttaggactgtgataagtcaaattatgctgcatgaaaaggatcaaatgtggtacttaagaggttaatagttcttacgctttggtagataatagatattcacagcagctccatgcaattgccaacccatcagaggaagacgtagctcttccaagctcatccacaacaatcaggctcctgtaagtgtgcaaatgtgcacatggtcattacaaggaaacaagagaaacagcaatccaatctattgcagcatggtagacccatagtacttcgaagaaacattctgcataatgaaagctgtctctttcatttctgtcatgaactgcaaagagaaattaagctgattagcagcattgaaataaactatacatcaattggcttcagactaattactaatactccataaaagatacagcattgatgtttttatttccttctcaaaaacgcaggagaactgtgcttcatttcattaagaaagcaaatatctacaagatgcctctcacaaaggaaaagctcgaccaactattgatgaaatatttgatttgatcgaagaaatattatatgtgaattgctttgtcaagtgtccaaggccaatacaacttgaaggaaggttataaatgacagtatacaaacaattcaaaagtccagatcagccatccagatattaccaagaaatggtatagtatgggctctcgcgatcctagataagatggttaatccactacttcaacgcgcttcttcatgtagagtcatccataaatatgacaaacaggtaccgatcttaggagttaagaccctccatatctaatgctatattaaggaaatccaccaaggaatccaaaaacaccaactactggaacaggacaatgcaaatgaccatttatacttcatatggacaagaaaacatcttaaatttgataggtttgagcacaatagagataatgtgcatcaggagatttaagataataaataggaattaatctgggaggaaacaagcctaaagaatggtactcaggggataaatattacttgaggactatcaacagtaacagttgaatgctttatctaatcattttattgtttcacgtgcttttagaagaattctgtaagtcaaataacaagataacataagtataaaccatatagaagagatgaatttgcatactgtgcttgagttattttcaacattgtccccagtgccaatccgtgtgaatacgcgatcaaccactcttagtgatgcaaattgagctggaacataacagccaatttgtgcaagaatgactattagacaaatctgttgaagatatgtgctcttcccactcctgcaacagcagataatgcagagagcagatgaatttccatatataattagcctgctatagacatttggatacaatgtttatggaacgcacatgtttggccccatgacaagaaccatattagatgcttcagacagaaagagattgttaggctgcatgatataaacagtattatgatcattgctatttcaatcaacaaatttatgatgaaaaagacatacaaatgaagtaaatactgaggaataaataacaaatgaagaacttacaacaaaatcattatgcaagctctcaagaataggatgccttccagcattaattgccatcggaccatcatctgcttaattggaagcaactgtcagatcaggactccacaacatcactaaaaaaaatccttaacaagatcagttactagtgttgaattgaattgcccaccagtgaattcaggtctcgtgtaacgatcaacgggcttagtagatattgtaaacgcaaaagaatttacaagcatgtccaacaggcataatacttcggcaagcaacgttaatataccaatgtcttctctgatctcattaataagccctgaaacaacagaacagatttatgcaagttaaatatttctttagacacttgaataatactagttgaaatgtaaaatgctgcacagaaacaagttacactatccacaagcttcaattccctttaagttcgtgagttgaattagtcaagtgtatgataccctcaaagtcccaccaattcagccaaaataagccaggaaagcaaagaaatggatggctaaaaagttcataaacaaagcaaaatgaggagatccctattctaagttaagaagaatgatgatgttctgttctacaatagctgctacctatatggaggatgcccaacaaatatagaatttgatatcccaatgcaacagatacattatgcatgcatgtattgcatgttaactctctagtttatcactagaaaattataataacaggtatctgataactggaccagagcttaacctatatcaatatcaacaaataaagtaacaaaactccaatggaaaaatgttgaatactcaatgtttagtggccatggcaaccttccaaacaaagttccgtgcgcaagaagcactcagcagcagcagacttattcctggcatttagctgcaaatttgggtagaaagcacatggtaataagtgaccgtatgaagaaataaactctccaatagcatattatattttttcaatgtcatatcctaatcgataaaataaaagcttatttcacgtgtagctatgatgaaattataccatacacttataaagaagaaaaatataacactgtcccaatgcttttggcaaaagaatagtttgctccgtgatgcttaaacaagatgataaactttctttgagggaaaacaaaagaacataaatgaataactattgactaacacttattccacttgaaaatagcatcccagagaaaataattacatggttaaatttgcagtgtggcagtaagtgttgaattactaaaaatgcccaaggatgataattcactggatgcaaacttaccgaagcaagctccaagcttgagcagtggacattcttcccatgtctaactacctaattgattacacattcacaaatatttggttagcatcttatggtttagctaagagggctggttcttaaaagggatatatccacatacctggataaatttattagggagcctttcagtaatgtccttctggggtacaataaaataaaatcctagtctgttgttatatggtatcttcaaatttggaagcttaaaatcctccctgtacttgttggcaaggttatgtatggctgaaaaatgcattatgtcaatcagctgtgttaggtaaaattagaaaacaaacatgaaaacgatagacaccttcgctggtatcacagaaagatctacgagcaacatcaagcagtccatcaattccagccttaatagcaaaacattgttgagtgcaggttacaaaaggagcccttgaatgaacaacatcttcatcaatgacatccccaattctaggatcataaaagaaaacatgcaaccaaatcaaaggtgaatggttacttttagaatgtagatggatatacttgttatttaataaatgtggacgaacatatttacagtcacataatgctaatatactggcaatattactaaaaactaaaaacaaatgtacaaacaaaagcaggatgggaagactaagcctgaagttagcatgctgttttcagtcttcattcaacttctcctttgaaatgggaggaaaaaggtcagaaaacagtacctctttctcatgcttgcatactttgggttttcacatatagtctgataaatgttgcgaagaaggaaactttttgcaccccttagaacctgtgatgagctacacatcacatgcgtgaaaaggtagatgggtatgtttctagaataaaagacatttacccttaaatgaacaaaataacatgcatcttcaaaaacaaaacaaaatgaaaaatcagaatgaataaattgctaaattgaatactaggacaaacacatctataacactaccttggagaggaatggtatggcatccagagctgtttttagaacaataatgtcagaaatcagcccttggctctttctaccattggcaggctttagcacttcatcagtatcctttttgggtttgaagcagaagtggcaaagaactttatctgaggcataataaaattatggaagttgtaacaccagcaaccattttacctattatctgtagtgttgcacagccagaagaggatatagaattttctacagagaaaaaggacataagttcacctgattcttttggaaacttacgaagaccttgtgtcaagccaaagaataattcctcattactcattagctcatcctaaaatttaagatataaaattaataaacatgcatttattggatatattactgatcattttcgatgataatattagtaactgaatacttgttatatcccagattccagttgactttcattcttgcaaaggagcgttgcatatcaatattacaagaactattgcttccccttctcatggaaatactttcacatatggcctgtggtgtacaatcatggttgcagtaaaattctccattatattgcaaagtgctccaacaggaaatgaactataaatggtacaaacatgattgtggtaaacccttcgagtaacgatttaagactatatgcactaagatttccacatgcataaagcagggttcatactccatgaagttagttcattcccacagaagatccagaacctagcctactagaagatccagaacttaatatgtgcaactttggaagtttcaaatgtcaggattaccgtatgaccaatttgatcaaacagacattccaatttaagaattgagaataacaaaaaagattaatctccttaccaagcaatccagacgagtattgattgtttgaatgtcttttaacggttgcaacaagttggctctcagtagtctagtcctgaacaagcaagtttgaagagaattgttgcagtgtgcttgatatttcaatacatagactacataaagttaaactattttgtaccatcaatagaagttgacatgaaactttttatctcagaaaagattgttcaaattgcaaaaatgaggagatattgaatgttgcagtgtaaatatatgtaaaaaagattagtttggagaatgggaaagccataccctcctgtagtctttgtagtcttcaacatctgaaagagacttttctttttgttgctagttccccacagttcagtatgaagagggtcaataatttccaatgtttgtacactgctaggtgcatatatggaacaatgaaggcaattcagatcgtgtagcagaaaattttaacttatattgtttctgctcctttggtgaagatgatttatcaagtgacagataatactgctcaatttaaccaaaagagtacctagttgagtcaatgttcatgtggtcaaatgacccattgaatgtaacctgaaaagttatacatacatatataagagaaaaatacggaaacatcagctaacatttttagagaaaacgtttttagagataatgtatgggaccccataatgtatagatttttttcagatcagcatagcccatagaagagtagtcacaaaatggagacttttgatacataatatcgtaagaatggccttacaggtgaaaaaaaggctaaacaacgatgatttatatgaaacaaaactctaaaaaacttactgataatgagtgattagtgataattacacctctttctgattcaatcctgcaagaagaaacaaagtaaattgtcattgtgatacttatcaacactatcaacatgagatctaatcatctgctatatttcggttttatcctcatttccgtccaatacgaggaaaaaaatagttatctatgaccaaaaaaaacaatatgagaaatatgttttgatgatccaagataagctttatagaatccaagtatccaacttgaaaatcctatctcagtttccatttcaatgtactaagtaacaacaaatattctggggcattgtataaatagtaagtagtatcatcaaatgaggtgcttaggcataactcctatgaaatgacatgagaagtaacagacaaattgtaaaataatttagtaagtacttgctttgagagttgcactgttgtagtacatagtaagttcatatgctccaattacactttgaaaaaatagaaattatgacacagctttgtcaagtcgttatgtccatattgaagcaatacacaactatgttcatgggagatacataacagaagttattaacttaatcctaaacagggaaaatgtagcccagcaatgtatcgagacaaagatagcacgcgtaccacttaattgttgcagaggcagcagcaagacaaagatagtattgcttgcaataagtatctaaaccgagtgcagatgggtctctagctgaaagattttttaccataacagcacccttaaaagaaaacaagaacatgcatgatgttaagcagcagttaatcacccaacaattaagcaaataaatggtcagaaaggaatacaaatcattatacctttgtgtcatcaaagcagccacgtgccattgttatctaaaaggtgaactctgtttagaataaacgaaagtgggttcatattatgagaaaacatagaacaaatttgcatatgtcagccatcacctttttatttgttggcaaatgtttaccaaccagctctgaaactccaaccataccgtctgctgctgttttgtttgggggcactattgcaaccataggatcatagaaatgcagaagtgtcttcgtattgtgatatgagcaactggtctcaatatactgagaaagatgcagtgaggctgatctcaaatcaaaagcagcaacaccaacctgcaaaaatactagtttgataaatcttcgtgatcttttggttcataataaagaaattgagaaataattaactccatgatttttgtttgtatgttttcaatttgagttgaattggatggtgtgcatatcaagttatcaactgacgtgcacagacaatctacacgtgttcatatcacgattttttttttccaaaactgacactacaaagaattcttacgttggcaaaaatgttgagatgcttccaaaactaaagatacacttgacttagaacaagaaaaataaagatgtacagagaggtcagcgtctcagaagatcttgttcattagtaaaccacaaaacaagtgtgtacaatggagaaatcattttcacaatctgttcatccataatacattatctaaaaaaaattcatccataataagtttatgagttgatctactacaacactttgatcaaatttctctcttctgcgccaatgcaccatgatccaatgaattttcctgtttacaatgaaacttgcaactccttcaaaacaagcctggagaacaactaatatatcgtagataaaaatgctttcccgcatggcgcatggtgctgttatggaaatggctttatcctttgaccgttggttatccggattcccaacttgtaagaaagtgccggccaaatcagtggaggaaaaaattgcaacagcaggtcactgcagtaattgtgcccacctctccaacaatttactgtacacatcacaccaactcgattcgaaccgctagagcagcactatcgaggacagggtatgctctaatcgccccggaaatggagctggagcctcaaatcctaaaaccaccaaaccctcaaatcaagccgctcagaacgccatataacacgaacccccccccccaccaccaccaccaatctgaccagctagagcaagtaatccacccgagcagcatccgatcgaccaccacccccgcgggagcgcgaacacaacacgcacgcaggccgacgacacgatcgaagccgatccgcggcgcagcgaagaccgagtagaacgcgaaacggaaaccctcgggggccttggaggagaagaggaggaagctagctaggcgagcaatccgacaagcaaaaatgcgtgcgggggtgtagggggagggatgggagggcgggggggggggg

SEQ ID NO: 13237 - DNA, 23582 bp, Oryza sativa
ggctccggcggcgtcgccctccatctccgcccgcgccgagctccgcgacggtggaatccgaagcggggaggaggagagtgaggcttgcgccagaagatggcgagagctctgcttttatacccaggcttgggcctgggcccatttgggaagagcggagttgaggggagtgggctgtgagactgtcacgtgggcccacctcaggcctcttttggaagcccaataatatctggcccatcctctctctctctctctctgcttgcctttgccttgcgttgccttaccaacagccgccgcctccaagctccggcgtccagccccagcaaagcggccgccgaggaaaccctcctctctcgccggcggcgggcgcatccccagtcacccgccccttaccggcggccctcccttcgctaagtttgctcccttctgaacagaaattcaaaagcaatcctcaataagggcccctttaatcgcaggattgagaaaacgtacgaataggaaaatcgtaggattttgataggaatataagtataaaacagaggattacaaaacacaggaatgaccgtttgattagaccacaggaaaaatacatgaattagaggagagataaagactcgaaggaaagtttctatgaggttctacctcatgatattcctccaaaacttgcatggcattaggcattcataggaatttcataggattccataagatccattcctttgattcaaagagctatataggaaaaattcctataaaaataaaatcctctaaaattcctatgaatttcctttaatcaaagggggcctaagttgctgtggttgctgagagagagggctggattgttagacgagagttgtgattccccccccccccccctcccaaaaaaaaattagagatatgataagttgccaagcgcaactctgcatctgattttatcctgtttctacgtatgttgtgactttgtgattatgtgattgtttacatttagattgactgaaactactcttagcccttactggaaccaatcagttcatttgtgctattagagttggtaaatctcgttgtttgtttttgtagaggtttaatcgttctattttgttattgtttattctattagctgggcacttagtatgcataatttgctgtcttgtaactttttcccctcaatcttaatgtcatttggatggcctcctttggtcattcctgtaaaaaaaaaaaagtgcactgtagtttaattcattgtggaaatcgtttcatttgttgatcggtttgcatcggtgtgaactttgatatatttagatagagctgattcaagcttatagtgagaactgcaaacagctgtgcttagggttttccacaaatttttggtggggagagatgtgttccgtagtgacgtcatgcttgtagcagcattttttggcttaacatacaaatcttatcagctagcagtatgctatttgctaggatgatgtagtcttatactccctccgtcccataaaatcacgattcctataaacccgaggtgactttagcagcagtggtaaaagactagtatgccctcaccaaattacaaagtacaaccattaattaacggtaaaaaaaaagacaagcataaatttccttgtggttgtccttcccatcgtcaatccccttccaccataacagctgcattcgaacaagccacgtccatcagcatgcaaagcaagcatcggccacataccagtataccacacgcatgcaaggctccaccgccgccgccgcgtagcaaagcctccaacacaacggagggaggcgcggggaggtggactggtggagcctcgcatctgtcaattaagaacagagccaggaacagagaaaaagagatactacaagaactagcaagaaccagatactacaagaactagcaagaaccccgacgaatgaactagcaagaaccccgacgaggccgtgtccgctcgtcgccgccgccgccgtgttcgccgatcgccgccgccgacgaggccgcgtccgcttgtcgccgccgatgccttgtccgctcgtcaccgctacccccgaggccgcatgtacgcaagaacaccggcgtccgctcgtcgcctcccccgccagccgccgccacgttgagcaggagggatgtgcggggaggaaggcagggagggagtgagggggagcggcatggagaagggagggatttgcggggaggaaggcgtggaggcaggaggtcgcatctgggcgtgatttgggggaagagagagcgatgcgatttagggaggagagaacgagacgagaaaagccgaggagataaggtttctgcggtcaaaacgataggagagagagaggtggcaggctcctttcccatctactatggcccacaatctttttttctgtgcacagatcgtttttttttttttttacaaacctccccctccaggattcatgattttgtaggacggagggagtagatgataagacatcacataccatgatatgcttttgaataaacgaagacaccataagacagaaccatggatgtaccccattggccattgccgaactactgtatccattcaggaattttctgcacagtaaatgctgatgtccaagctatgcatgaactagttcaattttttctctgatctagatgcttcttgctctattctattatgatttacacatggtactccttaagtaaattatcttattatattttccttgctaagacaaaatacaattgatcctcttttagaaaatatatcacaaatattgaaaattggtctaggagatcaggatcttcatcctgggaccgttagatttttagatccatctctgagtgcatctggattgcgccttctacaccaccaaatccccattccctcctgtttctttattgcagctatgttattgcttgtatttgtatggttcagtgttctttatttctacggccctttttttttgcaagtaagtttctgcacagctttttgtaaatatgttgtggtatcctattgttgcctcgtcctaaaaggtggataggatatagcaccacatataaagatttgtggaccatcactcaggggcggacccactgtaattcatgggtattcaaatgaatacccaagattttttttaaaaaaatagatatatctatatctatatctataactaactaatataaatattagcatttttccggtcgtcacatctttacaccatgtgttttttcgtccgtcacactttttttccgtcaccgcgtgtccttttcacctgtgcgtcgctcatcccgtcccgtatgcccatgcccccttgaacgagatcaaatccgatccaaataaatcacaaaatcacaaatccattgaatcacaaagtcacaaatctaacaacaatgaatcaaaatcatccaagaaaatgaataaatcaccggcgccattgctcatcggagctcctcgccagctgagaggagcgcgcggaggagagaaaggatgagagaaacgagtggcggaggaggagagggaaaggataagggcggggcggaggaatcaaggcgcggctctctcggcttgacacgttcggcagaaaagcgaagacaattttggttcgctggttcgcatcacacgtggccgtgagacccacataaaatttgggtgtagttatatttatggcgtcatatttttcataaaaaaaatagtcggtatgtatttacattgtaagttcataaattacatatgtaattttagtatatttacaatgtaagtgctacaattacatatgtaagtctctaaattacatatgtaattttagtgtatttacaatgtaagtctctaaattatatatgtaaatgatatgcaatttaagtataattagtgtgtaatttcaattcaagccaaaatctttgctcgatcagttggtcagggccgctggacaagccactggagatcctaggttcgattctttgcagtacaattttattttcgtcaactaaaatagcacgaatcctacagttgatctaatggatcagaaatcgacatatttctagagaaaaatgtgtcgacagttttttagcctttccgtaaaattttccaaaatatcagccgtatataccgttcttaacgcaaaatagatgaataatcagtttttttaattagctaaattgaattttcatctagcgtccattttttatctctaacaaattattacagtcgatgctcacagtgtttgcactatggacattaaaatacttctaacttagggggtgttgtttagattgagaggtgtaaagtttggttcgtcacatcagatattatgcagggtgtcgtatgaaatattggaggcctaataaaaaaaactaattacagaatctattagtaaaacgcgagacggatttattaagcttaattaatccatcattagcaaatgtttactataggaccacattgtcaaaccatagagcaattagacttaaaaaattcgtcttgaaaatttatcgcgatctgtgtaattatttattttttcagctctaccgtgtacctaccttactatgcaacccagaccagtcccgtgcctgcctgagttggtcgtgcgagactgaggctcgcctcagttgcggaggtgaacctaggtgggggagcggatagctgacctcagcccaccctgtgccatcaccgccgccaccatcaccttggcgtcgctggcacttagtattcgttcttaggtgattgggtgagattgcacatcgtattctgcgcgcacactttccaaactactaaacggtgtattttttacaaaaattttatatatgaaagttgctttaaaaaatcatattaatctattttttaaatttaaaatagttaatacttaattaatcacgcactaattgctcacctcgttttacgtatcttcccaatctacttctcctcaaacacagccttagtgcacatgggcacccgactaggtagacatgatatcaattcgtggcacaccgccagcttgacctccgtcggagccatgcgtggcctaagcccgctgcgcaagagcacacagtcgccgccgctctaccaaatcgccgccaccatcacctccctcctcacgctggagaaatcgggggaaagggtagaaatggcttatggttaggtttttcaggaatggggtgttttgtcctaagctcatgaaatctcagttgtccgatcaatatcctaccgacgccgtcaatcgtgccgactcacaccacgacttttttttatttttaatttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctaggacgattttgtactgtgcggggggtcgcctgcaaatgggcggccagggggcatgaaattttgcaggcggcccccttgctgccctgggggagggcgatttttgcctccccctataaagcccagtcccccctctctgaaatttcattatattcactaaaaatccaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgtttttatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacgatatgtggaaatggcttttgaacggtcatggcccctcgttatatttgtgtcggtacaagagaaagatataaatgtttcaatgcaaaccgaagatgtagagggtcctatcaatgcaggggatattgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctgaacttgttatatcagagggtgatcatgtaccttgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaataagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattattgaattcatccttcacggcacgcaagcgtactttagggatcgatacaagaaaattggtccgtccatggccgataacaacatagtgtttagcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatgttccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttatactagtggtattgcgaactattcggtgttgtatcataatgttatcgtgatgagtgttcggactaagtactcatatcgtgtaactgcagttattgttgtaattagaaatattccgtatggtgacacttttgtttgtttgtactcttgtttaatatgtgttagtaattcacttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccatccacgcacgtcgcgcgagtggttgcgtgtcgacccccgtcacgttccttggtacgcgtatgttcacatttcaactcaactttgctttgtgttgtacttatgtttgaagtttgctctatactggttgcgtgcggcaggccttctaccactttgtaggcttgttgagggggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacggccacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcacagcgcgcagtggccagaggacggtcccacgatggggacttactggtgtcgacgtggggttagtgcaacttcgctgcgttataagtttatcagtcgtcttcttttttttcttcacataacatgtctaattctgatcatgtttattgcagcgtcgttacgctcacgtccaggtgagacgaggttacccggacttcgtgttcgagtttgaccatctacagccgagcgacgtcatctgggagccgtacatagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtattagctacagaggaggtgatcaacgagctcttcccacacacggaggagaactaccgtgactaccttcgctggtaccttcttcgcactcgtgcgcgtgtgaccttcactccagacaccccagagccgcacgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgtgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttgtgcgaaaacatcaccccgtcgtaacttgatgttccatcctcgcaggacctcgtttgccttcgagcgcccctagcttcggagcagtgcgacctacagcaccggtttcgcacggtacagtttagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattacatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcatacatgaaaagaggcagctcgagttgtcactatcaactttcggcgctgcctgttgacatatagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgatcgtctcaactggcgaagcgatccttttgctggttggtttccaccatggtgtgaccgtcctttgtgctattgtggggatggatgcatactcaagtcttccctcatgataaaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactcccccacgtggcgtgagcgaccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttaaactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaattcgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttgttagtgccaaaacttgcttatattttggcactaacaaaatatttgtaccgtaacattccaaataggccctaaaaaataataaaattgtattttaccagtcttggagattttaatcttgtatagttttcaacataaaaagatttgataactattgatatttataaaaaaatataaagcacagtataaaatcgccctcccctagggcggcaagggggccgcctgcaaaattccaggccccccgctgcccatttgcaggcggccccccgcacagtacaaaatcgccctagcggagggcggcaagggggccgcctgcaaatttcgttgacggccgtcgcccgagagcgaacggaggcgacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaactcctcacaccaccgcaagcaacaacgacactggataatgggcctgcgagtgtatctgggctgcacgtactcgcacgcggcctgcttagctgctaaccgacatttcggccgctcgcgcttgcctggggtctactcggctgctcgcacacgatacgggccgcacgcgatgaagggcctccttgcctaacgggccgcactggccgagcctcgtgcattatcgggccgacgcacgcagttttggaccgtcgctagctttcgggccttattcattttgcctttatttttttcgctaaaaatcatttaatgtttacataactaatttttaatcactttgaaccatcattttaatatatatgaaattgttgtgcaataatttgcttttttataatgacatccgtttcctaatatgtaaagcggtataaaatttgaagatttgctacgtatggaccaatttgagattttgtacactccgtttcgtccgtatgtgcgagacccgatggttttttttccgcacgcggttttctcttggaagtgtttttttttatggactggttttttatccgaccgtttttttcgtgggtggcgatttcttttcacggtttttttttggtgagcccggttttttccaccaccgttcccgatcagttatttgggtgcgcacgttgaaggattgattgaagcgtaaaccgagttagatacaattacatagcttaggaattacaacacaggaattacaaagtccaagaataagaattacatggaagtaggatacaaacatcttcttaacctatattagaaaaacagaaaacacaagcaagactcgtatatgcacccaatatttagtatggatactaagagtctcgctcgacgttactcatatatgcacccagatttaaaaaaaaaacagagcaatttcctattggacgtgatgcatctgcttttattgcatttaaataagtatgcaagcaatattgacaatccatatttatttgatattcacccgttgcaacgcacgggcatatttgctagtaatggatattttgaagcaaaccaaccagccacctgaaggaaacctaatggtaagggtatgaaagagatccaataagaaagagcctccgccgcccctagggggtagaaccctagcctccgccgccgcccctcctcctccctcctctgtgcttcgccgccgccggagctcgtcgccggcaaagccgggcgacgcgctgggatggcggcggcggggccatcctcctcggctccacctcgccccggcgcgggcgtggcgacgatggcggcgggacggcgaggtcgtggtgacggggacggcgcggcgttgggcgcggcggtggggcgctcggtgttggctctccgcggctccagcgacgggcgactgcgtcgccagatctggtctccccgcttggccggggtgaccggagatgggctcggtcgacgccggcaccgctccgcgaacctggcaggagggtggctagcggcggcgatggtggcggatgtggcaacgacgaagttgccgacaacggcggcggactgcggcgtgtgccgcgacgccggccctcgtcaagaacctcgccaccacgaggaaggcgcggcgccctcgtcaatgctccggctgtgaacaccgtgcccgtgatgccttcctccatgatgccggcgacccgcgcttcgcgctgcacctccgatccgcaccaccccggtcggatctggacggctggcgtctggcggcgctggctagcgacggtggcggctgacggtggcggctggacaggggtgtccgtggcggtggcgatggtggctgacggtggcggctggcgacggtggtggctgtggcagtggcggtggcggctgtcgacgatggtacctatggcggcgatggttaaaggccatcatccggctgacggtgcatcgtcgtcggcggcggtatgtggaggcggggaaggggtctggcggcggggaaggaggagtccgggtgcgggcgcgccatcgatggtgggaacaattgtgggctgtggcctttgccgaatcgctgaagggacaatgttgttgaccgacaacgatctttcttgtgcggattggtggtgtgggtttggacagggaatcgtgggcgaaagccttgctgagccatttggccggctgacaacgacgacgctgtttggcgtcgttcccctccttggaggcgttgttttagcatacccatttcctttccctaccatattctccgggtgaaaaccttgcttcggttccgaacgagcggtggcggcgatccacgtcgcatcctccttggggcaccgctttggagaaacctcttcgtacaaggatattgtcattggtctatgcattggcttcgaacttcagtcttaggcctggacgaggccttctagctccacattttgttttgcttttctctgtttgggtcctctcttctcttgtttggtgtgttcaacttgtcttgaactacactctcttctgaagtggatctttgtaataattggctatagttatttttgagcaaaggccgggatattatattccattatctaaaaaaatatgtatatataggaaaaaagaaaaaaaatgcatatacacattcaaaactcaaaagaagcccaaactgaaaggattactaaccctcccaccacccaccatttcaggcctattggcccaatagcagaacaaagcccaaatgcatttctaaccctatctcttctcagttgagttctcacctcccccagccgccagccgccgggcgcctaggccgaggcgccgtcgccgtgccagcccagccgcctgcccgcctcgccggtcgcccactcgccctgcgccccgtcgcccgtggcggcacggccccccggccgccgcgcgcactcgcgcgtcgcgcccgctgacgctgtcgtgacgccgcgtcgccgcctcggcgcctccccggtccggcgaccggcggtccccggtcaccggccagcgcagaactgcagcagcggtgaggaagaggaactgtcgaattgactaactgaggatattgcttgtagcttgttcttgatgagctaaatgataagccacatatattctagatttctagtaatctagttgaaagtaatttcaggaatttgattgtcttatgcttgttcttgatgagctaaatgatgagccacagatattctagatttctagtaatctagttgaaagtaatttcaggaatttgattgtcttatgcttgttctttgatgataagccatagagattctagtgcatcattggtttttacaagttcccttctctgattcagaatttcagactgaagtatattggttattttagcttgtgaataactatatagattaggatttagaaaccagtgctgctttgctcaattgctctttgatattgttgtttgtatgtttgaaacatgaagagaaaaaaatggtcccatggttaatctaaattttttttagaaaaagctgctgtaaaaaagagaactcaagaaccaactggtccaagtcaatcattttcaaaatattaagaaacggaaagttctttaaattataagatttcttatcattttgccattttgtatgctctataaatttgatatgttttgtcatttaatagtttagtactatactctaatatgcttaacgcattcaatttatggtcaattctatccatctatgactttatgaaatcatgtttataccgttacatattatacaactattagattttgggttggaaaattttttctatctctaataatttcgaatacccaagttgaaaaacctgggcctgcccctgccatcactgtacatttctttatggtaggaagattcatgaattcttgttacatgattcacttacagtttcaaattaaatggcattgttttgtagttatataatggatcctaaaatgaagcaacttcaagaagcactggttgacattgaaactgatgcagagcagcttcttctggcaaggcatcaggtatttatgagttgccgacttgcctttttcttgttaatatgttagataggtattgatactgataactttatgtttttctgtgataaccagttagtggaaaacgataggataaggaatggtaatagggaagcactgacagccctccggaaaagagccaagacaaccaaaactagtgttccgaccccctttgaaatcataatgaaagggttggaaggaacctctggcaagcagctggtaaaggagatatgcccaacatgtggagatcatgaccccaaggaagatacatggttaatgtttccaggatcagatatctttgctcgtgttccatttcatgtggcccacactgttctagacaaaggtacactcttgatctattttcaatactgttgaggaaggcctctattgtccattttaaagtgcagcaaggattaaaaaaaaattattcacttgcggttgtgtcatctaggagcataacttgttcttttgtcaaattaactcattgtcttcattttcataatgatgcagatcaagaacgactagactatgacaccaagaagctacagagctttgtgaaggagaaatcgtttgtgatatcagagaaaggtgcccttgcagacagaatcagccccggcatcgtgaaatccctcgtcagccttacagataaacccaagtaggcacaagagagaaggtatcagagcatgtctgtctgctccactcggcaagaaagctgtgcatccactgaaacgaagcatccgttgggctcacctgtaacctgttgtgctatcgactgcgatgttgttttttgcttggaacatgtggccctgtttttccgtgctgtcattctgtgacattagctaggctgctgttgattagtttttaggcaacctctaatcctatattgttatgaattgtatgactaggttaggctatatgacagtacttcatttcaggcgcagttttcatagggaagtctgcttctgcatgtgctagtcgttgatctgaaaattcaggtcttacaaaagtttgaccagatgataatacccggggttttttttaaacctttgacaccgcaatatttgatgttgccacaagtcattattatgtcgtggtggttttaacctatgccacaagtcgtattatgggcatgttcactttgttgttcaacaataccaaattttagtaaaacaacaaactaaacacattattattgatgctatactaccaaactttaataattctagaagttcccactattaaaaagtctaagacattaaactaaacacaaccaacgctactgaaatttggcgatacgaaaatgtgccaattttggtattgtagaaagtaaattggtattgtagaaagtggataagaactgaacaagccctatattcgattttgtgcaacttttatcatatatgattttctgaaattaatttggtttgttggcttaccaaaagcaaccaaaattagaattgattttagaattttgaaacttcattttaaattgttttggattttttttctaattttcagtatccctcattctaagtcattcataatacagataacaaattcgctattataattgcttatcttttggtcctgtttggtagagctccaactcctaattttagttccaagagttaggtctggagtggaggagttatggagcagcctaaacccaactccaactctctagttttttcgggaatacgcaaaaggattgcgtactttttgtattaagaggaataaaatttatacaaacggcaaacaaagaagggagagagtgagaaaaaagagaaaaaggaaaacaagcacttaagcctactctcgctattacaatgtgacgaccgaacgaccaaacacgctaactagggagcactagcaacatgggatgggcaagatgccacagggcggcctcttgcgccatggctgtgacaacctcaggccaggaccgggaacggttgttgaacacacgattgttcctttcctttcaaatggaccaagcgccaagagtcacaattgtatcgaacccactacgacgctccctcggaactttgagccggcaagagcagtgccactcatggaaggaattagtgccagaggggaaacactaagggagaccgaggctcgaaaggatagtccaccatagctggagggactccgggcacacaatcagaatgtggtcgattgtctcttccagttggtcgcagaaggcacaataggttgggtgcggcagtccatgcttctctagtcggtcagccgtccagcagcgtcggtgagcgaccagccacatgaagtagcgacatcggggcggggcaaaagatcgctagattggcaggtgccgaaacgagatcctgcccgagaagaggtcaaggtaagccgaccgggtggagtacgaccccgaactctcccacctctagatgaaagaatcaggatgaccctcttagagagttgttgttcacaacgacgaccaaatctgcaagtattgcaggattgcctggactcccaaggagccatggagatcgcggattcaatggttgttggccaacgcatcagcgaccatagagctcgggtgccaaagaactccaactctctagttaatttatgagagagtacgaccccatttggcacagctccagctcccaactccaacttacctagagctagagttgtgccaaacggtacaaattctctgttttctggagtggagtttgcagagcagctccacaattttgtactacggggatggagctaggtttttctgctccacagctccacttcaccccaaaagacccactaccctttaattttttatgtatttacacaaaaatgccattgaactaccctaaactcctcctcccattctctctcctcccatcttctccggcaaaatccggcggcgggcgggctggcggcgccggcgccggcggcaaccagcggcggtcgggctcagcggcgcgcgggctggtcggcggcgcgcgggctggcggcggagcgtgggctggcggcggcgcacggggtcggcagtggcgcgcgggctggtcggcgacgcacgttctcagcggcggagcgggggctggcggcggcgtgcgggcttggcagcggcgcgggggctggccggctggcggcgaggattcctttttttttcttttttttcaatttttttcagatctggagctaaaaatttgccaaacacttttgatgggtctgcaactccaataggagctagctccaactagagtagaagtttagagctgggagttggagtttggagccctaccaaacggggccgtacattcagctctactctaggtagagctgaaattttttgactgagctgtagagctgtgccaaacaggctctttataactgtttatcaactgtatcccatatatacatgatgaagaaaaaagagggctagacggggaggatgcccaaaaatagcggcgagcgatactgcgcatgcgcgcggaacgtgcggtgcggagcaacgtggtgggctgagcgagcggacgaaagcgcgcacctacacaagcacgcgcgcgcgcgcgccaaagaggaaaccgctgggtttccgttccacggccggggcgcgtggcgtgggcgtgtggtggtgccgtgcgccgcgcgcgcgccctcttcgcccttgcctgccgcgcgcgtcgtccaatggcgccagcggccaccggcggtggcggcggcgaggacgacgcggcggtgccgctgctgctgcccgtgctgccgccggcggcggggtggtgcagctgggagtgggaggacgtggcgatctccgcggggctggtggcggtgcagctcgcgggcgcggcgtacatggtggtgctcgcgccggtgctggcgctcggcctcgacccgctcttcctcgtcaccttcggcagcctcgccacgggcctcttcaccctccctttcgccatcaacctcgagaggaagagatggccgtcgcacctcaacgccaaccaccttcttctccgcctcttcttgctcgccctcggagggtatgcatgtataacatgtcaatcgggaagtggattttaatatatcctctcattgtttacatcgtttacatgtcacttaaatattatgacaaaaactaagaaaatgtattaacatgtgatatatcgcttcataaatatacaagaaaaaaatttaaacttctacgtctcgcaacgaaaaaaacaaatttgactctaaatatacgttaactagttgtggtttaatttgttttttttcattacgagatgtataaattgaatttgaacttgtatgtttgtggagtattatatcgcgtattaatacacctttttttatcacaaccatttaagtgacgtgaaaaaaataaagggatatccccttgagagattaaaatagttttcccgtcaaacgattattatcacattttgtgcaaaacatgtctgatgacagatttatatcgatccttgtcgttggctgcagggtgacggtgttccaggcgctgatgctgcacggcatgaagaagacgtcgccggccatcgcctccaccatgcccaacctcgccccggtcttcatcttcgtcgtcgccgcgtgcctcggcttcgagagggtcgacctcagctgccggtacacgagggccaagatcgccgggacggtgctgtgcctcgccggcgccgtcaccatgagcgtcctgcagagccccgccgccgccgccgccacgcgtagcagcagccacaggacgacgacggcggcggcggcgaacgccggcgggggggactgggccgtcgggtgcgcgtgcctcctgggcgcggtgctggtggtgtccggcaccaccgtgctgcaggcggccaccatggtgcacttcccggcgccgttcacgctctgctccgccacgtcgctcgccggcgcggcgctcacgggggcgttccaggccgccaccgccgcgggcgggctcagccccggcacgccgcagatcagcctccagatcatcctctccctcctcctcgtggtaactacttcctccgtccctaaatgtttgacgccgttgacttttttaaccatgtttgaccgttcaccttattcaaaaagtttaagtaattattaattcttttcctatcgtttgatttattgttaaatatacttttatgtttatatatagtttacgtatttcacaagagtttttgaataagacgaacagtcaaacatgtttaaaaaagtcaacggcgtca

SEQ ID NO: 13238 - DNA, 13251 bp, Oryza sativa
atccatcaggtgatcattataacacgtccagtaacaataatgtacatcggaagttcaatgaaatttgcaagcacgttactccaaacaacaaaatttggaacaatattgttttgctcgatgtaagcaataacttaactaaactctgtacaatgaaacagtagagtgtatacttttcttgaaatcccaatctcaggaaagaatgttgcaaaaagtatttgtgagcaatgttggattctaaaactctgcagagcctggaacccggggaaatggaatggtgtctctaatgttgtccattccagttgcaaactgtactagtctttcaaatccaagaccaaaaccagcatgaggaactgttacagaaaaggtggaaattcgttatggatcatgacaggggggaaatcatgctaccgaataacaaattttaaatgatctgtaatgtaaaaggagaaattgcattatccagctcattttgatatttgaaatttaacctgatccatatcgacgtagatctaagtaccaccagtagctatctttgttaagatttaactcatccaagcgagcttcaaggtaatcaagacgttcttccctttggcttccaccaatgagttcaccaacctgaaattgaacaggaaaagagttatattacaaatcaactaattcaaatatgctagaagctttgcctccattttgtctatttatatactcggaattttacatatgatgtattgtttgagatgtcagctattggtgtatatgcttacccgaggaaccaatagatccattgcagcaactgttttaccatcatcattctctcgcatatagaaagctttgatttcctaagcaaaataaaaggaaattttgaagtatgacaactttgttaatgaactagttaatcacagaccagtgacgatataaacctttggataatctctaattatcaccgggcgcccaccaaaagcaacttctgtgatatatctttcatgctcactttgcagatccaatccccatttgacctatggatggttcaaaagacaaaagaaagaggcattatttttgtaaaataatcactcgcattcttgcatttacccatttgcctactcagggacagttgttgaaggatccacagtacacagaactgagtatgtagaagtagaaaacaaacaggtaattttgtgcacactaattaaaattaaacaaatcaaattatcagtaactacaaaaagtataagcatttgttctatcaacaagcatgttgacatgccatccaacaccaaagacagatatgcagtcaattttcgtttcctggttaggactttaaatagaacacaaggaacaaaattgtaatgtagtccaaatgagaatatgagaatataaataattgaatttgtgtgttaccgggaactcaaatttcttcttggacccaacaagtagctcaatagcatcagaatatgacaagtgaacaaagtttttctcaactacgtcctgcaagaagaaacattttcaatatttcagcatgaaacttgaccaaaacaatccatagtgcagcaacagaagaaagatctgagaggaatacatttaatctatcgatgatccctttttcaatccatgtattaaagaaatccatatcttctttgcagttctctagaacatacttcacctgtatcaaacaagcagtaactaggtaaatggtgtaagcatatagagacatcttccccacaattcagcaagtcagtaactgtgaagcatccataaaatattgtctgaatgaaataatcactaacagagttgagcaccaagcaaaaaagggcacctactacatactggagatatgaactcgcacatgccatgtcatcatttagatccgcaaaggcaagttcaggctcaatcatcttccccggaacacaaaccaacaaaaaaaaaacctgtaaattaagagttctggaatttaaaattctgaaagaaacataaatgtaaaagaatattgcgatacccaaaattcagccaaatgtcttgaggtgtttgaattttcagctctaaatgttggaccaaaagtgtaaacctgtagaataagcaatgtcaggaaacagaaacactggttacagctatatcaaatacgacagaaaattatttcaaatgaatctggcaaatgaaaatttacatctgatagagctgtagcgtatgtttcaccattcagttgcccagacactgtcagaaatgctggtttgcagaagaaatcctagcatagatacaagcaaataaccattgttacgaaaaccacaaagacattgaaacatttggattacttgaacagctgttggcatgcagtataacagagcatatcacaaaaattatacgggtaaatttgcttaaaatggggaagaaacatttgacttttaacaacaaaaggttgcataagcattcattctgaagttttacctgtgaccaatcaacccttccatccttagtagaaggaatatccttgactagagaaccaccttcagcactattcgaaatctgtatgacagggaaaaaaatctaacagcattaaatagaaacataatgaaaggggttatggcaattagaaaccaaaatggagagctctgatcattccatggaatatattgtaaacataaaaagataataagtgatactcagagccataaatatctttaaatatagacagatacataaaaaccaatcatgacaaacttaatcaactgttatagcagaactttaatgatttttaaataagtaaatctgtagatggaaaattcaaactgatttagcagtgcacctaataacatagtgaagctgttctaaacagacacagaagtacaaaactaaaagaaaacttcaagtagtttctgatttggacaagcatattagtacaggatgatgcggagcacttaatttcttttttttttgtgaggaaaaaaagaaaaagagcacttaatttctgaactggagcaaaaagtacactaatggttttgaggtaaaaatagagaagaccaaaatgtgtgttgcaatatgaacagcatgttagtacaggaaatgacattatgagcagaacattcccccagaaacagtaaatttgttacataccaagcaatctgtctatacactactctatagaatcttattgacgaaatactaaccaatgttgtcacataaaactgctcccctgctccttcacagtctgatgctgtgataatagggcttgctacccaaacaaatccgttgtcttgaaaaaatttgtgggttgcgtatgccaaagcatttctcactcttgccacctaaataagtacaacagtacagtaaaaattccatagaataagttacataactagagagatgaaaaatgttggacaccagccagcttcttcatcataagaaaaaggcactttctaacgcaaaagttcatcttactacaacacataaaactaccaacgtttgcactattttgatgtgcagaatatgatgctatatcagcagtttgttggattcttgccaatatgagaatcacacacatttcctgtccatggctgcattgatcatagtccattgcaattctacataatgtatgtatttcatcaccacattggcagatccatatccaaggttggattggacagaatgtcatctataaacatgccacttattttgtaatatttgcatagcaaaccttgtcacaacttgtatgctaatttatgagctaaattagggaattaacaacgcatctagaaaaggataatgatgagcattttgtagaaaagttgtggacagaaagggcatgatcatttccaaggcataacacaagtctacagatttagtagcttctgagcaaaaaaaaagtatcagaaaagaactagcaatgagtaaaatcatactgcgccaaaagtatttgtccgaggacggagatgggctacagttctcagaaattctcttgatgcccgcttcttttgtataggaaaagatgttggatcactttctccaatctgtacaaagaagtgaaacctacatcagaacacaccaaaaaaatgcactagaagcgtgcttacctgggataatattgtctacagcctgataaagcaaaatgcaactgcagattctcaatcaacattaacagtctataggtctatccttttgtcatgccatcagaaatttctttatataaaaagaaagcataggggcgaatttttttgtgcattgtgtgttaccacgttagggatcatcaaataacttattcgatataggagtgttcggttaacgctcatatctgtctttaacaagagtacaagactagcatagtagcatacaaaaagagataccttaactactccacaagtattttcctatatcaataaattatagaaattttattttgatatctggaaatagctagttaactccagaatctgtccacatttcatttagatttgtgaggcacgcaaagaaaaaaggaaataaaaagcaaaaggaggaaactataggcagaatgaaaccattaccacactgatctttgaaaccttcaactccactttttgtttaccaccttggctgcttgctataactccttccactaacacagaggccccagtagtgatagagtctatctgacatccaccaatgaaaatattgaccagtaaaatgtactatagccacaagaacacattggctgcaactatagcaaggaaaataaaaggaattgagacataactagacaacgctggtgtcattgttggtgccatgtcacaattatcagagttttattttctgtgttcacaagataaccattggattgatcaaactatttttattgaccagaataacaaaacaaaattaacatgtattgtttctactatctagttgtaccctgattccctgaatgattgcttacctggtcgtagccttctgtatcaggagtcaatacacattgcatgttggacaagcaagaaccatcattaacctgaaataaatttaaattttaggacgcgttagagatttaaagtaaaagccaatagtcattaccattatttcagggaactttaaagtctccagatgacagtattaacatcctatgcattcagaatatgagatactctgattcattatactgtgcactcatggcatgcagattactagattagtattgctggtccatgaaagactgtctgaagtctgattactaacacaaaagtaggccttagagaaattgtcctgatttctaacttcaaagcagttaataacacaaaagtaggccttagagaaaagtaggcaagtaacatgctgtttggttggttgccacactttgccacgccacaattttctaggcatgtgtttggttcgctaccgcaattgtgttatgccacactttttaaactttgggacccacatgtcatgctctcaaatttagagctaagcatgccacatttgtggccaactatttctaagccacatttgtgccaccatgccacaactagcctaaacttagttatggcaaggttaggcatcaaccaaacaactaatggcacactccacagaactgctggtatgcaagtcaaacaggctgcaattctcatcaaaagaaggacgacttatcaaacagtcacaaaaatgatttctgtaatatctatccagaagttcagtcttgttatcgtaatttgtacaaaagtagtacaatgaaagctagtttagtacaatcgcataaccatggatcgaaatgtttcatgaaatgtaaaatgatcaacgacattggggaagcaatgtgaatagtgcactgaaggaaagcatcttttccagcactcccaattcctagtccacaatgcaattttatgcaatgtgcgcaaactaatcattcgcaccgttcatttcatcaaacacaagaccgctaaccattagcgccaccatcacgaattcacgcttcaaacagaaagggatgcgagagcgcaaacgcaaagcttcccctcacctcgacgaaggtgacggtcctctgggcgcggcaggtgcgcacccacccgcgcacggcgagctgctttccaacccacgcggcgccctcgtcctcccctcccttgacatccgccacccgcgtccgtctcctgaactcccccacggcctcccccgaggccgccgccgccgccgccgtggcggccggtggcgggggcggcgccgaggcctgcgcggcggcgcagaagcggcgccacctcgaggtggtggcggcgagccgggccggcgtcgggtggagcgggagggcggcgaacgggcacgccctgggtgggccctggaggcggcgcggggcaaggcggaggaggcgggtcgccgcggcggccgccatcggcggcgagcgcgggcggcggcggcggcggaggaggaggaggggggtttaagctatcgcgggcctatctgctttccttcccctttgagccgtccgttttgtggtcgatagaattacgctttcctgctctgattacgtagattgtcatgctgctaatacatgtcctttttttttttgttaattggatatatttttttttgataaaggaagcttttattaatctcagacgattacattgttgatagaaccatactaagaaaactcccggcctctgcataactaggatgcacacagccaaaacacacaaacccacaaaagagtttgtaacaatagaaggaaagcagtaaaaatcagggagcaccaatcttcaagctagaccgccacccatgtccctgggtaaaacattccctgaccacctgctccaagggctgacacgccgctgcaaccaaatcccgtgaaccaggcttctgaaggatagcccaggtacgaaggaagtggatagttaaaaaaataacctgtaaaggagaagagatttttcttttgtcaaacaccatatcattcctgcaaagccataatgaccaacaaatagtggctgcccctaacaggataagtgacttcaagtctttcctaattccccgtagccaattaccaaacatattggatacaccacgtggcgggaaaagccatgtagccacttgtataatgcaccacacaaaatgggcaaatctgcactcataaaacaaatgtaatattgtctcatctttgtgacaaaagcaacaattcttacttccttgccaattgcgcttagctaggttatcccttgtcaaaactaccccacgacgtaaataccataggaagatatttactttaagcggtatttttaatttccaaattactttgtttatgttgggcaaatctgaatgtaccaaggcaagataatgcgacttcactgaaaattctccattttgggttaaattccaatgaaacttatcttgatcctgagtaagaactaggttagcgattcgtggaagaaggttattccacaccactaattttggcccaatgagatcccttcgccaagatacattcggagggtaattttgtagcacttttgctacagtatcatgtttattcctaactatattgtatagacaaggatattgttctcgcaatggtgcttctcccaaccacttgtcttcccaaaacttgatttgggcaccatctctcataatgaatttgccaaatcgtaaaaagtcacgcttgaccttcataaggctggcctagaattgtgagtccccaactttaaactcaacttgtgacacaggttttgagcccaagtacttgttacgaatcaattgttgccagaccccatcggtcgtgagtagcttaaataaccacttgctaagaagggcaatgtttttcatatctaaatcatgaattcctaaacccccttgttctttgggtcggcacataatactccacttcgtcaaacgataccttttcttttgatcatcacactgccaataaaatctcgagcgaaaataatcaagtttcttaagtacacctctcggtattgcgaagaaagacatcatatacagtggaagactactaagcactgagtttatcaatgttaaacttcctcctgtggaaagtagtttccctttccagctactgagtctcttctcaaagcgttcttctacccctttccaatctgcatttcttagtttcctataatggataagaatgcctaagtagcataatgggaattcgccagaagcacaaccaaagagatcagtatattggtcttccatggctcgagcatcaccaaaacagaataattcactcttatgaaagttaatcttgagacctgagagctgctcaaaagcacaaagcagaagcttcatgttacgagccttctcaaggtcatgatccataaaaagaatggtatcatcagcgtactgtagaatagaaatgccatcatccactagatgagggactactccacaaatctgtccatctactttggctcgattgattagaataaccaacatgtcagctacaatattaaaaagcatcggcgaaagaggatcaccttgtcgaaggccctttttcgtttggaaaaaaggtccgacgtcatcatttacttttattgatacacttccacccgaaacgaaagactcgatccaagaaatccacttggttgagaatcctttcatacgaagtgcttgcatcaaaaatggccatttgaccttatcataagctttctcaaaatcaattttgaagatcactccatttagtttcttccgatgtagttcatgtaaaatttcatgtaaaatgacgacaccctccaagatgtttcgtcctcgcatgaaagctgtttgggtcggactcactacatggtccgccaccgagttaatcctatttgtggcgaccttagtgaatagtttaaagctgacattaagcagacaaataggtctatattgttgtatgcgattcgcttctttgactttcgggagcaaagttatcaccccaaagttcaaactgatcaatggcaattcaccagtatgtaattcatggaataaattcatcaaatcatgtttaatgacttcccagaatttctgatagaattctgctggaaacccatctgggcccggtgctttgttatgctccatgtcaaatacagcatctcgtatttctttttccaaaaatggtgccgttaggaattcattttcagcctctgtgacctgtgatatatccccagtcctagattcatctagcgtaaaagggttatcttcaggtggcccaaatagtttcttatagaaactagtaatgtaggccttgagagctgcttgcccctctattttcccttcgtcctgttctaggtagaatatccgtttcttcctgtgtttgccattggcaaccatttggaagtatttggtattattatctcctagacgaacatcagaagttttggccctttgaaatcactttgtctcttcttctcttagaagcataactagtcgatctcttgcttgagtaagttgatctctttcaacttcagtcaggactcgaacctctgcagcgatgtccaattcatctatggtcgattgcaaactttttttctcttgcttatacataccactcatatgggccgcccaacctcgtagatgcttacgcaaagcactcattttattgttccatcgttggaccgagttgcgccctttgaccggcttgttccaaatttcgacaacacggtcgtggaaatcatcacgagtcaaccagcttagttctagtttgaactgtttatggttcccgatgaaagccgcagaaccagtatcaagcaaaagaggagtatgatctgaaacccctcgctcaagagcatgtaccgaaactatcggaaatttggattcccactccgtggtcattaagactcgatccaacttctcataagttgggttggctaaggaatttgcccatgtgaattgtctacctgctaaagcaatttctctcaagtcaaaactgtcaattacagcattgaagagaaaaggccagcggtcattatatctattgttgtttttctctgtactactcctcaaaatgttgaaatcaccaccaatgagcgtgggatgtggattttgttggcaagcgcggactagctcagctaagaagctagatttgaattcatcctgtgctggtccatagaccgccatcaagatccattcgaatctgtcctctttgttgcgtaaatggaatttaacgtaaaatttcccttccacaatcaaggacaagtccattacagctgcattaataccgagtaatatacctcctgatctgccacgagggggaagacagtgccaaatgaaatctgcgcccccagctaggcgatcaagattcgtctttgacacatcattcttccttgtctccaataaagcaacaaaatcaagattgtgttccttaatgttctcagcaacataccaatatttagccaagtcaagtagacctctgctattccagaagatgcctttcatttacaaccttttttgttcttgttacttttggtcctggtcgattgacctttcttttttgaagcagatttggattttcgaggggtatctattaagtcacaaattgttgtgctaagctccgcatcatccaagtctacttcagaaacttccttgaataagtgagcgagtaagatgccatcaggtttggcatcctcatcatcaccatcatcaaaaggattttgatcattcgcttcatcaataaccttagctttcatcttagttttaggtgctactttccatctgtcaaccttcatatgtttaatagcattaacagaaaaggccacgttttcacttccactacccaaagaaactcctatctttcccaaattggaggaaaattgttcattggataaataaacaatggaagaagatgggaggttagaatgcatacctatagaagggtcaaggtatgatgtagacgaaagtgatgacttcgctaagtcagccatcttggacatcattggcccatccagatttctcatcgctgccctgcgtttagccttcgtcgttgaatcctcatcggccgctgcaatgccattagatgatatggctgcattgcagcgatcactatggcgaagcccttcggtcttttcctcctgtaaaggagtgcatggggacctcacatgcccgaaggtcgagtgcttgatggagctcgatccgggctgagtgacatgaccctcatgtgtataggcagcagtttgagttgttgtagtaggcactggtggtgtttgcacgagtgaagtaggcatcggcagggtcggcactagtggagattttgtcggcgctgatgttgattgcctcgacgatgccaacgggtctacatgggtggagtggatgccggcagggtctgcacaggagcggatgggggtggggtcgacgtgagcgaccaccccaaaggtgcaggcgtaggtggagacaccgccattgtcagcccgggtggagtatccatcgatgatgaagacttcggtagaagcacaatcaatgtcggtgcggctggcgcagctgttgaggtcgagagagaaacttctctccgaccgtatgatgtcgatccggtcacccttaacggagtgaccgcaatgtgctgcttgttcactctagtgcccaggataatttgctgtctctgtggcacagggcgacgatcctcaaaaggagtcactgctaactgcataggagttggacctgaaactgcagcattcgaactctccggtgtcgatgtattcgccttcttcttttttgctgcatgatcagcactacctccatccatgttgctaccattatcagtacccgcagaatcatgatccatagtatcattggatggggtgggaatggcaggttgaaaatcttcaggctcaatagtgtaaatcagctcatacccatgcttcccaaacacaacatcagtagtgaaagggaaatgttccctatccataatgcccactttgattcggatcactcccaacttccggaaggttagcatgtctacttcttctgtagccccaattacactaccaagtgcccaaaaaccgagataatgccgccaagcatgaggaacaccggtgacatgcacccatgccatatccaattcatatgagggaataacatcacctgcttcctgccactcggagatcgtcagagcaaccccatgattctttaggcgaaactcgacatcagccattcttttcagttcctcctccgatgggaatgtaactaggaaagaatctttaccgtgtggcaaagcctcccagttccaatctgctcgaataagcctggcaagctctgtctgtaccccatccgctcctaggtgtccacccgtgatcgtgactaaagctgtaggtgccggaactgtagtctcgagcttgtaatcaaagtctggcacttgaagaaaaccaagctcattcttgccaaacccaagcagcgacgcatttggtttcggcatcttcaggattgggcacttgatagacaaatgtgaatccttcttgttacatataatgcaattcaaatctgccttgcacacagcaggcaaatgtccattgcacttgcatctgtagcaaaaaggtggtcgtggtttctttgcctttgccgctggtacctcagttgttgccattgctttgtgtttagccggcacctcagttacctattcctagcgagcaggaacctcttggcgctcctcttctctgcggctctgatcaggacggcgactagcatgagtgtcagctggccggtgattgacaggacagtgttgcggtcctctgtattgccggttgaagcctcgcccggctgatcctggtgacgatggttgcctgccgcgtgcgtatatccacgtccagcatcctgtgcgccccgattatcttggtcatagttccttctttgctgtcctgtgtcttgcgcagcagcagcagcctgaactgctcccgatccttgtttgttccgcggcagcgcgccgtgcgggtgcgatggtggagcaatcaggccccggggtggcgccgctgggcggccggtcatctcggcgtacgtaggatggcacacggcggctgaaggtttcgtcgagttagggttgagcgaagaaagttgcagtggtttagggagaagattgatcgcttgaatcgcgattgacttctgcctacaaaaccttgggccccgcaggtcagccctcgagcgaccgtaatgttttgctcgtgaaattaagtccatccgacggttctcagcgatggcgttcaaattttgagtcgcccactgattacgcttccgatccgatgttgtagggacagagttgcctgccggcggcggcaatataccattacagttatgtcgaattagagaaatgccattacaaatcatctactctctccgtttcataat

SEQ ID NO: 13239 - DNA, 16882 bp, Oryza sativa
cataatgtaagactttctagcattgcccatattcatatatatgctaatgaatctaggcacacatatatgtctagattcattagcatctatatgaatgtgggcaatgttagaaagtcttacattatgaaacggaggtagtatttcaaagcgtgccatctgaatatgggcagaatagtttccatgccatgccgtacgacgtaggctcgcgttgacttaatttgaccagtgtgtagtttcatatggtcgctaatgcccctgcatacatggatacatcggcgagttggttcgtctcgaccacgagaaaccgctccttccctgtccccaaaccattatgtggcggctatcgacggcggtagaaaccctagctggcgggtggcagcaagtccctccgcatctctaggggaccgcgggagcggctgcgatggacgaatcgagaaccctttcttggttgagcaggtgtagcgaggagcggtcccaggtagaagcgtgcggcatccccgagctcaagtgtgcttgtgggtggccggcagctccacgcacgtcgtccactatcagaaatcctgcccggcgatggctgcaatgtgggggagaggtgaatctttggccacgagaaattttgagttgcatctcctcgatttctttcccaattccctttccttccttttcatgcaaggtgtacgatgctatttatggatatgggaggtctcctcaggagtatgtcgaggatatgatggcatactaccatgccggcgagtataatagcctacgggagacgcaaccagttgcggtggcaattggtagatgcgcagggtcacaacatcgagttgtctagtatcttagaagaaaaagaggagcaattgcagctgtgtagagatgagctgaatcagtctaagagggagcttgcagagatgaaggacaaaatagaatcagagaaggacatgctccaatgggttatgcacatgctaatgttgatgtgtgttctttgtgtgccagtagttgtagggaagaactaccttaggtagttagtaattgctgtgagtgtgcaatatgtaatatgcaatctgtaaatgacttgtggaattaatcctagtttcatttttagttaaatgtgagcaattgtgaaatctgtaattgggctgtgcatttctagttgcagatttaccaaatgtgagcaaagctgaggaaatgtgacttatgtgacaaatttcagcaacatatgtgagcaaacttgattttcatttgtaaatttcagctacactaaatgttagttgcactaaaactgtcaaaatttggcaatgtgagaatgttagcaacattacaatttgcagcagaccaacaaatttgctggtattttcagcagaccaacacaaatctgaggatgttacaatatatggagcaagttcattcatataaggtcatataaatatcacatatatggagcaaatgtcaagtgccacataaatttttggtatttcaagcaggtatttcaagcaaaccaacacaaatgtgagaatgtcacatgtatggagcaatttcattcatctatgccacatatgatagtttgcatagcacagccaactttagaatacataataagaaggtcttagtgccattacttcactgctacatcacaaaataagcaggtctgccagccatcacaacataggtgtgtcttaggcattacatcacataataattacaaaagggaacccactaatcagctagcttacacatgcattacatcacaaaataagcagttcttgggccatcatatattacaaaagagaacccagtaatcagctagctcaacatcaagctgggttggatggttgagacacaccaaaccaatctgatagccttctaggagtagttgttggtggagcactggaagaagcaagatctctcatcttctgtggtgttcttttcttctttggagtttttttttctttttgtttggtgcagatgagctagcttcaacatccacatttgctggcctcctcctgcaagtgaaaagaagacacataattcaacaacagtaagaagtcatggatcaaaatggaagggttcagtacataccttttcctgggtgtttcttcggcagccatgtcatcttcatctagtggctcagccaatttgcaagttttctcaaagtgcccaaactgtttgcatctcttgtatttcaccttctttctcccaggctcaagacaaccccttatccttcgcactctaggcctgccagctcctcttctcagtcttggaggatgcactttgaacccaagatcaactgaaggccattgtaacctatcagtcatgggttgaatcctccctgcataagctgctctaaagtattagacactgtaatatggatgcacaaagtcctgaatctttcccctgttggtgcatatccaagccactgcatgcttgcaaggctttcctgtcacctgccataccctacaagaacaatttcggttgtccaagtccacagtgtccctctaggtgctattatcactctcaaccattgtgacttcagcaaatccatggtcacttctagccaccttaacaaccttcagattactagttgcaatgttcagctccttcatgacacctggtaggattccatcatccatcttgctagcacaatctcttctaagtgcaaatttcaccatgactatttctctaatggaatcaaccaactcatgtatgagcaaaccgtttaggcccttgatctggttgttgaaactctctgaaacattatttgtcaggtaatcacacttgctaagttctgaaaatccacatctataccaaatccttgagtggtgcttctctaggtactctattgcatcaggcctgacatcccatatatgcttcaagtgccactgaaacctatcctcggtatagcatctagcagctaggtacagatgattagtgaagattagcccttggtacttcttcatgaaattagaatagagatgcctcatgcattctctaaacctttacatgcatatgtagaaataactaaaccatctgggtctcctatggccttatttagttgttgcatgaaccagagtcggttatcatctattgtcgagtcaaacacaacatatgctacataatacaaccagttatgtccatctatagcagtggctgaagctagctgtccagtatatttaccagttaacctagttgcatctacacctaagtaaggtctacatccagccaaaaatccatctatgcaaggtttcaatgcaacaaaaattctcttaaagcacatcttcttgcctactttctgcaactctatctctacaattgtacctggtgacttgttctgcagtgcaaccttccagttgaaaagaagctggaagctttcttcatatgtaccatggatctgctccatagccttcttcataccagaccatgctttggagtatttcaacttgatctcatatctttcttcaagcttcttcctggcatcagttggtcccttgctaggattcttcttaatccaatcagagagtctatctgcacaccagccttgagtagccatcttccctttatgtagctttgtagaagaacaagtgtgctcaaatggaaggaccataatctgcatgagtaatgcaacacataagtaaacatcatttgaacaacaaaacaaaagaaatttgggaagagtttacctttacagtcttcttatcctcaatcagagatgcatttatacaccaagggcaaccatcagctgcaccttttgcaataaaccttgtaggatctgtcttcatacctttagcaaattcaaaacctttcaagatggcataatgccttacaacttttctgagagttatcatgggggaacaaagcatctttcacaatgtttggattctcaaggtcatgaatgatgttataaatctgaggataatcatctgtaatctgtgcctcaggagctgccagcctgccacagcactagcactagaaccaatctctccactctgaccagtggctgcagccccctgaggttcagatccaggttgaccttgctatttagatgcaggaacatataggcactcatcatcaacaccaacatactcctcattgtcaaagatatctgcctctctaacttctgcttcctctgttgtaagctggtcaaaacctccaacaatactagcggggatgtcagcaaggatttcatgagggatgtcaggagggatttcaggatggatttcagcagggaattcaggaggcgccacacatataggatttaaagcatttatagcaaatggcacaccctttgcagcatccaggatggatacaataagctcaaagtggctctcttctgcatatatttcaaacaactctggaatctggccattctccaatagtctcacgtcctcactaattgacttacaaaaataccatatggtaggagattggtttgggccccaagttaactcaacaaggctactcaacacaaactcaacgttaaagctatctgattccacaacccattaccgagttgacccttttgtgtaagttttcctaccaacagcatctattgtcacatagccttgaaccctaacgtctaccgaaaacctgtgcctaccaaacaaatcaccacacatgaagaacaatgccagccaaagatgtatgatgcagaaaaaagatgctttgcctcttaacattacaggtttcaattgatttagggttagggatactcatggccttgaacagatggtcggattggattcgcctagatccatctcctcgccgtctcgcccaggggtccgcggggaggggggttgtcgccatcacatttccagcaccatcacctgctagcggcgcatctctctcgctcgaatcctcgcctccaccgccggctagatctggagctcgaataggaaggaatggagtagggaatggatggagcaagcatacggttgagctgaaccaggtcagttttagagcgcgtctgaaaggggcatttccgtccatacacaaatatgtatccgatactacgtgtacaaacacgggagacgaccaaattatgggatggaccaaaattaacatcaatacggatggcatgcttcgaaataggcgatttataatggcacttctctaattcgacacaattgtaatggcatggatccaattaacctttttcttgcctaagtttcaattttagaatatttcggtgggaaactaggattgtgagactagaatataggtgtgcatttatgctccctgtttcatattgccgttttagttttctcttgaggcaaatatttatatcaacacataaaccaatgattcgcaatgagaaatatttttaaaataatttgcattttgttaaattatacgagtttctagaactgatggtcttgacttaggacaagttgtaataataagtaatttgataggaagtatatttgtctcggctagataaaatttttggttcgtcacaacttgtctactcccttcgccctaaaatatatagatatttttgtagttctaaaggaaggaacaaatgagaataagagaaaaattcttctaatttgctttgtccaagtgggatatatgacgcatttgtttttccattttcattcgaaagagtttttttttcctatttctctattcactccatggaaaaactcaatgcaatgaatttctgctggtatacaataaagaggaatatatacaaggtcttaaatcttgttatattttttttccttcaaagaaaaagaataattatattttgaactgctaaggtagctatattataggatggaagggaacattaaaaactaccgtgtataagtgaacattggtggaaactaatcggccattcatcatgcagaaaatagttttataatacaatttaccctcaactacggaagaagatatttaagaccttaaacttttgaaaccatatgaattacccccaaccccaccccaacataatcaagggttgttttgtactatgtgatatacacgtggcactaatttgactatgtggcaacccagttaacaaaactatcattttttaaatatcatgttggctccgtatgtcagcacctagttattgtcttccccccattctcccatctctctctctatctctctctcactctcactctcataagacatggacctgcacagttgctagacctcccttgccacgtgctcgtcacatgccaacaccgcctatgctccatgagagccgccgatttctccgtgctcattgtgagaaaccgtcgtcatggcactccctaggaaccccccaccacttgtagatgtgctcccctctctctctctctctctctttctcccttgatgatcccaagaggaggcagtggtggaaccctacatggtgaaatactcaaggaggcgtcatgcctcctcatgtttcgctcatcttctggtgagcttggcttgctagatctggccatagtgtgctcaaccgctaaattctcttctccctgcctattccttcctgcccttacctccatgatagtcattgatgttgagagagaggaaaagggacgtgctcgctcttacggcactagtgagaggagctcgacgtcggcgttttgtcttcccttcctctccttcctcagtagtgatggtgccctccccactcctctccctccctatgcaaagctcatggaggacaacatattagcggttatcgatctagagaccgaacctctgccaagcaacaattggtcaccaccaaagctatccatgccaccgagggatggaagagagccaaatgcatgagcgtcacgtcctctccatgcatcctatagcagcatcaccaccttacccagttcatattcgaggatggcataggctccctcgctgttactagccgaaccccaaccccttgtgagtaggagcttggaaccttgctaggttcccatcgactccctactccgccactaggaccttttcactgcctttgaccgcatctcgacaagcatcgttctctgttccagttaaggtgttgaccttcaacactcttgtgaccttaagacaacggctaacttgttgagacctccaatgcatgccattggtaggtgggtcccattgagagagggagagggatttgattggcgaggcacatccttcattatgttagagtaccacatgggaagtcgagaccacttgaaaaggggaggggattaatgtgtacatccccaactatttgatccgcacattaattgcaaattacatcctccatcattgtctagttttgcagttgagggggataaattgtacttttgaaataatttgggggtagaccaaacttaactaaaaaacatagagtcgccacattttaagtaagcttaaaactgggttccgaacactctttaggctgttcggcaatttgggtagggaactaccctctcacgcacgtaaaatggaacaactcattagtgcatgattaattaagtattagtttatcttaaaatgattaatatgattttttttaaaaaaataacttttctatagaatttttttttttaaaaaacacaccgtttagagtttgggaaacatacacgtgcaaaacgggggactagaggaggggagaagcgagaaacaaacgcagctagaggtgttcttcatggatgacttaatggattaggaataattacttataggaatcaattaaaatattactatataatttattttgaacgatttgcacaagacggtgtgaagttatattgatagaacaggaaaaaattacaagattacaatattactatataataaaagctatactaatactagcgtataataattgatttatctaccaacgttgatgtagaaaattcgccaactattacacctatctaaatccaatctaatccatcctatccaaacaaacaaacaaacaataatgccaatcaaacctcacatgcatatgcgaggaatacaagtatacaagatgacaaggaaaccatagttaaaaaaagaaaagagagagagccctactcgcctctctaacacgagcccaatcacgaggagggcgggcaagtgcggcaaccgcatcgcatcacactaaccgcaccaccggcagccggcagtcgagaggatggacagcagcaacggcgagcggccgccgcagggagaggatgcgccggcggcggcggcggggtcgatcggagggtacgagtccctgcacaggctcctccagtccaacctctccccggagctcttcaaggtaaaacttccctctcctcctccccccgaacggcggcccgctggttggttggttggttggtcggatgcgtctgggtcatcccccctccggggccgcctgtttcttggttggtttccgggtgggcgagctcgcggcggcggcgctggcgttgtcgattggtatgtcgtgagttaatcgggttcttggtgatgagatagatggctgtgttgatcacttgatcctgatgtctttgccattatggcggctaagactatatgtacggattgtaattgatgatgtcgggttgctctctaacacaattttgtgcgtcagatagtgacttgactgttgtcacttgtcagtgagtaattctgttgaagaaaacatcctgtagtgttaacgttaatgcgctacggttgtccatccatctgttgatgggaattcgttgtgttcagtgttctccttaggcaaaaaattggtacagtactgctagttaattgacaagatctgtcagtcgctatgaagtttaattatgatatggtttcattagaagatgctaaagtatatcactgccaatacagaacaatagattatggttcgattatttggggaaccgtactagttttttatgttaagctttatggtaaggatgtgttgaagatatcaacttgtttatatgctgagcctgagctgttgctaacttagtttctatatttgttaacaggaagcaagccggctgctattgggactgaattgtgggcgtgctctagaggccatctcattgcccgaagccacatctgctcttgcaaaagctcataactttgatgtgcaggttatttcctgatagttggtatattctttcattgatttatggatggaatcaaacacacactatctacagaaaaaaatgtctttgtctattggtaaataatcatgtacaattttaatgtttgaatcaggattcactaagacaaataaagcatcatgtcaaactcttctttggtagtggtagtagcagcttgtctactggttgcgcttttcaatccttcagcatctagcaaattaaactgataattccctgcactcttgttgtctcaatttttaagtagtgctcttttgtgctgcaggccttccgttttgatgcagataaagagtatctcaggcaaccacgggttattcgagttggcctgattcagaactcaattgctattcctaccaccagtcattttgcagatcagaagaaggctatcatggagaaagtcaagcctatgattgatgcagctggtgatgctggtgttaatattttgtgtttacaggtgagtcaattatcggtttgtacaacttccttttggcatttgatgaattactctagagttcccatgcaacttgttagtatgtatatcttcatttccaacctaatgtgtttctcagaatacttattctccatgttaatagtgaatatttgattaattcatttctgatccttgttgctcagaatattccttctcaattttctggcaatgttatgttctagacacattggcttaaatttccaaaggtgcatatcattctaatggttgatacccaaaattcaggaagcttggacaatgccttttgccttctgcacacgtgagaaaaggtggtgtgagtttgctgagcctgttgatggagaatctactcaatttcttcaacaacttgctaagaaatataacatggtaattgtgagcccaatcctcgaaagagatgtaaaccacggagagattgtatggaatacagctgttgtcataggtaatcatgggaacataattggtatacatcgaaaggtatgtgcaatcagtacatatttatttcctctggatatctctaagcatttccggtctaacaaaatgctactttagaatcacatcccaagagtcggtgatttcaatgagagcacatactatatggagggtaacactgggcatccagtgtttgaaacagcatatgggaaaatcggagtaaacatttgttatggaaggcatcatccccttaattggcttgcttttggcctcaatggagctgaaatagtattcaacccatccgcaactgttggtgaactcagtgaaccaatgtggcccattgaggtcagatatattcttacattccattctgttttatagcacttacttccagttgttgcgttctgaaattttcagaagtttgaataattttattcgttttttgatcttatttgcggtagaacagcactgatgcttaagttgtactctttcaggccagaaatgctgcaattgcaaatagctactttgtcgggtcaattaaccgggttggcacagaggtcttcccaaacccattcacttctggtgacgggaaacctcagcatgccgactttggtcatttctatggatccagccatttctcagcacctgatgcttcttgcaccccatcactatctcgctaccgagatggcttgatgatatctgatatggacctcaacttatgtcgccagatcaaagacaagtggggcttccgcatgactgcccgttatgacacgtatgcttccttgctttcagagtacttgaagccagattttaaacctcaagtcattgttgaccccttgatcaataagagtgcgtaatggtgagaaacttggtgccaaaggagagcactcaattctggaacttacacatttagagcattcagtttgagggaactcttcaaaatctgccattggggaatcgatttcttttttcaattttcgtatgtaaagaaaaatttgtatacatgtttacctcaaattgccttttacttggagttggaaacattgatactcattttgctttctgctgtaaatttgcaaggtatgtatgatctgtaaagataatgcacaccaaacaatatgccatattaatgatttagcccaaaaatttatatcacagttcattaacaagttacaccattctacaactgagaccattattcaaagaactggacttgtgcagaatgcttcgcattcttgtacaacatggcaattacttttattttgccacttgctaggctaagaaaatggattaactatatgatgtacaactgtccactatgtccaagttaattctgttgcccttctgcttattctctttgtcagaattcagaaatctaccctagagtaaacatcagatatatttataatctacttattatgtgatgcttcttcgttcttccacatcactagtcttttcaagaattccataacctgcaattgaaatagctctatatatcatgaatgaacataaaaaacaattatgagaactgtcatcaaacagtgccttacatggaacacaaatcatgaacctacctcagatggatcaatcagagaatatagggcatgagaatcctttggtacagatgacaccagaatcccgaaaccccttttatcgtcacgaagaacctgaaaattgagccacaaaatgaattttgtccatgaaaaagcattaatccttctgcaggaaagcagattatgcgccttaaaatcgaagaacctgaaaattgaaccataaaatgaattttgtccatgaaagacataaaccttctgaatgaaagcagaattccgcaccttaaaagcatcctcgtcggtacaatcatccccgatgtaaatagggagaacatttttacagctagctagatctagggagtccagcaagaactccacagccttccccttgttccagtctatcactggacgaatttccaaaacctgcatttcaatgatcagatacagctgacagtcatcttcaggagccaatttcagttttcagataattacttttcgtccatgagtcaatcggaggcgagggtagacttttaggacatcatttgtgcattgagaaacaagttgccaattctgaaagtcagattaatcagaagcaaggaattgcccatatgcctgaaaatataatttatgaatagtttctcccccatgaaatgattttgagaagataaatcttcaccttctcctcaacattgcggtagtgcaccgatacacagaacttgttgttctcaattttcacaccgtcgattgcctttgtcttatcgatgagcaatctaaaaacctgcattccattacattaagatgaacactgagctaaaatatggagttgtaaagcctgacatttttctacctcattgatcattggtaagaattcagtaccagcctggaagatcttcactcccttgccctaaaaaccgtttgaaaagatcaattcaattcaaaaaacaaatactgtatcatattttgcactaaaatttggaaacaaatattatgcttggctgaactgtaaagagctctccacacctgctttctatttgagttaatggagctcctatggttagtaactgaatcatgttccccaactggacccatgatgtccattccatggctaccagcatagtacaattctgttagtttaacaaaatcaaacacctaaaattgatacaaaaaggtacagttagtatcagaatgacagataacatatcaatttactattatatcagcacaatgattacgtcgaaaccttttaaataacatatgcaccttatcacgagaccttccactgataatcgcagtgggtagatgcaaggcagcattcctcaccacctcgcgcatctgtatacacgatattgtgcagaagttttagtcaatacaacttgacaagaggagactcaacagagctagatattgcaatgaaaaccacctggtcagacatgatagcattgtcaggttcatcgacaattggcgacagtgtaccgtcgtagtccaaaaacagcgctatcttcttccctttgccataggcaacaatgtggtcaaaggcatttagagctgaaggatacttcttctgcaacaacaacaaatgcaaaattgcgccactcttacaagatcaaacactgctaccacaaaaattcagcaactagtatggtagtaaactcaccgtccaagctcggtagatcgggtcgaatgaaccagatgaactattgatcacacaggtagcagtaggtgaggacaacctcatgtcatacaaccggccattggtgtgtaagggcatcaatttcagaggtaaaaccagttcctccatcttctctaatgatgcaggatcatcatattcagagcttctaccgttaccgcaggaacccatatatacagatctttttactgtcaaactgtcagcagacaccttgtttgcaaaaacattaactcaactctgaactctgaagcctatgaagattgaagaaccaccttattactttcttcagtatcttgcaaccacagattcacatccctttcacaacgaaaaataaagcatcgatgcgataagatatataattttctctctacatcatataatgaaaaatcaaaagggcaaaaggaagcaatggcaatacatactttcaagaaaccacctgaatctcctcatgatcagaacacaaatgggcagccgcttttcttgtggtttatatatatgcttcatctagataccgaaaagtactagtgacttgctgatgaatctgaggcagcaagtaacttgtgtgcttggaagtcaaaagaggcttacgctagctgcctcagggactaccgaaacggatcgcttcaagtcaaaaataaccaattgagacacaaagtcttgggaagaacggcagcatgctccgtacacacacagcaagagatcagacaggaataggtgtaaaatgttctacaatatatgttcagtgtttgagaattcagagacagcaagggcatctgtgtacgattattcagcgtgcaaccatgaagaaactagtctacagtaattgtcctgaccttcatatcaagttatgaaagaattaaagttgaacaagcaacaaggttgagtggaattgtttaggcaatatttatgatggaatgggattgtgaagaaagatactcatgcagtaagcagtgacatcttctataacttttgtactgctctaacacctagtgtatgcattttgttctctaattaactatgttcatgtgaaatgcaacctattaattagtttttcaatcatttccacaaaattgtgattatttttctaatgttgaaaattcacaattgtggactgtctccaaggaggtaggaggtgagaaagcgaaaagcaagagaaaggaaaacaataagaaaagaacacaactaaaatcctacttgccttaattgatcagttggcgtgagaaatcagaagaaaaagtgcaaaaactgattagggacttggtcgaacacacatcaacatcagatttgagtcatgttttataacttcacgtgtgcatatgttaagaaatcttaattactagcttctttcaaaataaagaaatcttaattaggaagtccctttcactctaaataaagctctcctaagagaaaaacccaagagtactgttggtacagcattggagtgcacttctctcaccaatcgaacgcaggaagcattcgattacatgaagcaaaacgactattagttcaaacaattaatggagtgcaattggaagcaacagagatcatcaaactaaatatgcatcttggtcaaggcatgatgcagagatcgattgaccaaatactacatgaacgtgcgataaaagcatcaaatttcgtgcgtcttcatccgtcgcaacatttgaatttgatcctccaaggaactaaatggaagggctgaaaatgtattacttgccttcagtttgaagattaaaagtctggagtttctcttcagtccttaatttgtacctttactaagaagctagttacatggtgaatagttaatactaactttatgcccaatgctatatactctcagactaaggaagtataatgctcaatacaattaatttattaattaataattctatttttctatatgttccaagtaagcagataatatgtgatgccactgaaaactttcgatagctcactaataatttctaaattcaaggtcttatacaaggagaaaccgaagaggtccacaatcaatttggaattttgcattgcgtgccttcaacctatttgattaatccgtgcattcaacagccaatcgataatcaagcctgagatcgatggcattaactaaatcaaatcaattaaactggctgagctttcgtgttgcagcaagattattaattggatatcattacatcaccagattcaaaacgcatgcatatatgtgcaagcatccatccatcaatatgatgatgatgtaattatctacgtgatcaaatcaatttgtaattaatccgagcaagtaggtcaggaaacgctcacctcgatcaaccggccggagagagagagaaaagagaagggatcaaaaggaaatgtggagagagaatgagacgtcggaatggagggagcgagaagagggggagggacgtagaaggcgggcgttcagggaagatgttgtgatgaggaagcaagacagcttgcatgcatgcgatgcgcccatagagaatttcatatctacatgacatgagacatgcaattttaagataatggcaaggaaaaagtttacattttcgacctctgcacatgtgcacacactactacagaacactagataggtgcgggcacaaatgactttgatcatcggtataaaaccggcacctataatatatgcataaactcgacacctttctctgacaggctaatagttgctggttatatttaaaaactggcacctatttagggagaaaggtgatttggtaggctggcagccgcgtgggcgggtgagtgggcgggaaaagcactatagttgccggctataccactttcggcatctacagtgctgatctctatttgcctccatgtagtagtgacacaacctatttatccttgtcggggattggtttctttcacataaaatcagagagatgtggttgctttcatgtgagtcataccaccctcaggctcacatgttagtaaccacgtcaggtgggaagttacgttagacaccctcaattagacatgtcatatatactcatgattaggaataaaaacagagtggatatggtcggataatgctcataccatattcattttactattcttttcaccggatatgaaaatgaatatgaatagctcagatacggaaacaaatacagcttatctcgaatatgaataagggttgaatatgattggcggaaacacttttttcttggaacacgaaaactacctcaacttctaatagaaacaataccatcatacataattagctcattttacattgaatatattataatttataaaaatatttaaaagcttaaataatattaatagtgtggactaatgttatgagattggctactattaaaatctaaaaaggtagattaaaggtcctagagttataaagaaatgagtatgtctcatggtttcagtggatatctgtatccatcgaaagcctcgacaccatattcgtattcatatccaggaaaatatatctgtattcatatctgtatccggactatccgataattatccactctgaacggtatcagtattcttttcccccatagcagatggaaattatccgcttcgtttcatccctacccatgatttgcatcaagagtaaattacactagcggtacacaaactttagatggatgtaatgtagtacatgaactagtaaaacactgggctgcaggaa

SEQ ID NO: 13240 - DNA, 15604 bp, Oryza sativa
  unsure (1)..(15604): unsure at all n locations
attcctgcagcccggtccatgtgaaccaaggccaaagaacacacaaacaagactaatcctgctaatttaagtgttgattaggatgttacattaacatgtaagtgaggagagagccgcatagacatacattgttcagaaaaatgtttaataaggcctaagagtgcacggagaaaaataaaaaaaaagaaattatgcaagaggtagaactgacaataataaagcgaaaatcaagtttacaaatatagcatgtctcatgcctgtatacatcgtgtcctaaccaacttctaacttggtaagcttggccattttgtgttttttcatcttggttcgcacacatcaaacatgtacatacactaaaataagtgttttacaagtttgagtactaaattatacctacttgatatatgtactgcttgttaaatatgtgatccgaattttgggcccataatatattcggattagttatctaataggacactactttataggattagtttcctattagggctcctagatttctgctatatatatcccttgtaaaccgcacggggagggtgcgacagtccaatgtatcccctgtgtttgtatccaattcctctatagtgatcattgccggtcggcgcccgtggttttttcccgcaaggattttccacgtaaaaattcgtatctccgttgtgcatctattttcataacaagtggtatcagagcattggagattcgatctatagtcgcttcgttgttgggttcgtggccatccatcagatcgatctatatgatgtcctggtcactggcgtgattccacgatcgaagaaatcgatctcatctgatcggcggcagcaggcgcgtgtcgtcgcgtcgtctcgccgatttaaagcggggtcatctgtcgactccgagcagccggcgtccacctaccaatctaccggcgtcatacacacgtcgggactcaggagatcaatctaccagcgcacgcccacgtcgggagaaaagaaagtcaggaagcggaagccaccgttcctgccctgttcatgtgaattaaatttcacgttggatttttcctgcgtgcacatatccatcgtaccagggatttaagccttgcattgttttggttctgttcaggggaacacaaattcacgttccaaattgctatgttcacaaagccaagtctaccaggaggttttttacggagatcaaatacttcgttttatgcacctagagtgtttcgcatttctgttagggtttgacaaattgtaccagcagattcaggattttattcccaaggcgagttagaagtttgatctaccactcctggattgagatgcaatctcgttatggcaagtgaagatgcaagttggcgcatgtttcaaggaggataagtcatgcacctgagattaaaaaaaagtacattcaagtcgtcgagagggagcctcgctcctgtcaagatcacaaggtgatcaaattgtccggcgaattctgctaccattgtacccaacataccaggaggttatcaggggatctaagtactttgtttttgtgcacaagaatttttcgcgtttctgtttggattccagaaattaatgccagcagatttaggattttattcccatggcgagtttgaagtttgtacatcagtttcgcgtctctgctgggttccacaatgtcataccagcaaatttaggatttgttcccaatggcgagtttgaagtatggtctacctcttctggattaagggtgttatggattatagtccaagtgactatttggcgcacattgattttatcatcacgaggttctttggagattgaagatttttatgctacaagggaaattcgtctcaaggaggagattgttaaatatgtgatccgaatttcgggcccacaatatattcggattagttatctaatatgactctactttataggattagtttcctattaggactcctagatttctgctatatatatcccttgtaagccgcacggggagggtgcgatagcccaatgtatcccctgcgtttgtatccaattcctctatagtgatcattgccggtcggcgcccatggttttttcccgcaagggttttccacgtaaaaattcgtgtctccgttgtgcatatattttcataacactgctaatgcaatttactcttacaacaatttacatttcacaatatagaagcctgtgggggccgatcgtgcgctcctaatctcttaaatactctctccgtcccattttaagtgcaaccataagtttccgtatccaactttgattatctgtcttatttgattttttttataattagtatttttattgtgagatgataaaacatgaatagtacttacacgtgacttttgttttttactttttttaaaaactttttaaataaaacggacgatcaaagttgtgcatggaaaattatggctgcagttaaaatgggacggaggggctatcaaccatatttctatgaatgcttctgaattatttttatcattgttacaattagtcatgttccaattcggagatgcatgggccgtgaatgctgttaacgtgggcctaagaaaatagcccagcaggccgcagtttcttttatatattttcccagtttttttaagggaatatattttgccaggtcaataggttaaccaccaggacttaataaagctccttagggtgaatagctaatatgggccctgaagtttcgcttcgggcttagtttagtcattgaggttttaaatcgtccagacaagtcctccaaattaattatttgggttaatataatccttggacccataaaaagtgacacgtgcgtatgccaagtcatcctcgcatgcagcggtctacccttatataccatatagaaaagaaagaaaaaaaaagaaggtaaatatttcgcacgtgtatgatcgttttagaattgtcacttacgattgctgcagccaaccacggattgtataaattccttttgtcgttcaccctctgcaacaatgttgggcctaggctggcttgttattttttctgtttgtgtctttttttttaattatgatatataagggtagaatgatatttcatttataccgctgcatgtgaggatgatttggcatgctcacgtggcgttttttgggtccaaaggctatattaacccaaataattattttagaggacttgtttggacaatttgaaacatcgatgactaaattgagcccgaagcgaaactttaggaccatattggctattcactcagctccttaaatgttgttttcgtgaaaaccgaacaaaaacctccgacttggatcaattttcgcaaactaaaattcgaattcgaatttgaattttctcgttctgcttgttggctatcgacagaaaaccgaattcgagtttgaattttctcgttctgcttgttggctatcgatagaaaaccgatcggaataaacgattttcctaacggaaataaacggcaagattagtccaaactgaacggagaaggcaagtttaacatcggctccagcgttggttaattcgttaggttaatcttgtagagattcatcgataagtggtatgtggttttaaccctgaagtcttatgttcaatccccaacacacccataatttcttcttataaggttcaagcgcgtggtcttatactcgatcttattgcagttcaaaacataaatggggtcctgcagagctattaccaatacataaatgggcttacatattgcaatttgcagttcagtagtggccttacggcacagcccatcagaacatgttctttattttctcacgctttccattctgtcccggtaaacaagtcatttagattcatattttcttaatttgtttaggaatttatatgagttcttcgaaaaaataaaattcaaatttgaatttggatgaaatggaccgatttagtcctcagcaacatagcttttgtcccgcgtcggttagtcagttttttttgtcctgttttcgttcaaccctgtatactcagtagagtttaaattctgatatctataattacgcacacaattaaaaaaacatatacatatatataattacgcacacgtggatgtgctcttaatggggattttgtgaggtttatagatttacggttggcctgtcttgagcgtgtaaagggcacgccacaccatacatcgtgagtgtgtgcacatgtcttccctttacatgtcgttaccatgcttaattctagctagtttagaaatgaatcatcggggtcgttgctaacatttgtgcctatctagctaggctcctctaataaatgaaaccagaaaagaagtggttgtgtagatagtaggtttaatgaatggcacgttgggttcagtcaagtcatcgattgtcaagagaaactttattttaatactaataccatttttaatatattacagtagcttatagttatcatgttcctcttattcttgagaagtctcccttagattggatgggtggctatgtctactctatctatcaaacatatttttaagagctttatttatcatctgtaaaagattggatacataactatttaagtatagatgttaggatttaaacttaagtggatgtaaattcatgtacatgtaactcgagagattggatacataactatttaagtatagacgttaggatttaaacttcagtggatgtaaattcatgtacatgtaactcgaacatcaagatcaaaggtgatatttgccataattttactacggtcaactcatatatatgatctattatctcaaactaaacggattttcacaaaatcttaggaagctttctaacaaccatggaacaaggacaaaggacaacctctactagctaacacctaaccattcacaaaaacttagtcaaggggctttttctagtttttatcaagttctaaatctccggctaagcctcttagcggttgagctctccaacagctaagacattagctgttgtcgaaaatattaggaaaaagttcaaaaatttgacagaatttaggctaaaagttagcatatcgatcactcacttgatttgcacatcaagttcatcaccaattcataattcatacttcatacgtggagttcatagttcctaattcatacttaatttagaggctaagtacaactattagcggccgataaatcttagcatcaaaattgaagtatcctagttgttcccctctccatctttgccgctatagccagaggtttagaacattggtttttatgaaaccattgacaagcggtgaaattaatctgaccgaatttcgtaaaagaaaaaaaattaaaatccacttcaaacttaataaaaaaacccaacgctttatgcttttagccgtcctagaaaatatatttttcgcagaaaccggccagttttccttggtatgtaaagttgtaaacccagtcatggtcgaccatggtgcacgccgaagtcgagagctgttggctcttatggtggaaaatattgacccccgtacacatgatgaagcactaggagtgaaacaacgagtgttggcacatgtccatatgcatcttgcatgattgatcgcgccagtgaaaccactgttagggcatacggtgaaaatctagtaaagatgattctaatctacttcctccgtttcataatgcaaatcattctagcattgtctatattcatataaatgttaatgaatatatacatatgcatatgtctaaatttattaacatctatttgaatgtggacaatgctagaatgacttatattatgaaacgaagggagtagctagctataggctgtggttgcatgcgcgcatggatatgctatccagcttcccttttgtcttacacaatatgcatgcttgcgtgcgttaatatataataactagggatgatgatcgatgcggtcttcagctcacataagggaacacacaatattcttttttttgggtgaaatttaatttgcacttattcatttcaccattctcccgttagtgtgcatttttgggtgtgttccgtagccaggctgtggcagccacagctgtagccggctgcttgcttggcttgtgtgaaacagcgctgcagcagcgctgcagccaagtagcccaacagacccttttgttttgccatccctattaaggctgacatcgaatccactggttcataacttccccccatgacaacgagcacgaggtagttcattagtgcatcattaattaagtattagttaaaaacattgaaaattagattaataagatctttttactcaactttgctataagaaaatttttataacacacgtactacctcagtcctaaaattttatagaaaagttgctttaaaaattatattaatccatttctcaagtttattttggttaatacttaataaatcatgcactaaccgccgctctatgtgttgggagtgagggttccaacccactcccgaactcaatctaagccaatgattcttcatctgtttcatactccctctgtccaacgtaagttattttgagtttttgtttgcaacgtttgaccactcgtcttattcaaatttttttttgcaaatataaaaaatgaaaagttgtgcttaaattactgtagataataaagtaagtcacaaataaaataaataataatttcaaaaaattttaaataagacaagtggtcaaacgttgcaagcaaaaactcaaaatctcttatattatgggacggagggagtatgaaacagagggagtagttgacatttaacttctttttcttagtaacacattactaacacaagcaaccataacgcgcgcacactcacccctataaacgtacatacgcatgccttattctgatgagcacagttaactttatcttaatagaccattatgcccttgtgcatattccaacattaaacattcctttgaaaatttttaacgagtacaaaaaaaaaggataattaaattttgtctacctaaagtatattgattttaaaaacattaaattggtgaacatgttatttttcttatttttttcaaaaacaatgcaccatggaatcattcggttctcaaatgtttcattaaataatttatagtagggaattaactgcattgcatgtttaatatatatattttttacaatattagcaactacttaatatttatatgtgaaaactattttccatattttattttaaagtttcacataaaaacctttaaaactaactgaaaattttcttacaatatatacattttcatacaacctttaaaactaacaacattaaaactatatctccttattttttgtttgaaatttgttatgacttttagtttcataagggaataataggcctttgggggcaaatctaatggtcaactaacattgatcaatgataatggtaaaagagaagtgagtgctaacagaatagtggtaaaagagagagaaatacaaaacttttaaggcggaaaagagaacacggtttggacggctagcaaaaagaaaaaataaatacattcctttcaatgtgtatttttcagagctatgacaataaaaatagtgtaaaaacttattagtggtagccattacttttccaaagttttgaggtcaaatagctagataatgatatatagttatatatataatgtagtaccatcttctgtacgtagttttctttccatatggtctagatccatagaaagagagaaccattggtagccattatataggcatatggttcatttgcttctaaacatggagctatattttctcaactctatatgtgcatctgtgcatgtttgcaacaacctaacatgacatcagtgacttttatacatgccctaattatgtgtgtgtgttcatagatcagtgcatatgttgcgtgcaacatcgatcgctttgtgtcaattattcatcagtccaatcatgtgggcgtccatggacgacaagcaacacgcgccgtaattaagacagaaattaagcatgaccggacagctactagtcttcaattgcactatattaacattgagatcagaagtagggagtacaatatatagctttctctgtctttaacagaatttcactatattataattggaattgaagttttgaaaaaactaatcttttcattgttagcttgatcatgtacttacatctagaacgatatattttttttttgacttgaaagagttatgaaggattgtctcgagagcagtctacacgaactccatgttaactagctagagatgggaaccggatcctctgatgttaggaaaccaacgtcagaaggcagtagtttcttcatccttcatccaccgtccctggagcatccaacgcctctcttgcttttgcttcattgtagggtgccacaatctctgttctctggcgcgtgaaggggattgattcatcgaggcggcgagcgaggaagcgccaagcaaacgaatcctgagacaaatcaacctgtattgactcaaacctcacaaatcaacctggaactttattcgatcgacccaagaaactcaagatcaacgaatacataagctatctgcgctactccaaccttgacaacaataaatcataaatggcattaagctagtgcagagcagaaaaaaaatcataataatgtgtgagctcgacggcattaattaattagttcctcgccggcgagtggtacgggctcggcgttccgtacgacggcgtcagcatcggcgttgggtgcggcggctggccagggtgcggcttgggcgccggcttggtcgacgacgcggctggcagatgggcttgcagatggtcgccgacgcgcacaccggcgacgtgcagtgggtcttgccggcgacggcaacgaaggttctctccgacagctgcatgatcctcgacggctcctgaccggggcatgccgcgttatgtttcgccgcgctgtggagctgagccacgctgtcggcgccgcggaggtcggcggcgagcggcacgctgaatgcgccggcgccgtcgagcttcccggccgcttcatctcgtactcgccgtcagcgctgttcttgcacttgatcgccacacggagacctgcacacaaatatatacttcctccgtcccataataagggattttgagtttttgtttgtaaattttgaccactcgttttatttaaattttttttgtaaatataaaaatcaaaaagttgtgcttaaaatactatagataataaagtaagtcacaaataaaataaataataattttaaaaaattttgaataagacgagtggtcaaacgttgcaagtaaaaacttaaaatcccttatattataggacggagggagtacacttgacttaacaatggcaaatcgtacaagatcgggctgttgtcgtcctcgtaggctgcgttaatccggtttggatgtgaaggacgaaaatttgactcggcgacagtgaccgcttccttgatagccgtctcaatgaatcgatcaccttcgcgcgcgagagaacagaggttgcggcaccccacaatgaagcaaaagcaagagaggcgttggatgctttagggatggtggatgaagaaactactgccctctgacgttggtttccttacatcagaggatccggttccctagagatgatacaagagaaaaaaaaaagtttcccttagcccatgcattattgcatattcctatacttgcctctgaaaaataacatacttttatgacttgaaagagttacaaaggattgtctctcaagcagtctacacgactccgtattaactagagatgatatagcgggggaaaaaagtttcccttacccatgcattatgtattcctacatagactctttcgtctttaatttgtttttgagccggttacactggtccttttcatatccaaggagacgatcataatgtacgtaacaaaaaatattacgagagaaataattgatataagagataaggtataccgttcatttggcttttctttctcatgcataatgtacatcctatatatagcactagcagaataaacacggatggtcatagacatcgtcgaacgctctaccacacaatctcaaacatatatatttttagagaaactatacataatactaacttccactgatcgcaaaaaaaaaaaaaaaagagtggtggtggtgtctcctgtttgcctccactggcttaaatccataaaaaaaaaggagctttagttttgcctcattctgttctccccaatattcacaggcagatagcccaaatcttcaaaccccgggaccccacagaaatggatggttccatcttgctagcaatgatgcatgcacacggctagcttgttcgtatatattgtcttcatgtgccattcacatatactacttgcctcttgtatactccatccatatcccaaaataaattagcttctatagatgaatctggatataggttatgtacttcagattcatatccaagaattgatttttttatgggacatatgggagtatatgtattcatgttcttatctcaaaatttaagagctagctgagggggcctaaattaagggggaaatagaaaaacaagtggacttgtaataggactttttgttggagaaggtggatactgcatgcttacattaggatttgttgcatcttagaatatattattgtgtatattgtatctttaaaacatactccttccgtttcaggttataagatgttttgactttagtgaaagtcaaaccatttcaagtttgactaagtttaccaaattagttttattaaattaataattaaatatatttttataataaatttatctttggtcaaaatattactatttttttctataaacttggtcaaataaacatcttataacagaaaacagagggagtatgagtgttgcactttctgaggattgctacataaaagaaatttcataggattttagaagagatatatgatgcatgtttgtttctctctcgcagtagagcccaacaaattgaaagcaaatccaatggctctaatttgtaggggagtttgtggttaggcaaatgtctagctcagtaccctccaaattatttggatcaatgattgttaacaccagtggatctacacatctaatccctctagctaccatagtaccatgataattaacaatgttttctaaagcaccccctgttaactaattaattaatctgtactccacaacatagggtagggtatatttttcaacaaattcgatccacggctgggaccacgcatcggaatccgtgcccggaagatgcacggcatggatcatatgtgctgctctatctcaacctctcttctccagtacaaaaaggcacaggaccccactgactaatcaacaagattagcagttaaataaaccttgggttgcatgtaaaataagctattaatttgcatgggttagtatgcatatacgtgtgcacatgatagaaaagaatggtgctattgctataggcagatcagaagaaccagagacaagtaaattaagacgttggttttattgcaagttgggagatttggcaaatcctccttgggattcttcgtgagtcgtcaaacttttcggtttcgttttcttcgaactatgtatatatagcttttgagatttcgttttatgtggcccggccctccaaaatccaaattggcactgaaaaatctcggcttttcgttgtgccgtctgctagagtttatagttaggtaaagctccaacatctcccagactatgattagcacttgtgttattgggttaatggtacccacattttcactttcttatcaagccaagtaccattgagatttaattagacctcgttcggaacacgatgacaggaacgattaattgttataacttgtgtagaatatacgtataaattcagtacagatttaaacagatataagttcagctgaacctcgctaagaaatatatatcatgaatctctctttgtcgtcaccaagtttgggtcttatccagtgattttccgtggttggataccgaacactggtttttacaacattaatcctagtagggaattttcatgcattacaaatgtggccttaccctagacttgcatattattgtacctagcatggactctattattgtgttcacctttctatcatacttgtttgttaataacatagtcttgattttctctttacaataaggttttgtggaatactccacacttgagatatttatttgctcgctattcatactcttagctaaaatgttaaacaaaatatggtaagcgaacatatctctactactttaaaagtgtaatcgtctgccttccgttcccttctcaccatgcaccagaggttgtgcgtccctttatgtgtacgtaatcaatatagaattcaatacttttccctcaatccacccacctagcctatccctaattatataggttagtctatgttttattctcaatccatccacccagccaatccctaattatatgagatgacccattggaaagcacagaatcttactagtttgaattaaatgtcatggttacccaaagaatctcaagtgatctatgaatgaaaagattgtagcaaattccaaagaaaaacctaggtcaaaaaaatccttcgaatggaaattgttgcttttacgcatcgcaaaactgaattttgaatatattataacagtcagtctcattactggagttgcatgcctgcaatcaatcgaggattttgttccttgcacacatattgatatactgactcttcagagagtgataacacaaaatggatctgcaggctagctgctgagccattgatcaaccaattttgtcttttcctggatcaatgcaaaaaaaatattcagtgacaggcatacaacctgaagaaccaattaagtgagagttgatctgattaattaactgatcagacgggtcgacgggacggccgtttacatccctagaggctctaacacaccttcatcatgcatgcatatgtgctattttgtatagttatgtgtgctataagtatataatattaatctatgtagcaacatctctagatcaggtcctagctatgatatgatcttccaggtatatattggaattggagtgagagagcccaaacatgcactgttgtacagaaccaaaatacaattgcaagtagctacatcatctataattcattcatccatatatctgaaactgcaaggaggctgctggctagcttcctcctctatttatacacacacccctctcacaggcctccacttgcatctctctctctctctctcccaattatatttgtagagagagggaagaaaagaagagaggggaggagcaatggcagggtctgaggagaagaaggagatgcaagaccccaggacacaggccatagcatccaccattagagttgtgcccaacttccctaagccaggttctctctcctctcttgcttgttgttttttagcttaattattcttgcatcctctcttgctttactgtgatttcgagcttagttcttgcatgtctcgctagttaattcatgtggttttctagctctgtcttcttgttttgaaaccgaacgatgttatttcttttgagtataaatatttttcagaagtattatgtatcaactggttggcttcttctttctgatcctttttttcagcatatatgtgctcataatctcatatatacatgtgcaataggggctgcaattctgtaaagaatattgaccttgggggttgcctttaatttcaagtgccaaaatctgtgtttccttgcaaaggtccccactggtactattgatccttgcctcgttggttctttccttcctttttttgtttattggttctgaacccaaaaactttcatgaatatagcttgtttcttgtgtgactttatcatgagctttttgcagcttgtaacctataaccaaatttctcacattactacaatttataggcatgcacatgcatggtttgagcatgcacatttaccacaaaatattgttgctgcgaactgatcttcctttatttttaaaattatttttcctgctatattatgtcatgaagacatatttaatcttcctattgaggtgaaactctcactctattcaaaaggctaattatgtggatatttcgataagcgcatccatcgtgatgatgaaggtggtgtgagcaaaatgttgtgtattcgagacattatgattttccctttagaagtcttttcccactctatatatatatatatatatatatatatatatatatatatatatatatatatatatatatatatatatatatatatatatatatatatggaggggtatcaanagagatcgcgcgcgcgtgcgcgcgcgctctctctctgcatttttctcaacacacatctcatcttcccttgcccgcccaaatttaatttatagaattcccacaaatactttggaagagttttgtggcaattatttttttctagaaaaaaaatcgattgactagatctgcgaattaaatcaatgacacatccctgcagaagaaaaggtctatgcaatacctttttttttcaggttctttcataatatttgtttttcttgatgaaatgtgcaggaataatgttccaagatatcacgaccctacttctaaatccccctgtgttcaaggacaccatcgacttgttcgttgaacggtacactggcaaaggcatctccgttgttgctggtaacatataattgttttgttttttatctcaaaaaattgaaaaaatcaagatttatttgaacttgtgcgctttgtttattcaagtactccatccgtcccttaattaatataagggattttgatattttgcttgcactgttttgatcactcgtcttattaaaaaaaattgtgcaaatataaaaacgaaaagttatgtttaaagtactttgagtaataaagtaagtcacaaataaaataaataatagttttaatttttttaataagacgaatgttcaaacagtacaagtaaaatgtcaaaatctcttatattaagggacggagggagtagtaactaatctgatctttatctcaaaaaaatatcagatcttatcaaatccattgaaatatataatttatttttttaatactaagtcagagttattatttatgaagatccaaatatagttaattaaaagcgtgactttgacaggcacacgatgggtcgattgaaaatctagccaagttgtacagtacaatatcttttacttgtcgttttttatactgacccggcctccaataatacatactcctaaccgttaattacctacttattactgtagaaaatcggtaaagttcagtagtatcgaagtaatttcatggaaaaatctaatgacatgattttcatttgtcgattccaaaaaaaatgctaagtcaatttaatttataagattaacgaaaataattctaaaatgacaaataaattagagagagagagagagtgtgtgtaagatcagagcgagagagattattcgtatgaggagtgtcacagtcaaatgtacagagaaatgaagaataatgcagcagtagtaattgactacaaaacaggaggtttggcctctctgtctgacccttttgtaaagttcgaaggcttccagatgatatgacaaaaatatttgcctttccctccacttgtttgtgcctgttggacaaatattttgag

SEQ ID NO: 13241 - DNA, 14428 bp, Oryza sativa
  unsure (1)..(14428): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttgttacagttcttaaaaatgatatttttgtctagaacatgtaacagttttcctgttgcaaaaaacagatagaaaacttgcaaataccaagttgtgttttcattaaaaaaacaagttcggtgattgggagtagagaagaaaaccaaagcttaaaatgtgaatgtaattgcagagaatgaaattgtagtgtaagcattgaaactgcaagcaaaacactaattaactcgagtgttacctgtgttctaattccattactaattgtatccccttcactgaccaaaactcatagtcaaccttgagcaggatgagctgctacagacccatggaagatgtgctgcaatatgaaggaccatcataagcaaggtagagctacttgttttttcttcaatttagtgagtcctacttataagtgtttaggaaatactgcctcccacaccatgtaaataaatttaaggaaaaaaggaggcaggacaagatgaagcgtttataatgcaaactattgaaaatcacaattcgtggatatgtgccatcaaatttgcttggaaactctctctctctctgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgattttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccatctccggcatcgacgacctcgtcttcccacccgggcagacgtttcggttcggcagcctcgacttcgtcaccagcaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcaccttcaccaacgtcaccagatcaagatgatggggcttacccaccgatcctgatgaagctccccgacgatttgacggccgtctccatcacgacagcgtctctttcccgtaggcctaggcggaagtcggcttcaataccgatttcgcctagcttcagggaagttggcgtcatcctccaaccactcggcacggtttagacggatcagctagatggcgactacagctctcccaccgtcgactcgcgccccaccgacatcgtggagtacgacgagtttagctctcgctaccacgacccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacggttacggcatgagcagcaggagcgtgagcggaccgcgaaggaggctgaggatcgacggcagcgagctttggaagcagggcgccgggcgcgtgatctcatcggccagcaagatgttgaagggacgccggtttttcgcacccctcaacagaatgcggttgccgcgatcaccctcctcgacaccctactcagggaaaacgagctcaatcaatccgatcacgtcgtcaacatcttgaaccagacgaagactatgattgcggcttcggtcccagttaactccgaaagcgtccatacgccgactggcagccgagtcccccacttccgatctcatgactaccgtcatccaagcctcagcatcaccggcgcaggatccaatcgcaggagcaggggccacgacgagcggtctgttcactcacctcccgatccccatagggagcgccgagtggaacggcctcgctcaccacctcgtcgccgccccgtcgatcttcgcgacacaatcatacagcgccgagcagctcgaggctatcatcactcgccggaccgccacgacgacgaccttgacggagtagcagccttcaccgacgacctgcgtcgagtggattggccagccggcttcaagccgactggaatagagaagtatgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcggaacttgttgcaaccgccagtcactcttctcgacagcattcgcgcgtcaacacgtttgacaagatcatgaactcccaatgcccgcaccatcctaactccaaccacgtggccaaagattgtttcgtctacaagcagttcgcggatcaatacaccaagactacacggaagaactccgatgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgccgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagctttgaagtcgccgatttcgagacagcataccatgccatactcggacgcccggcattagccaagttcatggccgtcccgcactacacttacatgatgatgaagatgcctggtccccgaggagtcctatccctacggagtgacatcaagcaagctgtcacatgcgacaaggagagttgcgacatggcccaaacccgcgagatggcgtctgcccgagaggatatccgactggctgcagccacggcgagcgaaggagaaatacctgctaccaagacttctaaaagtggagaaagcgaagctaagactaagaagattcccctagatccctctgatcctgctaaaactgctgtaataggcgccgagttagattgtaaataggaaagtgcgctcatcacctttcttcagaacaataaagatatctttgcgtggaaaccatctgatatgcccggtattcctagagaggtgattgagcactcattacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctagcaaacccagttctagttcggaagaaaacagggcaatggcgcatgtgtgttgattacactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgcccttcggggcatactgctacgtcaccatgccatttggactgaaaaacgcaggagcaacttatcaacgtatgatccagagatgcttctcaacgcagattggccgtaacgttgaagcttatgtggatgatgtagtcgtcaagaccaagcaaaaggatgatttgatctcggatctggaagaaaccttcgcgagcatccgtgctttcaggatgaaattaaaccctgaaaagtgcacattcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgaacgggggatgcccttctttaagctactaaagaaaacagatgatttccagtggggacctgaagcacagaaggccttcgaagatttcaagaaactcctcaccgagccaccggtcctagcctcaccacacctgcaggagccgttgttgctgtatgtatcagccacctcccaggttgtgagcactgtcttggtcgttgagcgtgaggaagaaggccatgtccagaaagtccagcgaccgatttattttgtcagcgaggtcctagccgactccaaaacgaggtaccctcaggttcagaagctgttatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagtgccaagaggatacccccgcggagaagatggagcactggaccatgcattttgacgggtcaaaaagactttcgggcactggagcaggagtggttctaatttcaccaactggagaaagattaagctatgtactttggatacatttttcggcgtcccacaacgtcgccgagtatgaggccctccttcatgggctgcggattgcaatttccctagggataaagcgtctaatagttagaggcgattcacagctggtagtcaaccaggttatgaaagagtggtcctgccttgatgacaatatgatggcatatcgacaagaggtacgcaaattggaagacaagttcgatggactcgaactaagtcatgttcttcgacacaataatgaagccgccgacagacttgccaactttggatccaagcgcgaggtggcgccttccgatgttttcgtcgaacacctttatacgccgacggtacctcacaaagatactgctcaaattgcgggcactcatgacgtagctatgattgaagccgactggcgagagcccctcatacgatttttgacttctcaagaactccctcaagacaaagatgaagccgagcggatttcaaggcggagcaaactttatgttatgcatgaagctgagttatacaagaaaagcccttcaggagttctgcaacgttgcgtatctttagaggaagggagacaattgctgaaagacatacattctgggatatgcggaaaccatgctgctgcacgcaccattgtcggcaaagcttaccggcagggttttttttggcctactgcagtgtccgacgccgacaaaattgtgcgcacgtgcgaaggttgccaatttttcgccagacaaattcatttaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggatcatcactgataatggcacacaattcactggcggagtttttaaagacttttgtgaagactttggaattaagatttgctatgcctcggtggcacaccccatgagcaatggacaggtggagcgagccaatggcatgatacttcaagggattaaagcgcgtgtctttgaccggctaaaaccctatgccggcaaatgggtgcaacagctgccatcggtgctttggtctttgcgaactacacccagtcgggccacaggccagtcaccttttttccttgtctacggggcagaagcaatgttgccgagtgaagttgaattcgaatctttgcgctttcgaaatttccgtgaagaacgctacgaagaggaccgagtggatgacttgcaccgattggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattattataataatggagtgtgattttttatcaattcaatttgcttacttggtttatcattgccttgttcgatttttctacttagtctgcgaggactgaaagttttttatagcttctttgggttttaggctcaacaaagcttgataaaagcttttaagaaatcaaagatttggctagaactatcaagcacagcataaatacaccagtattgtacaaattgagcctccatttgttacattcatactcagtcagagtcagtcctttcatcatcagagttattgttgctcggctgaaggtcgttgttgcggaattgctctacaacgtcacttgcaatcttatcagccgcattttgagcattgctgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattgaggaacatagcttggacaagtggtgtagcgacattggcaacttcatctcttgctcctttaagcctcttgattttatcaaccaggacgtcaaactgagcttgagatttgattttacggtctacaaaacacatttacaataagaatctgctacattaaaaagaggaaagttcagattgtcagctggcagtaccttcaacctccttcaaggccgagtccctttctgcagctagttctgctttgtcttttctcaaagcttcaatttgcttctccatttgagccatcctggtggcttgcgctgtttgaaatccgaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacagcttcaagagttcccaaatgaggaaccagcttttctaaggttgtggtcttggcctcattgcgaagatggattctctgcacggtggttcatggattagttttgctaacgagaaaacaaagtcatcaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcaccagtcggctgactttcggcagtcggctggctttcggcagtcggctcagcatctttggataaatttgactctgtggcagccggatcaggatcttttccagttggatctatatcggacggtttcctgcaaagtgtcctttcaatattcagcgtaatttctatgagagaagcatgccggaataaaatggtaccgagaggtttatacctggaagatgttctgatctttggcatttgacggccagccagttttttcctaggcatggtatgctttgggagtttattgggcgtgcccttgtccccagatttgttgctgtcatcgacttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgcggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcaaatgctgtgcgggatctctctttgattggagataatcgacacttaatgaaatgccgagtgatttgctctccctgtaagccttgctctttgagcttcagcatgcgttccatcagttctaaggcttgggcggcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgttcggttgaggcttaaggaaaaagattcggcggaacagagcaaaatgaggtctaatgcccaaaaaagcttcacagacatggacgaaatttgcaatatggactatggagttcggattcaaatgatgtacgctgattccatagaaattcagtatcccacggaagaactttgaggttggaagagcaaatccaccataaaagaaatgagagaagaccacgacctcgtgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagctttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcccagctctgtactgtagcaaggagtggggaaaatggcgagagttccggcggggaagacgaagcgtcgtttggatctcgggttttcttgttaagggtatcggaggtgcgaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttataatatttggtgggtaatctttagagtcttatattcggatgcctgtcaagtgtgttcattcgtgaactttttagagtgttaaccactcggatttcttttattatggctgaaaagcagtcggctggaatgcctctttaggcgccgcgtatgcttttgtcatatgatgcataattatgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgatttttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacactctctctctgctagtctgattcatccttgttagtgtaagagcagttagtgagaatatgtatgctacccgtgcaagcacattgagatgacagtgttacttgcaagttgcaacaccatatgcgatgacagcaatggaagagtctctgagtgcaagcatagggggacaaagcttttatactctatgcagccctgatacaaaaacaaaatggggtgccattcttccaccatcaggatttgatcttacttgtcaacaagcaattatcccacagcgtgtacagatcgagagctagcaacaaaacctggagaaatattggggcaggttggggatggcaactagcagtgagtgcgggctctggtctccggatggagacacaacaacaccaaaatgaagcagaccaaggccagctttcagagtccagatgaacatatggcaacttgagatgaacgacgtgcggcagttggatggaggcggtggcggcgggggaagtggtggtagggggagcgggagagcgggtagagaagggagcggcggccgacggcggtgaaggaaccgtcgacacgggagggggttcacaagatttaaaagttttaattgttgtttatttttactgaaacatttgatcgtccgattcgtttggaggaattgggcgcttgatttggaatctcctctgcaactaagagatgctcctaactttacccatccacatcctactaacattgcaacctcatcatatctgcaacgtcagagccaaaacaattagtgatagaacatcacagccggcaattaaattttaaagtatacattatttttctctattttgtatatatacatgcatttacagaaatatacattttccgcggtacaggaacacggcaccgtgccatcagtgcagctcgaaggcacggaacggacaggaggggcggtgccgcgggaccgacgtggtcctgcagattggtcgcacggcaccacttgcggtgccggtggtgcggcaccggcatctaagcacgcatgagtttttaataccgttcaaaacattgtttatttagttattgtttaactctgtttactactgttcacagagctggttccgcgcaatggaaccgcaggactgcattggtgctgcgtttttgagccgcgggactgtcacagtttcacagtttcggcccgtaggaccatcgcggttccgctcgcccgttcagcgggaacggcctggctagcgctctcgtgttcctgtattcaacctgtgggatacgtatgtttgtgctatttcttctcgtgtaagtatgtaaacctaaattattaaaaaaatagatataatctcaaaaaaaattctcacagccgctgttcgtgttgacactatcgaatttttttcatttttaaatttatttttttaatatttacagaaatattatatcagcagaaagatttacaaaaatagaccctgtcgccctctatttgggcggcaagctgacgtggcacacatgcgcatgacggtcattttagggggctgtgaattttgcacgtggcccccttgccgcccagtggggcctccgtgcaaaattcgcaagggcagtaaggggcttagatgcaaaaagaactagccaattgcttttttgggagggcaaaaattacatttagccccttgccgcccttacagaggactgtagggggctaagcgcaaaatgcgcacacggtgccgtcacgacgccgtgtgccacgtcaacttgctgcccaaatggagggcggcaggatctatttttgtaaatctttccattgatataatatttctgtaaatattaaaaaaataaatttaaaaatgaaaaaaattctgatactacctgccaaaaagtgagaaaggccgaaagacgccgccgtaggactccccctcgcagagaaggaataagttcactttgggtccctctatttgtcggttagtctgattttcgtcccttgaccgcaaaaccgggtatgacccgtcccccaacttacgaaaatcaggcaaacaaggtccctcggcagtatgaagggcggttttggccgacgtggcgcctacgtggctcgtttgactaggtcttcgtcccacgtggcactgacgtggcgattacgtggcattgacgtggcgctttcgtggcaattttatccgaaaaaataataaaaatcgtgggacccatatgttagctaaaaaaaaaaggtggggcccatttggttccacctatcagcctccctcctttctctcttccccctatac

SEQ ID NO: 13242 - DNA, 23624 bp, Oryza sativa
agagggggtagagagaagagggggctgatgtgggaccacatgggccccaccttttcttataatttttgtgtagctgacatgtgggtcccatgttttttttattatttttccaggaatcatttgtcacataagcgccacgttggacgaggacctagtcaaagggagccacgtaggcgtcacgtcatccaaaaccaggcacaatactgccgagcgaccttttttttgcacggagtcatacccggttttgctgggatgaaagccggactgggcgacatatagagggacctaatgtgaacttattcccgcagagaacgagatctgagcccatcttgctgtcgacgagtcacgaggagctccacttcagaactctaaaaataagagacatgacacacctgtgactgcacgagttgccctcaattcacttatcttgttcaccaaaattggatatcaccagtgtgacataagttttcacaaaatccatcggactggtatgtacagcaccttacagattccatacacaacatgcaccattcctaggaaaatatgactgctacatagttgcctccctagatgtaaaagatattaaggcaagcgacatgatcgtgcatatcaaaactaaaatgaaagagtatgagcatgacagatgactcaattcatcaatgccggggccacaaaccacataatattgtacaagttgagcaataaggcagggcacattcacaactttacccagcattgtggaagtccttcagatctgattttgacaaggatcagctcatctctgaccacagaaacagtggcatcaaggcagcctttgctgtttatatcagtcatcatcagtatcatctgtcttctgcttcttccacttataggccgcttcgaggatcttgaggtttggtgccagcgcaacctcatcagggaaaatataatccatgtactcctcatacctactaaggtttaggaaaatgttttatcagcacatttgttccctaaattgcaggcagcctaaatggaaaacaagctatgcgaacagattaggagtcaaaactatttattgtctccttttgttataccaaatttcttaacctccttttaagggcagatagcacagagtaaaatgaaacttgttagagaaactatagaagaatgaaataattgagtaaggcacatacgcagtagtggagccatcctctgaaggatctggtctctttctcttcactttccttggtgcctttttctgcactaaggtaacatcaccgagatgaccaaagctcacctccttattaagccattcttcaaggagcattgctctttcctcctttaactctggagcactagttctgaagtattcaaatgcccgttcaaatacagctgaaaattgcaataaagaagaggttagatttattgcactatgaatgacaaaaggaacagaggtactcaactggacaaagtaaatttgttctccaaattctgtttacctcggcaccttcgaacctgctctatctgctgttgttgataactaacttcatttttaatctcctcactttgactgtcttccccacccaaaccaactgaggcctcaaaactcagcatagctaatccataccttcaaatcctttgttctatcaagcaatctctcgtagagttcacaagttctgtggaattcatttttatcaatttcaaactgcaagtattcctgtaagatacaaaaaaggaaatgattaagaatatacatagcaaacaaacaaaaggaatttcatattttaaggtactcttggctgactaaaattttaaggtggtctatagattttctaagatcactactttatggctgtctgaattctcaaatattgtaacaaggattgatgctgtacaacagttttgtataaataattttataacagtttctgcagtaattaattattctagtgaaattaatgagagaatctgtcaatcataataggacctaactatttaaaaaacttcctaaaaggcccaaattttcaaaatgttctgtattctggacatcttttttccttagaatgataaataaactgaaaatcaaaatatttactagtgatgtttacaatgcatggctcattaacttctgtattgataaataaactgaaaatcaaaatattttcaacaatgaatataatggtacctttaaattataaatacatatattgttggactatggaatatggatggtcaaacattataaaatatgaatgttggaatgcttaggtaccacagcaattccgaaagcacaaggaagcaagttttttttatgtgcgggtgttgtctcagacaatgtcaattcaacaaatcactagaatatgaaattcaactgatttaggaactaaaggctaaagccatgctaggaaatatctatcacttttagtctgaaagccataaaaatgacgatatattaggataatagaaagaataacataccttccacagaacttccggcgtatcaagggctgactgtgcaatagcaagctcatagatcgagcgagctctatcagtctcaccaaggctcttctctaattcggcatacttcatccaggcataacagtttgctggagaccattcaatatacttctcatagagagtcctacaacgttcaaaattacccagatacaactcaatctcaatgtactttttgaatatcttgccctttggagccatcccaatagcatttccaagaatccgccgtgcagccttaagattcttctgccttatctcaaactgggctgccatgagccacatcttagaaaaagtgagtttcttgtgtggaatcaatttgagacactcgctgtaaacttccctggtccgttccatgtcctttgcatcaagctcctcatacaaagcataatttatccatagataaatgtatcgttgccagtaacgcttctcctctgcaggtgggatattagcaatggctctctcatacacctccctgatcctgtccttgttcccaacactctcctcaagcctaatgtaatcaaaccatgaatcataattgagggggtttttcctcacctcgtcctcatactggaatctcctcttacccacaatggcgtcctcaattccttcacggtcaccaaactgtttttcaaaggcaaggaacttcctgtacagctcttcagcctggcctttgggcaccctgtcaagtgcatacttgtacactgcacgggcgcgctcgacctcccggcacctttcctcaaactcagcaaaggctacaaacaaaacctcagcatgctcatcatctgccagcaggtctgctgcacgctcgtacacccgtcgtgcccgctccacctctccgcgcttcatctcaaactttgcgtacaggatgaatgtatgtggctgcgggtgttcggccacaaaacgttcaaagatggcccgcacacgctcaatttcaccgtatcttagctcaaatttgatgtacgagttccaaccagctgcgtcaggacgccatgccatccacagctcaaacaccttgcgggcgttggcgacggctccaagcacttgctccatatggatgtacttgtaccagagctggtcctggtccacccagggcaggagggagacggcgcgatcacacacattacattcggttcatatgccgattccgcatctcgaactcggcatatccacgccacgccagagcgtgtggtcgcggtgggcgacgtcgagggcgcgctcgtagacggagcgcgcgcgggcgaagtccccctgccgctcctcccacctggcgtacttgacccacgcgccgacgttccaccgggcgcggcggatggcgtcctcgaactccttgcggcggcggaggcggtactcggagagctcgacggagtcggcgatcttctgcttggggggacggacctcgggctcctgccgctccgggcctcgcgcaggatctgctccgcggtgatctggaccgaggccggggtcttgttcttcacgcgcgtcgcccggggcagcttcacctccgtgtcccgcttggtgaggaacccgagggtcgggtcggaggcggatgacggcgccatgtcgccggcggcggcggcggcggcgcggatggcgagcgccatggccgccggtggtgatggggagagagagctagggttagggctcgggagggccggagggagggaggaagaggaggggattttcgagttggtgcgtttgggccgtacgatctggatgcgacggtgggggttgatcgggtttcgcaaacgggggcaagccgccaagcccgcgcgtgggctatatgattgggtttttgggtagatgggctttgtgatggatccgcagcgcggctcgaattcggtttcgggtgcttggctcgagttcggtttgcgctagccctgtggtagggcgagtggtgcggtggccctgggccccgccgtgataagggcctcgatcagtcttgattaatcctaacactggattatttattcaccgttccacacattttctcctctctcttctttattgagatgattattgatggtatttaatataaccaccactaaatacaggatcgatcactgatacatgttgatacgtacaattatagttatcactgcattttcttataaaaatgctagcatgaattacttgatactgtcacaattttctcaaagtcgtggaactattaataggaaattggattgtgtttgcaatgttgtctctacaataattacaataatttaataagtataagcttacctagcgtagcgtagtgtcatcgtaatcgtaatttgggctggtttattttatgatggtgggagtggggccaaagtataggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcgcacggcacggcccggcacggcccgtcaggccgaaaagcgccggcggcgcgtgacagactgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtagaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttccatttttaattttttttccttatacatttcctttccttttttaaaaaaaaaaaaacactgtgcttcacgggccgccgtgccccgaacggcccgtgggcctcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctaggccaaagtaactcatcctaacctagaggatgcaattattcaggtttagtaggacacctcttatctatgctttctccttactctgttagatatgtgatttagggtcttatgatctttatctatcaggcgtatgtgtgtagagcgtgtattgcatttgtatgttctatttagaagatatattagctctacaatcgttaagaaaaaaatattctacatattatacccattgagggcctctatttttatttcgctctgggcctccgaaatgttaggaccggccttgaacacattttgagaagataccagagaagagagaaatagcatcgggttgtagatttgtagccagctacagcacggactccaagatatgacaggtgtgggaccaagtttgaattgtgtagtatatatctataggtaactattgtataaattagctactaaattaactatatatgatttggagttagtagttggctatactattaaacttactcttaggctgtgttcttcctccacatttcccaactcatctgccttgtgtctcgtgtgcatgttttttaaattgctaaacggtgtgtttttttaaaaggtttcaatacaaaagttgctttaaaaattatactaatctattttttaaaacaataataaatatttaattaatcataagaaaatgcgtcactccgtaaacatgtctctggtgtctagaaaaaacaaaaaaccttagtgtctccggtagtgttaacaacgaaagttggtaaatttacatcggatttggagttaaggccgaagcggatttggaaggaaatcgataacggaaacagggtatgaatcggcttcggaaccgcatcggctacagtgtgcatcagcagttaccgaatcggacaaggcaagccgatgtagccgattccggcaaggtgatattggaatcattgtcggattaagttgatgtgcttcatgatgattgccatgtatggatcgagtccgaagaaggcagttgtatctattaattaggaatagtttgttagttttctttttatctttaggaaagtgtgtttagtgtcctataaggactttatgttttccttttatctttaggaaagtttctttcttgtcctataaggactattatctacccatgggtataaatatgtacacctggggtcattgtaaactatcttcacgatcaatacaattcggcgcatcgccacccttttcacttccacttttgtttttacgttccggcggaacttggcacctgacgcggggctgcatcgtcttcgatctttggcgaagggataagtccaatgtttcgccggcccaggcaattgtatcgtctacgtcggcgtcgttcaaggctgcaacagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctatcaccctgaaaactcagtcaacggcttgattgtctagatattgtgtttttttttcatacttagtgctgcatcagttaagtttgatctactaagtcgtgcttagaaccataatctctagcctgcttcttgattgccaataagggttttattggggtttcagccggtgagttatctagacgttgcatcggctcataaggattgctatacatataagttggatttagccgatgacaacaaaagtttcactatttaatctaatcttgtggatttcatgacatcggacctccagccgatgtgtgctttaaccttcggatcgatgcttatttatcatatcattatttgtcgattggtttatactagattatattgttattttattacatcatcatcagccgattgcctttatatcattatctacattggacatatagccgattacttaaaccctatcgctatcggctggtatcggtatcggctattatcggctatcgaccggaactactccatcggcttgtcagccaatcggctgttttgatctactatttgcatatcttgtcagttgcaggatcaaactgactggcacgcccgcatctcatcaagatttggacctgcacaggaactaagcagatctcccaggccagtgtgttcgattttttcgtcaacacaaattagcacgcctggtgggaccacgaattttatatccacatgtctgaagaagaagtcaattccaagatcatggtcacggtggtgaatttaatggaggaacaacaatattggctcggggggcaagcatatcagtttcagcatggtggagtacatcagtatcggctcatgaaagccgattacaagatagagaaagaagataattttgaagcatgagttctcatacttcaaaagtggagggcatgtgttaatagtgaaatttggtaagcccggagtagtcatcggcttagagtcagcatcggcttcgaagtcctgagattagccgatgagagttgtcaagtcgttagttgtcggattcttgctatattcggttaaggaaatttatctactaaaggaagcttatccagaagagaccgaattcaaagagaatgcggcatggcaagttatctattaattatgaatagtttgttagtttccttttatctttaggaaagtgtgtttagtgtcctataaggactttatcttttccttttatatttaggaatgtttctttcttgtccgacaaggacttgtatcaacccatggatataaatatgtacacccggggtctatgtaatctatcgctacgatcaatataattcggcgcatcaccaccttttaccttttctactttattttatcgtccaacgggacttggcacctgacgcggggctgcatcggtgttcgatctcttgctaaggggtaagtccaatgttccaccggcctaggcaattgtatcgtttacgtcggcgtcgttcaagggtgcatcagtacattcgacctcttggattgctctggttcggatgatatacttgcctacctatttatcatatgtctctgttaatctagtcttagcatatcaatttagctctatcggctgcttctcgttttagggtttctaccggtatcggctaaatcccgttactagattagattagcttagacatctaccaccctgaaaactcagtcaatggcttgattatctagatattatgtttcttttcatacttagtgctgcatcagttaagtttgatctactaagtcgtgcttagaaccataatctctagcctgctttttgattgccaataaggttttcatcggggtttcagccgatgagttatttggatgttgcatcggcttacaaggattgcatacatattggatttagctgatcgcaagaaaggttttactgtttaacctaatcttgtggattttatgacatcggacctccagccgatgtatgctttaaccgtcggatcagtgcttgttctattatatcatattgctagccgattggtttatactggattatattgttattttattacatcatcatcagccgattgccattatattagtatctacattggacatatagccgattgcttaaaccttatcgctatcggctggtatcagcatcggctattatcggctatcggttggaactactccatcggcttgtcagccgatcggctgttttatctgctgtttacatatcttgtcagttgaaggatcaaactgactggcacgctcgcatctcatcaatcgttggacctgcacaggagttaagcagatctcccaggccggtgtgttcgattttttcgtcaacaagtagtgaagcagcccgaattcagattttctagaagatatttttttcagggacgggggtgaattttattgattaaatagagtcattacaatctcgcagaacaagatcatgaacataaagtaggagcatcaagtctccacaccgcactatgtcaagtccttctatttaactaagctagttcatgatccactcaattacaccctcttccaacatgatttagaccgatttcctacaagattttctatggacacgactagattgacgcgtgggtttctccacacatattggtggcatacggcatacccattaggggtgaaatcgctaatacatgactagccatgcgcctctcccccgcgccgccatgtggcgcgcgcggagagggggcacgcggtggaggaacatgtgcgcgattctttttttttcggtttttctcttgtttccattcggttttttcgtggctttttttttttatttttttttgtttttcccttttggttttttctggtttttatacaactttatatgcgtatgtatagaaactctatatacgtacacaaagtttgtatatgtgcatataaaaaatttatatatgtgtctttttttatacgtatgtatacaaactttgtgtataaggtatacaagtttgtacacgcatatgaagtttatatacatgtatatatattttttatactcttttttttgttttttaatacatactccctccatacccacaaaacaagtcgtttaggacaaaattgtgcttactaaggagtgattaatttgaggctattcttccatgtctgcccctattaaatgagggtgcgggtgcattcatttgagaagcaaacagagctcaaatggctactgcagtgaggtttgaaggttgagtgcttgggttcgatacttggtgagctcattacttttttgctgattttgcatggcgcttgcgtgtgtatttttgggcacgtatttttcgttttttcgtctgggcactccgtttttgcgtatttttgggcgcgtatttttcgttttttcgtctgggcactccgttttttttttctgattttgcatggcgctctagcgggtgttttttgggcgcatatttttcgttcttttcacgggtagatgtcgtttcagtttcaccatgcctatttaaacggcttcttctctttccattattgtgcttaacctgctcactttcagtccgcgagagtttccatctactgcatgcaaggctgttccagctgttgctggctttgatttgaatgtccgcctagaagaagatgaggacggcaatgttcccttccatctcaacgagccaatattggaggatcacaacgttaatggtaatgtgtttgttctttccttttttttatattcacaacaacaacatcaactaagtttctattctaagttttttctttcctttttccgacaggatttgatttgaacatgccactagatgaatttggtgtagttgatttagatttttttacaaaaccacgctggtaatcttgatctcagtttgttctttcctttttcatttttttattaaagcagtggctattttttttgaatgtgcttgttttttttctttgactagaacatgctgtacagaaccaagctcctgttgaaggacaacatcgaaggaaggacatgacagaagaagtcacaaaacaagtgtactaagcattgttgaaggacaacaagaatgggaaactaggcaagaaagatacaagaagggttgctgatcaatttggagtgcacattcgatcagttcagcgcttatggaagcgaggtaaaatccaacttgctcataacattccggttgtggttgctagtcacaagaagggtagatctggtcgtaaggcaatccctcttgatttggaacaattgcgcaacattcctctcaagcaaagaatgaccatagaagatgtgtctagtaaactaggtatttccaaatctaggatacaaaggtatttgaaaaaaggtttgcttagacggcactctagtagcatcaaaccatacctcacagatgctaacaagaagactaggttgaagtggtgtgttgacatgattgatcaaagtttggttggtgatccaagatttaaggatttttttgactatgtgttcattgatgaaaaatggttctacctctctcaaaaatctgagaagtattacttgctacccgaggaagatgaaccacatcgcgcttgtaagaacaagaattacatccctaggctcatgttcttgtgtgtttgtgctcggccaaggtttaggaatggagaatgtgtttttatggtaaaattggttgttttccacttgtcacttatgaacatgctgtgagaagtagtcagaatcgtctttgtggagaactagtaatcaagccaataacttcaataacaagagatgtgattagagatttcatggtaaacaaagtgttgcctgccattcgagccaaatggccaagagaagatgtgaacaaaccaatttttatacaacaagataatgcaccttcccatttgatattggatgatcctgttttttgtgaggctgctagggaagaagggtttgacattcgcctagtttgtcaaccacccaattctccagattttaacattctagacttggggttttttcgagctattcaagcaattcaataaaaaaggaggcaaagacaataaaagatctagttccagccgtggaacatgtaaatggatccattgttcacttgtttcattgttttgttcaacaattaaagtactcggtgaaagatttattccacacatgttttgtaggcattcttagagtactctccatggaaagcaaacagaatgtttgtaacactacaaactgttttgaaggaagccatgaaagtaaaaggtggcaacaagatcaaaattcctcacatgcaaaaggaaaaactagagagagaagatcggctgccattgcaaatctcatgtgaagcatccttgcttgctgaatgcattgctagtctcgctgcagcaaattagaagtagaatattagatgatgcaagcatgttagtctttgcaacatgctagccgaagcaagaatattagcagcaaattagtttttgcttgcatgttaagtcgactgaatgagacatgtaacttactattcttgcttcatctttgcatcttccaactccttcatactgtagatctcgtccaactttttgataacgtgctcaggaagaagtatggtttcaccatccatttgaagtttctccacatcaggaatgtataactcacaatcaaacttttccatgttaagcaaaaaccttgctatgaggtcgtagtcttcatgtaaaaggccacaacgggcacacttgcgagcacggcggcgagcttggaagcatgcttctccgaagacgccgccagcgtggaatgtgccgcagcgaggacactgcaccacctcgacggactctggtaccacctcgacagagtccggcacctcgacggagtccaacgccatctccgattctagcccctcgacggagtccagcgcgttgacgatgtccagggtgtcgacggagtctggcacctcgacggacttcagcgactcgacgtactccatggcgcgaccaagctctgaaccctaactatagccgggcggcgaggaagagagacgcgcatgtgcgagcggcaagcgacgagcgtgtgctgcatgcgggagatgaagaggaaagatcgagcgccattaatcacgtccattcagcttaaggcggcattaatcacgtcgcctcgtttcttgcctcgccgctcgttgctcggctctcgcgtcaggggcatacgtgtccaaactaaaccccgctgaggaacgacgacttgttttgtgaaaacgggtaagagcccagaacgactttgttttgtgggtatggagggagtatgtatataaactttgtatatgtaaacaaagtttatacatacgaatataaagtttgtatacacgtatatattttttatatacgttaaaagtgcatggatatatataaaatttttatatatatgttgtatatacacgtatgtatatttatatacatataaactttgtattcacatatacaaagttacatgtatgtacatacgtctattgtaaatagaaacagtacactagaaggaattagcatatgtatgattgatctctttttattaataattaaaattaaaaatagttaacttgacactacgctaaaaatgctatattttgggacggaggagccagaacggacgttttcatttttgcgtcgaagacggccccgattgcacattgcaggccggaaaccggccgagcccacccattagaaaggacggacccaccgtgcagagctctcctccgctccccggcccggtcacgccgccaccgccgtcgccaccgctccccgccggccgttgtccgtctctctcgccgcaacctcgaccacgacctggggctggggcaggctccgcctcgccgccgcccggcgactgccagtcaggctcgcctcgagccctttccgagcccaacccgtagctataggccctaaagtggagttaggtccaacgccacattgcctcgccgacgcaagtagcccaccgcaccactgtctcgtcgactccgctgctctacaacgaccactccccgaacccggattgagagcgagcgagagcgcgcgcgcggggagaagccgagggtgaagtcgtcgtcgtcggcggcggcggcggcggaggaggaggaggaggagacgacgatgcagtggtacctggtggccgcgctcctcaccgtcctcaccagctcgcaggcaagccccggccccccctccctaaaccctccacctcatcttccccttcctcttcccgcgacgcgctgtccagatctacgcgctttgggtttttcgtcgacgcgtggagcagaggcctctgtaggaggcggcggcggtggcggcggttgctgctgcttcgatctgcggcgatgtgcgtaatttgatccattggagttgtggtttggagaaatgcagttcagataaggtgtggcctgggggtccgtgcctgcttcagggagcagctacctgagcaggcgtgttctgaaggtgtccattttattcccttgttggggatgggtttttggtggaattgtgaagttctctaggtgtttgcaagttgatgtaaatggtcacggggacgcaccatgtagaacaaacttataattccattgcgggaatgtgtcattccgttcggttagtatggcatgaagatggcccttcatttttcatactagacaactatccagaccattatggtcattttgcacatttcctggtgttccaaacagaattctacttacagttaattccagaaatggaaaaataataggagtaaaatatccttatgagaagaaagagaagaagaaatcaagatattaaatgcaaaagaaatcaagaacatgaccaatcttcagcgcgcaaccaagggctatgacctgacgaagaatctcgggctagaaatagtgcggcattagggaggttaagatggtgagtgacttctctggagcttgcccagcagttatgagatagtagtgtactccagaagggtacaccagaatagcatggtactgaaatgtttgattccaagcgccaaaccagaatgacccacagaacaaaactgacaacttgatgtagaaaacccaatcattggaggttaacgagcagacttcatggtcatagttaaattaacttaagttattctagaaattgtccattacttgtttttttccttcaattgcatggtttattttctaagctctagagtttttaattctcttgcatatgtgcagggtatcttgactaccctctcgcagagcaatggcaaatataagtacgactacgcaaccattccatttctcgcagaactcttcaaggtacatgaagtttatgctattgtttacagtgatatctgtatatcctagttactgaaggcactcaagagataacattcatctatttatttattctgcatgctgatgttaacctgttcttgatacagctgtctttctcaagcttctttctttggaaggaatgccagtcttcatctccaccaaggatgacaaaagagtggaggagtatacgactataccttgttccttcagtcatatatctcatccacaacaatgtgcagtttgccaccttgacctatgttgatccatctacctatcagataatgggaaaccttaaaattgtcacaactggaattctgtttaggtgactcttttgtaccttaatgtcaaatatttccactgttattcttcctgatattattggcatgatagaatatatattaaatatccttgtgtactctgcttcatttgataaaattcaaacttcaagtgcattctgaacttgaaagcagtcaaagacttatccaaaataacatacacgatagaaatttttagcttgtcttcaaattttaagcagcttacccataatgccaattgtcattagcatatattatctgtatgtttgatgattcttgataatttaaattttatattttcaactattctggtggttcactatatgacactcttttgttgtttaaggtttgccctgacccttgaaattcagttgacttaatgtccgttttttcaggtcataaaataatttaatttgctacactgcaatcaattcactgaaatagctatacattttttcattttaatgtttcttgctccacaaagtaagaatatcaactagtaagaattgtgcaccacacaagtgttgcagagccattgaatttgtgacagctgacaattgagaaatcaatatcttatgtttgtgtttcaaaacttatgcattgcaactagatattgacacttcatttagttgaccagccaacatgctgaccaaattaatttctggtgcttgattgattaagtctcattttctctctaaactgtataggcttgtcctaaaaaggaagttgtcaaatctacaatggatggcagtagttttactggctgttggaactactacaagtcaggtttgtgaacattttgaaactttattcccttttgttttagcatatactattgggttatgcttatgttatctcacaaaactcctcatacaaacatgttacaaaaaatggactggtggcctgactggaaaaaaaaacctagtctggtcggtttaaataaaataatgattgagagaaaatccaggcagattgacttttgctactgttgaggcttctggggttcaaacctgggatcttgagtcccccgaatgcatggattgggcctctaaccaactgagctgagctacacatttgatttatgggagatcttgtagatatttaaaaaatgtttttattatgtgtagccttaaaatctattgaaaatatcatttccaaactggccagttcaccggttaactggtcagatcagcaaacaatgaaccagcaaatgaccagttcaaccatacatgttttttcatactacgataccacggatgactgcttcatcctttatggggcactcgtcttagtggcatgtgtgtgtggatccaccttgtaagtgtgataatcattgatccgttctgatagtagaaaacatatttaagtctgcctaacttatatgtttttaacttgatggccgcaaactttgtgaacatgtaactgagtaatatgtgactgtatttttttcttctattctttggtgcggtatatttacacctgatatacatgctccaagattggatttttcataatgtttcacacttactcaggtttccaatagatatacatataaaaatcagatttctgatgttcattagatgatcgcaagctatttaatgtgtaggaaagatccactgatattggacacttctccttttttcatgtcaaaatacactgcaataccattaatttttctttgaatattttactgtaactatgttaagtcactaaatttgtttttcttactacccttctgttgcttacaggttaaaggatgtggcgatgctccatgtgattctcttttttcagccccatttcagggttacatgcttgggatactttctgcttgcctttctgcactagctggtgtctacactgaatatttgatgaagaagaataatgatagtctgtactggcaaaatgtacaattatatacgtaggtatctatatctaactctggtccattgtcacagacctgcacaggccaaataccttccattttcagtgtgcatattttctgactatacatttgattgcatcaaaacaattttaaggctacctggtgtgctgtcacaccaggtgtggcaaacactatttcacacttatcttatgcactgtcaggtttggtgttatattcaacatgggatggcttatctatggtgacttcaaagctggatttgagaggggtccatggtggcagcgtctttttaatggctattctatcacaacgtggatggttgtgttcaatttagggtctactggccttctggtctcatggctgatgaagtattctgacaatatagtcaaggtgacagtttattcttaatcttagctgtgcagaaaaaaatcatctcactagcgtgtttcctttatactgtgaaagacgtaaatgaagataaagttcacaatataaaaataagttatccacagatccaaaatccatggacgatagcatggggtcagtcatccacctacatatacacatgcaaaagaatcaagatatgcctgattctagtgcctgcagtgcagattgatactgtgtatttgatttcatgccaattacgtatttgctatttgtcaaagaaaactagttgaccagactcttcaatctttagagagcatgctttatttgtactgtacatttgtctttaagaaaacatggaaaaacaagtatatttggtgtcctaaagcaggataatgtggttattcatgtgtgctgaacataagattttcaccatactgaactagttaattttttttgtgagtttgtttcttctcttttctttccttggttgagctagctgctattcattcccaatgcctttctactggccactccttgataactccattttcctgtccaatcaagtgacccatggagcggcagttcaaactttcgcctatagacattattattttttgtcagattcattgaaattaatagaccttttttcagtggtacttttttttttaacaaaacgatgagcgccgttttcattgaatatagaaggggtaaactgtacacaaaggaactgtaaaagtaaggggccttaggccctagctaactatactgtaagccagtctccgagtctttttgctcctgccaagacccaacccaagttttagcctcctccttgatttttgccatcaaactggccgtcgagagctctttttgttggaaggttctccggttcctctcgttccaaatctcccaggtcactagcagcgttaaggtgcatagtgcctttttgggtactccttttgtgtttgcgatggcctcccaccactctagcactgtcaaaatatgttgccgctgggtggggtttagctgggcgcaagcggtgcagtctgctagtgccgcccagatcctttttcagtggtacttgtattggggtttagcaaaatgttaatgccatcacaaatctgtagacagtaagaaggatatgccttttttatcttatacaattgaagttgaaggattgtcttatgaacctctatttgaacaggtgtactcaacttcaatggccatgcttttaacaatggtattgtctgtatatcttttcaatgtgagagcaacacttcaggtacctctttttttttttttttttggttattggagccctttcatccgtttcagtttattcaattttttttacatgttggatatgaaaccatgtagattactgttcatacttacacatgctctatcccctcccttttacagcttttcctaggcattgtcatctgcataatttccctgcagatgtattttatgcctgtgaacatgcttgttgaattgccacaagcattgccagttacttcaaagtaggtacatgccagtgatgccactgttgtttaacctgttgatcagtgtgtacggtcttctgatttaagcagaaaggttagttgattatttatagctcagcttttgtgagtaatcccatggaaatcggaggctgcaatctccacagcatatgtgtacagtgtcatgtttcagataacgtgaaagaagagtggagcaaacatgggtttactgctacactttgccaattttttggcaaaaaggtgaaagcatgccttggaaaaggaaatccagaatccctatacattctttagttagtgcttaatggtttattcaccttgtatctaaattttctgacattcagtggatgcaaaactggtgagtgatcatgaaatagtaaatctttgcagaaaatttaagattccctcgtcagttgcaatattgcagcacagcagcatccatacttttttttttgtttcaggtaggatgcagaacttatttttatcacttgtcgagcagagctcctacattattttcaagacaaaaatgatttgataatacatatttgacatcataatcaaataatctattttttttctacgatgtaaatagcgtagttgacaatatgtcagatgacatattccaccgggactagtttctagcatcttttattctattaccctgtatttggatcatcaacaattacacgtaagggttttccattcctgctggcggtaactatctaagcttattgtgaggcatggacttgtcaaaattcatttgatttacaaaggtataacattgcaaaatcaatttagttaatgaatcagattgtttattaggctctgttttcttgtcatactgctgcagttgcttaacccttgatatgcatcccatcccatgatttgcaaaactagaaattctatgatgtccagataaaatttgcccatggaaatggagggcccctcctatagtaccgtacctagaatgatgtaaaatgctttcccaaggatggagtttgtatgttgtctttggcttgcgtgcaataccaagcttgctggtcagtggtcactgaaatatctttgaaactgccatatggttattgttgttcattggaaaacgatataagttggtgtaaatgtgcttgaaaattgatgctagggtttgtgggccgccccttgttttgctaattttagttctgcccagaacccttgaatagtgtgcctggtctcaaactgaatttaagtccttgttagcctgtataacaagtatatcttgttattcctcactacagtagtactagtaactacttcctccgtttcatatttatataagactttctagcatt

SEQ ID NO: 13243 - DNA, 30553 bp, Oryza sativa
gtgggcaatgctagaaagtcttataacctgaaattgaggtagtacttaatactatatgttggccttcggaaatagtgaaacatgtgaatgattaggataattgctagtttctgtttcagaaatttggccactgttaccttgtacaaaatcaggattttgtgtgttcgacatattgttagaagccatacatgtgaatcttttgctaattctgtgccctccactcctgagcttatcattcaaacccaggtagtttatgttttttttttagtggcatttccaggattgaatttttggtttctttccctccatcaagaaatatcttgagtggcaattttcaggacagagggattctttcccctccctcaagaaagcttttcacttccagctgagctagctgtagtctactttctagggttctaaaggcttacccatctgaccgcatgaacagtggacattcctttatctggctagtatgggttaagggataacttgcttttcatgtacataaaaaatgagtctaatgctttctcaaatttagttcttttatgcatgtttggttttttcaacactataaatgttcacttcattcatatgtgagaattgagatgcaaaatatgttagctgtcacaaacttaagttacctgcatcagctggaaatttgtctcagtgcatactcttatggaacttgacaggtgtcatactacaattatgcaaatgcttttctttttttttttaccctgatctcagtaccgtagtgcagctgtatccctttgggggaaggaattgatttaaaaattggaaaatcaattgattatatcaattcttcctgtataaatgtctgtatttttttttagtcaagtgatctcttggagcgaacatgcttttgccgattatattcttgatcgttccttttggagctgttgggaggaaaaaggtaaggtgggcaatatggcttgtcatgacagcattgtgtttgatatttcaagtaggcattgctaaagaagaaaagaaatatccctagtaaccataaaggcagaaagtggtatgcaaaaaattggagaaggtaaccatcggccaccaccgatgaatgacctgaaaagaatgtctctgttaggtggaaatcaactgtggttttcccagttcactggtttcccttcctcctgtgtcctgacctttacctcttccccgtcttgagagtaaaaggcaaagcaaaactgaccatgtaatgtacatacatttcatgccctacatggcactggagaaagagacatgctgtacatggaatggatatcgcctctgccattgcagtgaggtctcttccttctatattcttatatgttgcgggcaaaagcctatgcaaggggtggatgtggtttttggtgttgtttttaatgcggaactcttttttctgaatcctatcaaactttttttctatacttttttttttgtgttccaaaggtgtcttgtttcaactggacaagcaatctgaaaaaaataaaaacagaaagaaatgtgggtttaccgtgttgcctgcctgaaacaaagatgctgtttgtgcacaagcacacgtacggcgcccccagtttgttgtcgcccatagcatcggcgtccgaagtggccactgcagtgcgtgcgtgagactgaagcagcaagtcacatccgtggaacggaaatgcttataccacaagctagttctgtgttgcatgccgaactcgtgcaccgctcatccgaaccacattccattatccccctcatacgccctaacagttttaaaaatttccccatcggttgtccccgaattgaattcaggttattgtttcagtcgtaactgattttgaatttaattagagggtccgtcttttcctttttgtcactctgttttaacttgagtaaatttcacaaaactacatgttttatagttcaagttgcagaaaaccacacacactttaacacttgggacttaagtatatatattttaaagtgtagaatgaatggattcacccgcgatatgacgtgactgtttcacctaggacgagaacatggcatcctattatcagccatcgcacgaaattaataggatgccacgtcctcatcttagatggaacaaccacgtcatctcacggataaatccatttatcgatagtgtggttttgtgaaactaaactatcaaaatatatgtacttaagtgccaagtgtcaaaatatgtgtggttttgtgtgtggttttctgcaacttgaaccataaaatatatgtagttttgtgaaatttactcattttaacttctactttactatgttagtaaaaatataaaattctagatataatcattgtgcagattagtagcgagaagttaatttttgctgagacaaagagtacttcactatgagtagcaatataaaattttaccctgaaataattttcgtagacttataatggacaccctactgttcgttccttttctcttaccgatctaaatggcgtggttttaagaaacttacttcataagaaagctttccaaattcaccttgttaactttttaatatttatttgtgcccttaaataatactccctccatcccattttaagtgaagttttgggtttctatgtctaacatttaaccgtccgttttatttgaaaaatttataaaatatttttaaaaaataagtcatgcataaattactattaatattttatcatctaataacaacagaaatactaataattttattttaaataagacgaagagacaaacgtttaaaaaaaaatccaaaactgggagtagtaataaactctgtgtgattcataatggatcatccatcagaatatatatatagtaccgaaaagaaaattcaaataaagatgaatcatcagacttccacacaaaatgattagcagcagcatgagtggcacggcatatcccagcctcttaattaaaccccactcgtaattaaatggtgcgcgccaactatgcttaattcaacatctcaccactaaaaactcgcgatctccacttctccgcgccacaatccatctctctagcactctccacaccattcgttcctctcctcctcccctataaaaaccctcacactcatcagcaaccttctctgtactgcgaccaacgacaaacaccacaagctaagtaaggagtaagtagctttgcaagattcagcacaaatgggatcgttgggccctgctgttgtggtgagcgcgagcgcggcgaagatggccggcggcgggcagcagccgtcgacggagaggaaggagacgtcgtcggcgttcggcggcgggtgctgcggcggcggcttccagatgccgctgcactacccgcggtacaagaaggcggactacgaggcgatgccggagtggcgcgtggactgcctcctccgggagtacggcctccccgtcgacggcggcgtggaggagaagcggaggttcgccatgggcgccttcctctggcccgaccagtactgaagcttgctgtgcttcgccttggagatattcagaagccgatcgagcagggtaccagtaactgcatgatgctaatttgattaggagcgctctatatatattaattaatctattatgtgtttttattatgctgagctcgtgttaatctgtcatccgcatataatggcgccatggaaatatggaatgatgatgttgtaaatatttcctactactacgttcataaagatatggaagaatacattattttgctcttaaattaattatgttggtggacgtttaattatgcatgcaattttcaaaatttatatttatatcagtgaaaaatgtgttatgcgtccgcctcctcgtcctgggctcattaatcaacagcaaaagtgcaaacaggttgtggcgatcctggttgtcttgcttggcgaatggcgatggggcagtacgagggaagagtggttcctcttctctctctctcgctctctccaattctccatctgcatctccaagccaggatggtaaccgagagctcttgcgatccgtttcagtgatcaaagtattgctggtgttggacggttgtagatctactgtaggtgtagctgcagtcggcctcgtattgcaacggtcagttcagtgctagctttctttcctcaatggtgtgtattagtattgttggcatcacaactaaaaaaacatttttccacgcggttgaggcgtttgtctgtacagaaaggtctaaaaaataacgttcgctattttcgcatgtgggtgcttatgttggccacatgcaaaaataaaaatccaaaaaaaatctcaaaaaggaagaaaaatcgaaaccctagctcctgatggtggcagtggtgcggatccggctgtcgcagcgcaggccgtggtggatcgggctaactcttcctcgtcgtcatcggtggcggtgccgagcatggagccgcccactctcgaccacttccctgtcattgtcggcggctccactgcctgagatcgctaagccacccgctgcccagtcccggctgcctcctcatcgtcagcgacagcgccgctcaaggccaccgctcccgctcgcctagctgcccgccgccgccagctcccgctcggaggagaggagaggagagtaagagagagaatagaggagaggaggttgaaaaaaaattgaagcggtgaagagggaaagagaggagggaaaaaactgtggaaaagaggggtatattttcgcatgcggaccacttaagaggcccacatgcgaacatatattttcacatgcagccccttaagaggaccgcatatgaaaataaactatttttgtatgcgggcccttaagagactcggctgtgaaaatagatttttgcatgtgagcttcttaaggagctgtacgtgaaaatgaaggtcgatttttacaggtacgactagttatggtccacctgtaacctatatgggtcctcgtaaaaaaattgttttttaagtagtgcatgctgttgcccacttggctgagtttggtgctagtttcttttttcctttcttttctcatgactatagctttcgagagttataatattgtatttttctcttgctttatccctacaaactttacactgactaaccgtttgtttaagtagttcgtactttacatttaccctagttcggaaaagccaatattccggcagagatcctagcccagtacaatattccaggccagtacagttcaaactgaaaggaaaacccgttttactcccttgaattgttctgccagaacactttacattacaaacagtaggatttgtagaggactcaaaatcttgggattttattcctttagtgtccttaggactgaagcaatgaaactatgaaaatcctattgatgatttagtttagatctatgccccatttcgaggaaattaaaataaaggctcctctggatggaatgaaattcaaacgaattttaaaggtttttaaacctcaaaaacaaatttccctatatgtgttgtttggaacaaaggatttgagcatttcaaattcataaaaaaaattacaattagctcaaacatcattttatttttctttggagaagttcaatgcatcttttatctttatctcttttccctctcacaattccatcaaaatcatgtggtttctattaaccatccaaatacaatataatgtctcaaattcacgtgctttaaaaaaacatgggatttgcgcatacgtgacattccaatccttgtgtttttttttcatatttgcttgttttttttcaaatcctgaattccaaatcatgagctcaaacctcaaagctcttatagtttcctttgaaaagtctaatgcattctctacccccctccccccctgatctctctatgacccaaataaacttcctaaaaaattcctatgtttatttcaagtgaaccatccaaagtcatattattgtatatattcctgtgttttgaaattattgcgggttctataagagcatggcagccaatcccggcatttttcttgtttgtatattttaaaatcctactttccaaacgagtccaaatgttagctcaggaatcctaattagcttttatgaacaaatagtaaaatttttaatataaaacaaaaatgttatcaaaatatactcaatgttctaaatatttaatggaactaaattgatgttgtagatgttgctaattttttctataaatttgatcaatcttaaagatgtttgactaagaaaaaagtcaaagcgacttatgatatgaaacggagggagtacaaacaaataaaatatatctacaatacttatagttttgtgggatgttttttttttgtcgatgagaaaaaaaacttagatattttcagttgagagtttcacaaaataaattctaagtctttacaactagtttcttgaatcatgtgggtcaaatgtttctatttgtatatgacaccaattttcatatggaatgttttatgtgaaaatgatgcttatacaaatttgagtaaatttaataaactccaaatattttgacaaagatgcattttagtccattgtgttacaaaactagacatttaaggttaaattcatgaaaccgctatggatttaacaatatcacaaaattacagatttatcataaagctacatattgtagagggttctgtcaaggcattgttaccctaatagaggcattaaaattatagtttttgtgataaatttggacttaaattttgtagtttcttgatgttgtggcttaaatatgtagttttataatatatttagcctcgaatgtatagttttgtggtactataggttaatttgtgtaattttgtcatagtttttttttcaaagtacatatatagttttgtgacatttactctagtatatttttttattctgcttggaattgtttaaaaatattttttcagtttacatgtgagaattctttgaaaatgttttgtttgttgcaccgtcacctcttatccattaaccattctacttctagtgacatttctatccaataagtcatatttgaagttctacgtttgaaagattatatgttagtagtatcattttgtcttatgttagtattttttaagagtctttaatcactatgtacacagtaggttggaacgacctaaggtagatttgaattgagtttttaaactgcatgcaaattgttagaagcaatttatattttgtaaaatataaactaaaacctcgagagtaaataaaacttttcctaagtgtgcatacataggcaacatctatactctacagtgatggatggtggcagtgaatctaatacctaacaccgatttttacaattttaactaaatccatatattttttgatattatggaatagtccaatactgttcaaacaaataaacaccatagattagaataagcagacaagccatactatcataggtagtattttatttaaaaaaatccttttatacatcataaacgtgagctttttctagtgtttatagatcacactagcttgaaaaagaaacacatattttggtcgaaactgatgcaaatagacaaagatcaaggataactgtttgattagattttataagtgatataaaatgaagaaatattatagaagttgatctttctaagagtgagtttgaggtagaagtgtttgtcattataggtcttacattatgctacgtcgcaactaaggagtaaggactcgaagtcccgaaaagaaattctttgcgctctcaacttgaaacacaggccgggtttagttcctaacttttttttcaaacttccaacttttccatcacatcaaaactttcctacacacataaacttccaacttttttcttcgaacatccaattttaatcaaagttccaattttagcgtggaacaaaacatacccacagtttcatttcagacaggtaactctggacagtcacctatcaaacactgtctgaattagatcctcagaacttcagaccctgtagctaccattgcatagaagaaacccactagctagttaattaatacaaattaattgttgttacctcccaattatgcagttactaaggctgagttttttttttaacttcaaagaacaactttctcgtttttctttaacatgtttcttaaatagctaaatggtgcacttttgtggaataatttttatatagaagttttttaataaaataaatctatttttaaatgtataatagtttctctctctgaaaaggacaagcttatgtctggattcaaagttaaaattggtttttgcagaacgcgatataacactcaattaatcacaccttaagtactcaccttgttttgcacgcagcaaaaaaggtcaagcaatttgcttgttcgaatgcaattaagctaagtgttgcttcttgtagccacatccttcgatcaatcatgcatgttacagatgatggagacatgatcgagctcagacagcgacgccggcgagatgcggtgcccggaggccgacggcgccttgccggcgatcgagatgttcatttgttcagaatttattgatggttcctgtccatattcttctgaaacttggcactgttttcattagcgatggatgggaatatggacacgaactcttgagtgttcttgtcaggccaagtcgttggctgctttgagtggcattattaatgcgaaggtcaattatatggatctactggacacacccatcgtttgcgtctcgaataatctcgagaattatgattgcgcatgaataataataattattattattattatcacgccgtgtaatcttgtggcgaagctttgtttcattgattcattcaggtttaattttgatattttctattcgatggaaaagaagggtaattcacttttattttacttatatgtttaatatagaattatatatactagtatttgttacagattctagagtcctaattaataaattataattaagctttataagtatatctatctattattatatactaaaagtccattaaacttcctacaaacgctctcaagccgccacgtggcgctctaataaattagagaaaatcctagaaattctaagaaaaaattaaaacatctacccctcgattttcacttaaattggtgggtccaatattatacactgttagatgaaattgatcttaacacaaaccaaatactatgggtcccatctctcctccttctcccacgcatatgtacgtacgtatacttccttccttttctttttcatttttttcttctttttttccatttatataatggatatatatatatttttaaataatcgatcataattttacaaagaaagaatttaccatcgtacaactcacatgtaactaaattagctctacaatatttgaaagtaaaatttacaccattatatgttacccattaaattaataatgtaagataatttccacttaaaccggtgtactcattactttgtactattatttaaaaataatgcactattttaaaataaagtttacacaattatactgtgcacctatcaaataaacaatttaagatctatatacgtgcactaaaccgatggacccattatttaaatcatcgtatctattttttattacattggactcttactctcaaataatacactgtttcaaaataaagtctacaccattatattgtatacccattaaattaacaatttaaaatatatattaactaatttacacttatactagaaccgatggacccatcatttaaatcatcggatctattatttgcaaataataaagcgtccaaagttctcttttggcccattgcacaatgcacgtctacacctttacctttcgcacacgtgacaagcgttgtgtctgagacatttaaggtgatcacgaccgctgcaacgctattgctttgccacatatcaaatcatatatggagatcattaattttgttaataacatgaaaagaaaattaaaggtatgatgcaacgagagaagaattatgcaccgtgggttgtgttttttccagcacttagttatgtttaagctgaaaccgagagttggttacagaataattataatgtattatgttatgtcgtatttggattttgtactatttgttcgtataggtgaaagaaatcattatgttataaatatgagcataatattaacgaataacaatagaactcttactaagacaaggttgttataagggagtttatgacccactttttttccctgattccatagttttgatttttgtttgcacactttccaagtttctaaatagtgtatttttaaacgataatttaactttctagaacctaattcatttgtttatatcctcaaatagctatcacataaatcagataattcatcaatttaacctgtccaacacttttttttcatgcgaatcatggtaatcagtaaattggggatcaaccgataatcaaagtcgtaaaataaatatgtaagagctactatgcacaactataaataggtgtcaaaattaattgttattaattagacacataattaatttcttatataaacatggatgaagctggaacaaatattaccatatgccccatacatatatattacatggttaatattctaattatatgtgttaagtccttaaaaattccttaaaatgctctcaagctgccacatggtgctctaataaattagagaaaatattagaaattctaaggaaaaaaagtaaagtatctattacttgattttcacttaaatcggtacgtccaatattataaactgttagattaaattgatcttagaacaaactaaatactacgaggtcctacctctcctcccgcggcataggtacgcacctacatacgtgggtatgtacgctttccctcccttttttttttcatttttccctttcttctttttttccatgcatacgcttccctctctttcttaatatatcttgcgccttcatgagatgatttaatcccaggaattttgagtatcttgctctcgcatttttcatttgtggccatactacatgatatgtatatagatggactgcattgataattaactagtaatagtttcttatttagtcaaaaaaaacatgattcaaaagtcgtaagtacttaatctatctcctactcaaaattttgtgaatggttttctaagatatcttaagagaaatagaacccttaaattattatgaaataacattatatgagatgaaatttttgagcaaacaataattgtaactttcaataatataagtgcccgcgcatgtgcgcgggccaccttcctagtttttatataaaatttagagcattcacgatgtagaaatgaccttatcaattactgtaagagcatgagaagggacagcaccagccaccagcactcatgctgcaatggttttgtgcgcgagaatcaatctagcagaagtgctcaagcatagtaccaactagcgagaggccaaatgaagtctaagttttcattgatgccatctctaccactccgccactgtccgttctgggggcgccgccggcgttgatcccggtgacaagaagccatcatcgataggctctgccgctagattttaagctatggtgaatccccaaacttacactgtaggggagcggcgtgctaagacctgcggccactaaagcgcagaaggtcacaatgaagaaatttaggattattgacgaggatgaggaggtaaatgaggaggtggttcaagattacatccaggtcttcgacaagccgctgccgccatagcatgtgcaggcactggtggaacttctgcagctcaacatctccgcctctacacagcaactgccaaaggacgacgcggtgacattgccaaacgccaccctgcaggctgtggcatcgttaacatgaggcgtcttgccctgtgtggtactgaatagtgtgtgagtgtgtatatgtccttttaatgtagagttttaatctgctagtgtggaatgttagaggtctaaatgatgttgccaagagtgctagtcaaagggtcagtgttgttctccaattcttatggagtttgtttccaagagtcgaaattggatgttgtaactccctcattgatctatgaactttgtggtcctaggtccaattgttttgttgtgtttcttgcaatccacacaaggagaggagtcattatcatttgtgttgtcgaaagacaactgcgtcacgtcaaaggacgtggttcactcaatgagttgttggaatagtaaagcaatatattaatcggtaaaaaattttgggatcccccaattacacggccctagggagctatttatagttttagtacaggctcataccctctagggtttagttaataaggggaatttacatggttacccctatgatagggacattagagttggtatacaatgtgttttgtattcatgggccctaaggcgatcttcttgggccggcctattagtggcaaagggcctctatgggccgcaggacctccttggcccttagccgaaggcatcttctactttggacgacgacctcatgcttcgccctacggccttcgcccttagtggttcttcggccgaatggtgagcttggtggcgaacccttcggtctttgtcgcctggctttgcctaggcttgatggtgaaccctttggtctcgtcgtttgacttcgcccaagagcttcgccttaggcgcaccccttggacttagccgaagcttgatggattaggttgtttcggcaggttggtcgaaggtcctcgtgacatgcctccaacaatttggaagggggatttattccagagggggtgtggtgcacatcgggcagtggttagtctcagtttacctgaaatggattcaggggggacaaatcttggttttgtcttcgatgtactggcctcaaagggatgatgagatgttgatgttcttggaagagatgacaactattagagaggtttatccaggggaatggataattgtatgggacttcaatcttatcacctcagctacatacaagaacaattctagaatcaaacaccagatgatgaacatttttagaagcaagatagatgaactagaactcaagaagatgtacttgtttgaaagaaggtacacatgaagcaatgaacaataaagaccaaccttggtgaaacttaacaggctttttgtcacaacacaatggtaggaggtttttcctgaagcgcatatgcaggccatgagttcatctggctttgtccactgccctttgttgctatcgtgtggggacagaccgattaggcacagaagattcaaatttgagaccttttggacaaagttagatgacttcatggtccatggaggtggttcaggaggcatggtagagggatgttgatagtgaagacccctatcgtattctatatgtcaaaaaatggaagattgtaaggtgctaaccaaatggggacagcgacgcatcagcaactttaggttgcaactgtagattgcgaatgagataattctcaggttggatgtggcgcaagaaaagttctgacatgtttgtagcggcgacttagggcaccgttgaaggaaagatatcttacactggcctctcttgaaagtataagaataaggcaatgagccagaataagagatctgaaagagggagattcaagcattgccttcttcttcatgaacatgagaactcgacgtagaacgctgttgatcccaaggctggaacatgaggacactttggctacgataatgaaggataggcaatagatgactaccagctatttcaagacggttatgggcttggccaggaatgcatctaaactgatatttttccatgaggtgcagatggccacactcaatctgtcggagttaaatgccccttttactgaagaagaggtgtgggcatcaatcaaaaacataccaaatgagaagtcactaggcccggatgggtatacatgcctattttatcaaaaatattggagtatcatcaagccaaaattaatggcagtgttgttaaagtttggttatggtaacaaccaaaacctggacctactgaacacggtgatcatcaccctgcttcctaagaaagaattatgaaccctgctgaaagattacagacctatcagtttaattcacagcttggccaagctggcaacaaagatcatgactcttacactgaccataaaaggtcaagagctccagccaaaattaggttcttcatgtggctggccattgtttaacggctgacaacttactcaaaagaggacggccacatgagacaacatgcacgctgtgtaacaccggctttgaggaccacaaccacctattcatcaaatgtgtctacaccaacagagtttggactttgctgcaggactggatcaatatgaatttccaactccctatcagtgatgattggacgttggcagattggtggcaactggcgcggaatcatttccgaacgagctataggaagtcttttgactcgttgtttttgatggtgtgttggttcatttggaaagagcaaaacgggacagtgtttgaatacagatttgaagtggcagagcagctcgtcaatgatatcaaggaagaaatctccatttggaagacagcgggcattttttcaatctggtgaggagtactcttctctctctctctctctctctctaggtttacatgttttcttgagggtgctcaatcactcttaacttggcagtttaatgttgagattatactcatgaaattatcttatctaaatcttaatgaaattcggtcggccaatttttcagctgacccggcaaaatatttcatgctcttccttttactattaagaataagaattaatctctgcatcaaataggggcagtttcacaagcataaattttcttaaccagaaaaatcatccttaaccttcaaaatggtggaagaaggcatatgtgcaaggtaacccatagaactgatgatatgttcttttagaactaatactaccaaaataaatcaaaaatcaaaacatcaaactgaacaacaatcttttaattggccaaacttggatgacctctgaaactaaaagagattcagaaaggcagaaactaacgacctcatcttttcgcttattcttatgcttatcaaccaaaatttgaattttcaaccttaaatttgaagccaattttgaggttttttcatcgaagtttatttttcagcctttgcttttactcccttcgtcccataatatagcaacctagtactggatgtaacattttatagtgtctagattcgttgtactatgaaatgtcccatccagttctaagttgctatattatgggacggatggagtagatcactaaggacacgtatataaaaattttattcacaaattacttttcgtttgcaaatatgccgtttggcttattccgtagataagccaaacgatgggctgtaacttatgaaggccaacacaagtactatgtactcttgactcttgacagtcaaggaacacaaagctgtagcctctatcaaacttgctccaatgcattatggtaatttttgttttatttatttactcaattcattggcccatttctttcatctcttgaagtttgtgtagagattaccccttacgcaaggggtggcttctcctttgtcctcccttctctccaccacctcaccatgggagcttatatggcacataggagcgagtgtttcgatgcttatagtacttgttgtaaaccaaatttctttcagggatcccgctaagcctaattcccttcaagtaatcacatttaagatagacattagaaatgaaatttaagagcttttatggtaatctttttagttttcttcaatgtctccacttctcaaaggataggatagatacttgggcatcgcaacactagaagtttttaaataaataatcaaatttatagctggacgtgtagtaagaaatgtgacaaagagttcatctcatttgtactacctccgtttcacaatgtaagactttctagtattacccacattcatatatatgttaatgaatctaggcatatatatgtgtctagattcattaatatctatacgaacatgagcaatgctagaaagtcttacaatatgaaacagagggagtacttcataatatacttagttacttactgaaaacaacccaccacttctatgcaagaaggtatgttcgtctcttacattaagacgcaagtccctaataggtgaggctctcccttataaagtcataagcccacacatcataagagctttattgggatctgttctttaaatagtcatgattagctcctttataaggtagaacacaaaccgtaacaactaacgagatgttgtaagtttgatcagaatataaactccacgcagtttgagttctttagtttatattacaccgtccatctaaccctcctaattcactaaaaactagtaccacctgtcattactgtgctcttctcaggagacgaccaaattgacaaggtactacatcagaactgcgaagttatggattcttagttattactccatccgtttcaagttataagactttctagcattgtctacattcattcagatgttaatgaatttagacgcgcacacacacattcattaatatatatatatatatatatatatatatatgaatattagcaatactagaaagtcttataatatgaaacggagaaagtactatattttagttaatctctctttttaactaccaccatccaaaaagaatgcgattctcatcttcctcagcgattaagcacgcacatcagcgataaattaatcgcaagttcggcatacacaagaaacactaaacagtaacatacataacttgtatgtgaaatcagttaatcacaagaagtacatgacaaaagaaaacttctgcaattaaaaaaaatggcatgctatatgtattgatccaccattatctaagtttcacattttgcagggaagagtttaacttctaaagaaacataagctcattaatcagatcattgttgcaatctagagtggatggcaacaccataaacttaattgactagagacctcaaaaacagcttaagtagcaaggaaactcaatatcagagctcaaacggttaaatgcatagacaggagccaatgtaccaaccataatgctaatattgcaatcacaaacactcaacatgagtttcgaagatatgttacatcttcaacaaacattagaattttacaattgcgcactaatataaattacactactttccccttttatttatgacacaagatggctacaaacgaagcactagaagccccctattaacacagcaccactaaatcatcaggatccacagttcctaaatacacagcacggtaggaacatataagttacttgccagttgaaatgaaacagggcccagcgaagggaatggttggtgtttttaatgcatgaactgtattacagccagttgcgatcagaggtgctagccccggtgctaaagttcaattgcttctgataatccatactgttagcaagcatagccgcaatgttgccaccatgcaccctgccttctggaacaggtgattgaacatgatgaagagcctgcttggtgttagcggcaaatgtctcaccaaagttgaaagagtttccaggaagggtcccatgactaacatcagaatcagcaccagtagaaccaggcagggcaatagttccaactgtctgaccaccacggactcgactatcttccaccagcgcattgtgtgcaacgcacaggcctttcttaccccttgcaaagcgctcacaagtaccgctgccgtctccaaggccagaccctgattggccccataagcagcgtttacctcccccatgtgccttgcaaaagtctgtactcccctgtgcactcttgctgcagccggtaaactggcaccgcttaccaccgccatgacggacacagcagtcagtccgtccccttgcactcttggtgcatcctggtaccacacatcgctttccgcctccatgggcaacgcagaactcagtgccaccatggacactcttagggcacccttcagctgaacagcgtttccctcctccatgggccttgcagagagcagtgcttccctcagcacccttgctgcaattcggatgtgtgcatctcttcccacctccatgagctttgcagaaattagtgctgccctgagctccctttgtgcaaccatcatgtttgcagcgacggccaccaccatgagcgatgcaaaagcctgattggccctctgcactctttgtgcagttcagtttttggcatctcttccccccaccatgcttaatacaaaggccagattttcctcttgctgcctttctacacccatcacggctacaacggcggccacctccatgggctatgcagaaatctgtgcggccttcagcgctctttgtgcatccaaggtgctcgcagcgtctgccacctccatgtgctttacagaagatagtttttccctcggctcctttcttgcaaccttctctctggcaccttctacccccaccatgtgcaatgcagcgccctgaagaacctctagcaccttttgcacatcctggttgtgaacagatttttgtgctgttgcagcgttgttgaaagctgacaacaccagaagtactggttactggactttgtggcgtttgtatcatttttggcagtggggcaagatcttgagactggttggagctacctggtaactctttacttgaaaaatgaccagtgttgttcctggactgatacagataaggaagtagcttaccaccagatttccagcgagcagatgttgatccttcgtccactgtaggcactgaggacatattgcatgattgcagaaatacggcctgttgtttggttgctgcagagaagtccacattcgtcacagcagattcacagggtccaaaattcaaagataactcgagatccacaggcttctccaaaactttcttgccattacaatcataactatccagttttgaagtgccttcattatacagattaaactgaaaattcatgtccaaatcaacagatgaaccatcgtccctgtcctttgctgaagacatggtgcagcatgttcccatgctctgcttgctcgagtctgatgagcttgaggagttacctaaacccaatgacaagtcaacccacttccgcttgatccctcttgacaaaggattgtgcatgctatcttgggcaagcacatcaagttgtgaagaacaagccattggttggctgactggtggactaacggtggtccatttttcagcatttcttggattcgtgccagtaaattccaagaatccaagctgtttatccattgcctctagtggatgaggatatgcagtaaatcctgggagcccaagttgtaattcaactgcttcaggtggctgagaatattaagactcaaatttgaccaatcttaagggaaaagtacagtcagtggcgcttctgggttacataatacacaaagaaactaagaagtcagaaatataagcagctcctttgcctttttgcatcccccactgacaaatccagaagtatcattgcgatccatttcttagtttttaattaagagaaaggcttcttattcagatggcaacagtaaagctacaatcagaagcaaatgtcgctgctttcatccgatcaaatcaaggaagttagattctgcatgaaaagaaatacacgtgttgaacaacccatttagaagagcaacatataaaaaacaaaatgcacataatagaaaaaaaaagaacatactgcatggctgtaataaaagtggcgcatttgttttatgcctttgaatgtttagaggcttaaagcccatatagagtggttcagaagaaatgttaatagattatttccatgcagcactgtagctaaaaaagttttagtatggaatttagtcatatggaatctagtccttcaattcgatgtctgaaatttggttgaattgccttttttatttaaaaacaagaaaagtccatatttgatctccaatttttcgtccctcgattacagaaccatccattatttggtgcctcaacttttacaaccgtgaacatctcattactaggcacagatcatttaataccatcaatttcaatgacacatcattagagtaaaccccggtttgggctcaaggatgaaatatggacggttttaagaggtgcgggacaaataatgaatgattttgtagttgaggtacaaaagtcataccaagtccatagttgagggaccaaatatagacccttttttaaagactgtaactaagtaactaacaaaaagaaaagtgttctcaacatttgtttttgtaaaaccaagggaagcagctctgccattcattttaagaagagaatctttacgtgctaacatccaacatcaacaccctaatcagtcaagtgatactggcattatatggattcagtggggtgtgtaaaatttggtctagtgtcaatttttaaatactaggactaacagctcagtgaaaacatcatgcatatttctaatctctccagtacattgttctatatatgtccattacaaatatgtacaatgtgacatcaaatgtatatgtaaagttgctgaacaacacagatcagttcgttgaggatactttcttagaaaaaggtttgctttgacttagtcttgttgcatattatcttacttattgaaataatttatttgagactcaagactaagaccagaacaaccacatgcatttttcttctgaagaggtggggtgaatgcttgaaattaatgttcatgtaggcatggctttcaaatacaaaaggaaaaatgatgcttagaattgatcctacatgagaagaaacatgaatcaatattcacaattcgtgcagtgcaatgaatggatgcataaggatgatatttacaagcaaccgtaaaagagaagaactaggaatccacattcgtaagtcaagcagtgtaatgaattgatgcatattcttttgattactgcaactagatccatatgccgcagtaagtacaaaaactaaatgccagtgatggatcgaatgcttatgatcagtaccagcgagtgaagaaacaggaacagcccatctaatactgaaaaactctagctgctggttgagaagttcagcaacctcactctgcaatcggggaaaaacagaataaaggcagaaagcaagaaattagatgaaaccttttaactaggtcaacgcgacaaagtaatctggttatctgaacagatgaaaccaaaacgataactttttacaggaaaaggacgtatacatctaaagcactagaaaagttttatcacaattgacaccaagcctagcagctttacacgaagggatcgaatatttgcacatgcatgcagtacaacaactaccacaaaagtagaatcagtgcactccagataggtatcacagtcagcaactttacatggtaggatgatgcatcatataaatcgaaaatcagtgtcgggagaatattattattatcacagtcagcagcttcaaatcttaggagccatgacagatcgatattcaacctaaagagaatattctatattctagccatcatgcaccaggagaagtggaatttggtctccagattcaactatatcacttgataactagtgatcagaaattcatggtttacatccaagaatctatgaagcaccggacggataaaagagagcatcttccacgcatgcaacctaatcaataaaccgaatcaaaaccccaagattttatataatacaccccaagcaccacacctacatcctccatatgcctcaattaagttttctttttttttcttttaaatattgcaagattcagtatccacacttgttgcacggtaaaagttaagaacaaatatttcaaaaaaaaaaaaaactgaagagttgtatcatgtggatactggtaaaaaagattggatcagagttaacactcccaatacgcaggtttacacacgcatccatccaagcgtccacttggagcgaagtcagtgatctaactactaccgaggcaacgagagaatgaaataatcatgacgcaatacacaaacactacaactacaagggctcgggctccccgcgagagagacggataacagtatcattcccgggggcggcgcaacgaagtgaacgagaaaccctctaattcccttccccgtcgccggttcgccgccaagcgccgccggaggccggagcagcatgcgccagagcggcaatcgaactcgcacaccaaaccagcacgcgtcccgccgcgcgcccgttccagcgagctatggtcgggcacgggaacaggcggccgacaggggaggaagaaatggaagggaaaaaaaaaagaattagagagaggcagcaggagacggacctgtggcggcggcggcggaggaagaggcggcgagtcggaggggagacaagtggaggagggtggagaggagaggcgagacgagacgaggcgatgaggtggtgggatgggatgggaggaatggagtggtgtggtggtattgtggtggtggagggagagggagggtgatggtggtggggaaaagggaaacctgaggtgggtgatgcagagacgggtggatggagagggggagggtgggccgtggcgccgtgcaaaagtggagatctgttctcgcagatgttttgtcccctccccatgtgggaaagtgggatgcgcggtggaaaagtttattttcatttatacccttcacaaaggtcatatttacacatattgcttttttattgttgattttacagtgagtcataatttggacagctcatgtttaactaagtcgtataatggtgtatatcttagcttacgcttttacgctggactatattttttttctacaaattgtatgtgcattttggacctggtttttcccttctcttctaccattatcagtcgcacaccaccatcaatcttggctatatattgtctcgcggcacctaagcgcttgagctattgagcacgagaaccacatggctacatctactctacctagcagccaacaagtctttggccactaccgcctctataatctttatccaaattgtgcttagtcaccttggtgctaagcacatgacaactcgagctcgagggcataccacgtgtaggtgaaggttgaggctagccgtctcaaactagcacagagcaaaagcatgttgcttgagctcggtggtcacgttaatctgaggttggccactaccacctttctcctatttctttctagattgagcaacctgtgctttcatccagatcgggctactggaattggatatgatcgcttgtctagcccgctgcaaaagaactctagcatcctatttctagccacctccccattcatttctttctcgatcgagtgtggaaaggttggagcgttgtcataagggaccgctctgcgaagcttacattccctccgctttctctaccaatcctcctcactcctctcggatcaacagctttgtgacatggcacccaacgatggagaagaccattgcggcatatctgttggcaacttttttaacaagtagacaagcacgatcggacacctaaacgcattgcggtaatatggagtcaccaaccaccctcaatttagcaaaaagctagaccaagatgggttttgatatattaaaccggctaacatagccgatttagatagaacgatagataactacacgtcttatgggcaaacggaaggtttacgggacaaacctacaaaggatttcgcactctcgcagcgaagacggacgatttacaacgcaaatcgacaaagatggacgaactagactagaactatgtgaaaagtagatgcaatgtttgaaaaagcgattcaattggctaattatatagatcgtacattgtatgttccttgtcccttatattagggttggtcttgcctactacaagtcctcttccacgtccaatttggcataggaaccaaaggaaagctgaaacatagcctcccgagtaaggaatcccgagactcgataaaaactgacttgggctcggaccctgccggtctgcccggcccatacacggcgatcaaaccggtccagtggaggaaactggcaactttcccaaatcttggcaattttccttattttgaacctagctaccaaatttgggtgtaaacaatatcgttgctcgaatcccctcaaagagagcttgtcgctgaatcgcattgttgttgcgttgccttagttttctctctgactcgctgatcaacgacatgtagaaaaaaaatttcacacaaaacatactccctccgttcaaaaaaaattaatctaggaatagatgtgacccctcattgtattaggagggatcacatttttcctaggttaagtttttttggatggaggaagtaagtgatagaaagaagtggttgtatacatccatgttggtacagagatcgggttttataaattcccaatatcttttaaaaaaagggtgacgaagagaccaaaccaaacgtaaggatccataatcagtaaattcctacaaagcgaaggccgtaactgcaaagctggcaagaaacaacgccagtagtccagacttccagtacaccaaaaccagcacgaggcaaaacgggaaaacagccaggaaggcaccaccctcgcacgttggaaatcggcggcaaattaaccaggcgacctacctacgattccccgaagatctccacacccgtgacagacaggtaggccacaccaccatctgggacccacatgtcatcggcaaaatctgggctcgctggtcaccccatctctccccagtggctgcgggccgcggcgaccgcgggcatggcggaaaatcaaatccccacctccacgtcaccgctgacgcgaacacccccgccgcctctcgtaccactgacacgtggggcccaccccgagcgacgtagcgttcgcaatcttggattttttttattctttacgccgttgtgtgggccccactcgctcgcgcgcacgcactagggggagggggaggcggaggggaggacgagatctttcacgtgggacccaccccgtgtggcctgtcgtgtgtcggaggcaccaacttggcaccgccaccgtccaatttggcacgctgcagtgcaggcgcacgctccctctgtcgtttcttttcaacttttcacttaagtacaagtgtacaactaccactactaccatatcaaaaaaaaatactgcccggtatatcatataaaatactagtaattctgaaaacaataggctccgtggacctgcacgatttggccatttcgataattcgattgtgtgacggcgaccgtgtttataacactgataattaactatcatataaaacactgtgataactggtaaattaacatataggattgtctaaaagcattagaaaataaatggaactcatttagaatcagaaattgaaacgacgagatgcgccggttttcttcttgtttgtttttcttttaaaaatatccaagtagctcgcccatacaacttaatttcgaaagcattggaaaataaatggaactcgatttagaatctcaggatgcgccagttttcttattgttttattttcttttaaaagaattcaagtagcccatgtaagtcactgctatctctaatctcaccgatacaacttaatttcgtaaaaagaacacttcctgtggctctattttcttttctaactttctaccttgatctagtttgtagtaatttcctatcgcacttagcgattttcttatactctatggacctccagcatgatgagctaagttgctccatgtcttctctggttaggcatgaaaaatacacatctccgtagtatgtgattgtcgttgtgtttcgtcaccatagtgttaaaggaattaaagtgcataaaagcataaggtggaaggaggccgaggtacatgcacttttggtgtcgaagggttaacttcgctaactagaatggaggtttatgggtgtgagaaatcgtataaaactggatagagacgagaaataaacttatgaacaccgttataagggtgagaattgaaagactactcacttgtaatgggtatttagattccttttttttaaggttaattggatccatgccactgtaactttgtgagaacaaaaaagggaaaattagaactatgccattataattttacaaaatttaagatatgccatcctgacccacatgtcattgactcatgtggattctacatgtcattgagataccgatgacatatcttaaattttacaaaattataatggtatatctcaaaatgccactcctattaatcatatcggctactcccgtccccttttccgactactctcccacaccgtctccgttcccgtcccacatgtcggtcccatctccccatcttttcctccatccggcgcgaccgcagaaggacaacggcagcagcggctcccgagcactctctccgcggatggcgtcgaggacagggacgcgggggacgaggctgagcaccatgtggcggagggtggggaggggctgaaggtgaggtcgcggtcaatggcacggcgcgcagggcgaggtacaggttgtggttgccgccctgcaggtgcgcgttggcgcggttggcgagcaccagcaggcggacgcggcggcgggaggaggcgagcgcggaggagaggttcccggcgaacccacgtgcaacgaggaaggactcgagcgaggcgagcagcagcgcggcgaaggagaggagcacagcgtgggagcccgagagggagcccttgagcgcatcggcgtcggcgaggagggagcggaggttgtcaatggcgcagatgaagtcgtggaagtgcgcgcggcagagctcctcgatctcggtctcccggtcccgcgccgcggcccagagcgaggcgagtagtggctcggggcacctgcacgtgaacacgcgccgcactaacgggcccaggtcctccccggcggtgatggcgatggagagctgggcgaggtcggcctccgacgccgccgccgacatcggcacatcaccaggctgcttctgccgcatcgggatctggtcatccccattgagttcttcgtcgtgttctcgtcgtcctgccgccttttgatttggttggatttgttcgctttggtcattgcttgttgacgatgaagttgggcatggcagattccgccagcaacaaggtggcgtcggcggggcctcctctcccagctcgctgttgacgccgccctcgccgtcgtcgatccaactcacccggacctcctcgcccagttcgccgtcgacgccgccctcgccaggaagtggtcgggatgaggacgggaacagagacgcgtgagagaggaggacggaaaatgtgattaaattggcatggttctaattttagaaattttcaatggcatgtagcctatataacgaatagtagtggtatttttttaatttgacaaagttgtaatggcatagatccaattaacttttttttaatgttcacaatcatccgtataaaaggaaaattttgttgcacacagcactaaggtttggaataagaggactcgcccataccctctttttttttctccttttgtcctgacatcttaaagttctacgaaaaatgaaaggatggatcatggatgaacctcctagccagccactacggcgagaccttttaaagtttacactttatacatgtggtgatgagtaggcaaacactatactccctaagtcaaaaaaaaaaagtttaatcccaactatgaatctggacacacttatacacaaatttatagctaagatttgatcttttatgggacggatggtataccgtatacaccaccagatgatccctcctgcatacatggaagctcagagtactcataagttgaacacaagaatttaagcgatttcatatcgatttaccttctctgattcacttttcatactataaggcgttgtgggtatcaaatagctagattcatggatcgatgtatgtgatttatatatgtgtccgaattcatatggatatggagtccaaaacatatataatgtgaaactgaggaatacatattataaaatggccaattacataaatgccacagtttcttgtatttgtcaaactgctaatggtttttttatctaatctcatgtaccactagtttcattaaaaaaagttgttctaaaataccacttacttttaaagttgactaatagcaagtcaaaatggtttcaactctccttgaaaaaaaaaagttttacctttttcaataccaaaatgctctgaagactgaacaattgactaaaaatttaaaagcaaattgataaaaagaatacaaaaaacatagaaaactcctcatctcttcccccgcgtcaccatcctccttgccaattgccatgactggccttcccgcacgtctagcgggccaacgacctccaaagccatttaccctctcattatactgttgcatgagctctctctctacgtgcatggccgatggccatgagcttttaacacgtgaaaccgttaatattttgatacacgtttgagtattcatcttaattattaaagaagtttatagaattatttattttttattatgaatttgtttatcattaaatgtacttttaccattatttacattcgtatatttacacgtgatttttttaaaagaacaaacgatcaatcgcgtgtcaaatagttaacgacgtgatctatgaaaatccgaaggtgattttagtccctccggaagtatattggatgctttatacatcgacatatcgtgtatcactgaaattaaccgtaattatgaacacttgttaaatttaggatgtatataaacccgagttgacatgttttaccacaagaaaacctaacctgccgagctccacacaattcgcggagggggcataatatattaatgtaatgctacaacttaattgcaattttaaccactgtcatgcttaattaatcacccgtagaagaagaacacgactagttgagtcatgcatctgatgctgatcgaagttgtgtgccgtgcaatgcgtacgtacgtaggctgcatgatctcatcacgctatttcatattttcctcttggaggcagcaggtgtgcaataatctaagctaggaaccaatggaaacttcacccactttgccaggaaattaggggtaaccgtgtgtctaatcacctactactctgctcatgaccatgaacgcctacgtttcatttgtttctttgaaaggttgattaattaaccaggcgatatatgggcaacgcaatcagcctggaaatatattgttagagggaagaaaataggcgtacgctaaagaacgtgaagacggcatgtcgacattatgggcccaccactgacgcgaacgagtccagctataagataaattaattaagtctagcacgatgacgaaatgtgatgaactcatgatggttaatatctcgatcgatctgctttgattaatttccgcttcgatcgatggtgagagctttcttttcttttctttttgaatgaacagttagaccaaaagcaacctctactctacatcatctatcaaaaagaatgaaattcggggaggacgtactcgttcagattcatctaaaaaattgtttctactgggatggagggagtactcatattaaggggtattcacgcttttgatcatattttgtaacttaactataaattaatttgatctttttttcaaatttactcattgaaccctttttttttaaaaaaaaataaaggtcagatctaaccctattaactcaagaaaaatatatttttatggcgttgatttgatccaactttctcagtgttttttttgcgcaaacctaattaatcttgataagtaattgttttaccatgataaagctcatgacatttacataagtaaaaaaagttacacatctaattccagcactataaaaatgacagaaacgttcacttccaccgccacacgctcgctcaaagccgaatcctgctgaccatcacttccaaccgcaccaatgtcctcctgatcggatcgaggaggagcgccgccgacgcctgtcatccatcgtcctcctcattatttggatcgcccattgctacccgtcatcctccccgagtcctcactcggatcaaggaggagaagcgacgccactcgtcgtcctccacgtttagatctaggagaagaaacgtcgtcgccctgccacctttgagcacgtagccgtcctccctattcggatcaaggagaaggagcgtcgccgttaccgcctcccacagcttgcacatgccctccgcgcgtaaccgccgccattccctccctccacgtgtcgtccctccctccgagtccccgttgacaagcgagatcccaatagcctgctagccccgacgcttcccttccactgcatgaaaaaccctacctcaagttgtggctgtagagatggaaggataaggccaagtgagttaaggggcattttgatcattttccgcctctaaatatactttctagttgcattactaatgttatggttacgataggggccaaatggtaggtttggtttggaaaataggatctaatgggcaaagtaaaaaaaaaaaacagggtcaaattaatagttagcttttggaatggagtcaaacgcacaattaacccttaatgttaattagtggcaccaattgacgtaagctaa

SEQ ID NO: 13244 - DNA, 5660 bp, Oryza sativa
  unsure (1)..(5660): unsure at all n locations
cgcccatcgaaggtatgtagctcactattttcccaagccctaaaatctctcagagaatttgtagtattattccgtgggaacgaatgaatattaggctgattaagtgattagttgctatcattcaaagaaactgtatattgtgtgagttttataatttgtcatggtctatatatgcagatagaagtaatattggaatcagccaatctgattccaaattctcgaggagacatcctctcgttatttgcatatcatttaaataattatgaaaaaaaattataagatatattaatatgtgataaattagatcactccacaaactttgcagtaatacctttttcatacgtgcaccagacgaatgatgtgttaagataagagagatgaaaagttcctgagtatagatgacataattaaaatgtctatgttgataaataaactttttccttcctcgtacctttgacgaagttccttgatttctagcgaataaatatatccgccttatacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacacgtggctggctgagccatctttagtcccggttggtgttaccaaccgggattaaagatcgagctgaccttttttttttgcgaggccccgggggtgcgtggtttatatatatatatatatatatatatatatatatatatatatatatatatatatatatatatatatatatatataaaccatgcaactatatgtttcaagacatatatatgcatacatatatatatatgtatatatatatattatattatattatatantatgtatanacatgcataatatatatgtatttatacatatatatgttatgcaantgcatatgtatatagatatatatatgaccanaatatatttacattataganaatgtgtacacatgcatatagaaacatatgtagtcatgtattaattacaatccattatatgtcctagctagctacgatttcaacgtagtagtagtcgctgctagctcagaagctaaggaccggtgaattgtgtntccgtcgtagtagaattcacccttgggatcaaggatttcttcgttgatgaatcccatgagttgttcttgaaccgttgcgataaattccttgtgtgtggtcaagttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtaatagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataaattcgaaaaccttgtcaaacgtagactcttttttatccattgagtcatatacgttgatggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtctagttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaatttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggcccttgactttgaagggccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccagaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgggccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatagcgtccatgctctgtgatcctacctgccccgttgaggcgcaactgctacggtttcctgacgggctcaccattgcaggaggaatggtcggctggggatcatgggaccgatgtgcggccatgcgttcatcaaccttccttgccacctcctcttgcatgttgagttcgtaactcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcttccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatattgcatttcacgttaacgttcgtcctcgttcgttcgctcgttcacgttccctagctcgttcacgttccctagctcgttcacgttcgttcgctcgttctcgttcacgttcgttcgcttgttctcattcacgttcgttccctcgttctcgcttgtcttcgttcgatcgttctcgttctcactctcgttcgttcgatcgttctcgttctcgttcacgttctcgcggcaatgtacgttgacgtgttcgttctcgctctcgttcgttcgatcgttctcgttctcgt

SEQ ID NO: 13245 - DNA, 575 bp, Oryza sativa
cgggagtaaatatcttttcccgctatttcgaaattctttttaaacccggttagggttaagaaccgggattaaagattaaagcactgcatatgattttcgcttacatatgtgtttataaaatagaagttaatgcattaacattatttaaagtacaaagattaatgacaattacttcgaaaaattatttttgtcggtaataaattaagtggataaatcgtaataagcaaatatatgacttataattaataaaaattccaatatatatatatacttagcatatatatgaatgatattattatattggtaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaa

SEQ ID NO: 13246 - DNA, 609 bp, Oryza sativa
acttttggtgtaccttgcctcctgggacaaggaataatacacgcacgtcaggaacgcctgttgggtgatttccggtcgtgatagctggccccaacgccgccaccgcgcccccactctgccgggtccccacgccgccgccgccgccgcgcccgcacgccgccgggccggccgacggcgccccgacgccgccgccactgcacgccactgccgcgcgcgcccgaacgtgaccgaacgcgagatacgtggacgacctttgaacgaacgcgaatgaacattcacgaaacgcgaacgatacgattacgaaacgttaacgaacgcgaaggaacataacgaaacgttaacgaatgcgaacgaacatgcacgaaaggttaacgaacgcgaatgaacatgcacgaaacgttaacgaacgcggacgaacgtaacaaaacgttaacgaacgcgaacgaacgtgaacgatacgatcacgaaacgcgaacgaacgtgcacgaaacgcttacgaacgtgaatgcacttgtactaaaagtgttagaacgaacgcgtttctacttatacgatttactggtaatacatatatgattatatatgtaacttggcccatttagactaata

SEQ ID NO: 13247 - DNA, 8429 bp, Oryza sativa
tgtgcctgtcagcacggtgtactggcgcagaacaagggcacgcggggatgatgacagctttgtcccggactcagagaaagagatgttgtggaccacaatgctcgagacgttcacgctacccgcgggtacggataacttagtgaaacagtggactctgaagaaaatggcggaacagttccagagcttcaagggagatctctacaagaaatacatcctgaagggactaacaccgaacttcgacgtattcccaaagctaagggatcattgggacgagttcattgcttacaagacagggcaacaagggcaagcgatgatggccagaaacaaagaaaatgccgccaagaagaagtaccatcaccacttggggtcaggcggatatagcgtcgcgaagccgaagtggaaggagatggaggctagcttgcttgagaggggtatcgaaccggccaccgctaattggccggatcgatcgaagttctgatactatgcccacggtggaacgcttaacccagttgatggctcccttgtcttcagcgatcagatacgcgaggctgccagtcgcgactaacggacgcagtggtagcctcttctcagggcacattccgacctgacagagagaaggatgagctgtcactcgccctacagactcccgagcatccaggacgaacacgagggaaaggcgtgattccctggaagattggatttaaggaggacatccacacgtacaggagtcggatgaggagcaagagagataccgaggcgaagattgcagatcttgagtacagggtatcgagctacgagctcagcatgcaagaggaggtggcaaggaaggtggatgaacgtatggccgtacatcggtcccaggatccccagccgtacattcatcctgcaatggtcagcccattaggcaatcgtagcagctgcgcctcaacggggcaggtcggatcacagagcatggacaccatgcaaacccaggacgaaacctcctgccccgttgatgagatcacgcagcggataccatgtgagctgcatattcccttcaagaacttatcaatcaaggtatgctcgtagtttgatgatttttgacttgtacattccgcaagttgctgcttaggttgattactaatagatagcctctcatcacgtgaaggtggcgtcggaaatggccgtcccaacggacccttccgggacttaccactgcaggccgattccagcaggatactcgagggtcgaagttgagctggtggaagccttgtacgaggacctcgagttggactacccaggaggggacgatgagacgcatctacgagacacaagccacgccatcatactatggcgcaagcggtacatcatccttcctgggcgacaagcggcatttcgtgcaccatctcctcaggctccgccatctcctcctgcaccatttcctccgccacctcttattgcaccatttcctttgggtcctccgccacctcctggtgcaccatttcctccgtttcctccgcctcctccgggtccaccgtgtccgtttgcacctcccaagacaaggtcttgccaagctccaccgcctggccgcacaagggcaaggaagaaggcgaaagttgacacccccaaaaacaaggagcccccatacgattgcagtcaagaggagcttgatggttatgtggcaggagaggtgaagaggcaactcaagcctcggagtcctgaaaagaagatacctattgacccgagcgtgaagaaattcttcaagggaatgtccaaaacaaacaaggaggcgttacagatatcggactatgaccgaacacttcagagagcctatcacaagaagtccaaaccagttcctcagcttggagaacaaccaaacaaagaggtcgagccgttggtgaccggcgaagattttggcataacggatttcattgcagacaccggtctatctgtggatcagttggttggagccgcactaatcccgaaggcggaagtggcatacaagtttgaactcggtaaaccgcttgtcaaacctgaacagctggagtcccaaccgacacagatgtacaaattccacgacggtacatggaaatgagcgccaacggtagagagatgttcggggcgaggatcagaaaccctgacttcttgcaaggagacgatgttctctggatccatttcaaggatctcttcgatctgtaccagttggatgccctcgacgtctctctcctgagcgcatggattttgtgagtatctttgagttcgatttgtttcgttcaataattagctcctggcatatatgtaagcaataatactttcctttcatcgttgcagaatggagattcaaagggcccgacggcggagggtctacaatactgggttcatcgaccctcagaaaatcaactccgaaatgatcaacaagtatgagaaagacacagaggacaatctcgtccatctcctaacgcagcagcatttctagacgtacatactactgccgtacaacacagagtgagtttttattgtcattcgaacaaatttcattcccatacatatagcatgtacattttcgatcatatatatctcatctcacgcatattccagattccactaggtcatgttattcttcgacttggatgcatgcagagtcactgtgtacgactcaatgaataaagaggagaagatttttgacaaggtcttcaaactgatagacaggtaatataatgccatctattcgaaagtcgcggggaatctattgctattatgttgatctcaggtaataattaattaatcattgcttgcaactacatatgtagggcttgggatcggttccgtcaattggtccgcgggacttggaaagaaaaacttggacggaggtttcattttccagtgagtacatgcatgatccaaaattatattgaattgaatctctaattacagttaatataaagagtatattaaatctctctttgtttctcgtgtagtgtggaaagcaggaacagggaactaacttatgcggctactacgtatgcgagtatgcccactgcctatcaaaccaaatatgcacaacacgagagcttgatgtacgtatacataaaccattcaaaagttcattgcgtatcgatttgttaagttgtttattaatttcatatattgatacatcattatttttggaatgatagcgtattcacatgagggataatctcccacacaaggattttatcacggctgttcaagaacaactgatgggattcatcaacgaagaagtccttaatcccgacggtgaattctactacgacggatcaacaattcataacgtcggtccttcctcttctgacataacgccggcgtcgaagtcgaagtcgtagctatagctaccgagcaaatgaattgtactatatatgcatgtatatatatatttatatatgtacacatttgcttttgtgttaatatatattttggtaacatatatatatatatatagcacataaaatgttaagtagctttaattaaacatatgtgtgtgtatataatatatgatttatacatacacacacacatatatatatatatatatatatatatatgtatatatatatatatatatatatatatatatatatatatatgactatatatgtattgtaacatatgtatgtgtatatatatatatatatatatatataatcaaccatgcagcaaacagggccatgcaaaaaaaaaaaaggtcagctcgatctttagtcccggttatttcacccgggactaaagatagttatctttagtcccggattcgtagtcccgattggacaaccgggactaaaggggggttaccaaccgggactacaaacggtttctccaccagtgtaacttaatttgatcgtgtctactttacatatggttacctcgaccatggctccctcacacacttttcgggagaaaattgtgattttgctatcgcaaaagaatggtttcgctggaatactatcccttcaaagtgattcattaaaatgctatcctaaactaggggtgttcactgaaatgctattttggatctttttgattattactaatgtttttactctcttttattttttctccggaccaaaatgccctcgtctctatgtcctcctttcgcccaggataatggcaggttaacattgctctagcaaaatatattgctatatatttgtgaaacctatgcacgcctcatgctccgctgcgtgatatgtatatactaattgatcactaacactaatacaaaagctcccgtgcactggtttgaaagtcaaacaacacctctctggttttgacacatgctttgctagagcaatatattttgctttcacatttgtacaataaaaatggtgtgtagtccagttcagtcacaagcgcgcatacacatcaagatataatggagaagctagcttaacccataaaatttgggcatgaaaaaattgtaaaaacaaaatagaacaaatttggacagcatgtagacataatattgaatagcatgtggttcacaaaatacctcacataacaatggttcacaacataacagtggtcacaacataacagtggttcacatgcaccatggttcacatgcaccatggttcacaaaagacctcaaataacagtgcctcacatgcaccaacaacaaaggtggttcacatacactaacatggttcacatacaccaccatggttcacaaaatacctcttataacagtgcctcacatgcatagcacacaatcaagtaggcttcattttcttgggtgtgagcttctttgtacatgtcctctttgagcttgattcagcaatattcaacctccttttacatgtcacttgtgaagcaagtgccggttgtgtgcttgtccctccttgttccattaacattgcaagccggctacaaggaaattgttgttgttaagcaaaaatacatctaggttaatgtaattgtagttggttgtactaaccgtcttgtcacaactgttgggctttcttgaataatggtttgtacagtaggcctagttggggtatgtggtataggagcaggagcaacatgagcagcaggagcatcaggagcatcaggagcaggggcataaaccacatcaggagcattaggagcaggagccggcccatacctcattgtgttccatcttgcctttcgtttcctacaaggtgagataaatatattttaattttacaaggaaaaacaaatgtagtacaatagaaaaaaaataatgacatttagacttacggcttcttctttgtaccattgagcttgcacttgtagctagtttgtccatgacccaactcaccgcattttttacacctctttttcctctaatcgttgccttctctttggcagtctttaggcttgctaccaccaccttccaagcaacccttgatccttagtttcctgtaccttcctaggttcctttttgcaaggggtgcaccaagaacaaaaggtaaatccaccttaggccattgtgatttgtcagggagtggctcaataattgagttgtatgcattccagaatagggccacagagtagtagggattaatgtagttctccaactttacatccctaatttgctaggaggcaatcactgccaaggcatgttggcaaggcttgctagtgtgttgccactcctgacatgtacaagactgctcatgtgtcctcacaacatgcctagcatggctgctactattgtcccaaacctcagcagtggttatgtcagcatgcacaactgacaagtggcctaaccctcgagtcctagctctcaactggtgcaaaatggcaggtagaattgtacctgtgaatttatttccaatccttctcctcctattccacagggtcattatcatctccctacatgtgtcagcaagctcacaaataggtaaggcctttatatctctgatccaattgttaaagcactctgcaagattgttagtgacataatcacatttaatttcagcattgaagccactcctgtaccatatcaatttatggtaagtgtcaagccagagagccacatcggtgcatgctttcttaattgtatccatacactcctcgtgcacttgtgccctatatgatctagctacaggatacatctcttggaagacagatccaccatatttcttgattagattttgcgtaaggtggttaaaacattctctatgtccagcccaagggaaaactcggtgcactgcaatctctaatcctttgcatgcatcagtacaaattgcaagaggagatacttttcctatggccttgagcaattgaatcataaaccaggtccaattatcagtagtctcagcatcaaagaaaccaaaagcaatggggtacatccagttgtttccatctatagctatggcagatgctaaatgtcctttccacaaaccatttagggcagttgagtctacactaaggtatggcctacatccagttagaaatccagtaatccatggactaagtgcacaaaagaatctgttaaaataaaccttcccatcaacctcaatagtgtcaatctcaataacactaccaggggacctctccatgactgcagccctccacctatacaacatatggaaattttcttcccaactaccttgcaattggatcatagccaaactcctacccttagccacagtatcataattgattttgcatttctgatcctcttgcaaccttttttgcagttctttagggcccatacctgagtctgtcctaaggatatggatggccttggaagcaacccaggcgctggttggtgtggtagtctttcttctaccgctagatgtacacgtgtgataattagtaaactttgtcacctgcaaattaaaacaaataaaacatggcattagagcaaaataaagaaaataacatagaagtgaaaatgtcaatgacattaggaaaaaaagtaccattacggttcgctcgtcagcctgtctacgcccattcacatgccaagggcaatcacttgcccctttgcatgctcctacatattttttacgatctgtcgcctttacccaaagttcaaactcctcattgatagcaaactgtctaaccgccaatctaaagaccttcatgttgggatacacagttcctttgaccaaggatggcttattcgcgtcattcaccatcatcctttctcccgcaacctcgtcctcgaccggaggctcaacctcaacctcattttcatcgtgattccgattttcagcaccattgccattgttaccattaccctgttcagttgtagccgccgcttgagcattctcggcggcttcatcctcagccctcaaacccaaaagcacatacaactcgtcatcatccacgatgtttacccttccttcctcatctaacgattcgataatctgtaggttttcccaatcaacaataggtggtggatgtggttctggctgtggctgttctccttgagtaggaggagaactaccaccactatcaggttcatcagcaggtgattgtacaactactaattgactcccaggctcctcctcgagcctagagaaaaagatgcaaataattgcaaacaatagtcagatctatctaaccccttacttccagcaaatcaatcgtgtaatcatgtcactgaaaaaaaaatagagaagtgcatacctcccaacaatctgtagccaggtggagtcatccatggagtcaaaccctaaccacacattgagggaggggaggagggagtggagggcgggaagagctgaccgaggggcagcggctgatgggggtggcagcggatggaggtagcggtggatgggggcggcggtggcggcggatgggggtggtggtggatgggggcggcggcagatgggggtggcggtggatggaggccgtggtggatgggggcggcggcggatgggggtcgcggtggcggcggcggatgggggtggcggtggcagcggaggcggatgggggcggtggcgctgactgggggaggacgaggtaggggagtggcaggggcgggggccggcgccggcgccgaagacgaagccgatgcggaggcgcgctgctgtcgcctctgccgatgccgctcccagcttctccctcagtcaacaccgacgctggatggctggagagatcgattcgatctggtgataaggacacaagggtattttggtcagaacaaaacttaaaatagagtaaaatcatttctagaaaccaaaaagatcaaaaatagcatttcagtgaacaccccttagtttaggatagcattttaatgaatcactttgaagggatagtattccagcgaaaccattcttttgcgatagcaaaatcacaattttctcacttttcggcagggccgtctccagaaattgggggccccggaacgaaatataatttgagattctaaatttacttttgattcagtcgattatttaaattagtaaattatattcatggtatttgatttaaaagaatag

SEQ ID NO: 13248 - DNA, 11458 bp, Oryza sativa
gttggctagcagctttgggcatcgtcactgttgatcaaggattcagaagctggtttcgcatgcacgcacatgaacacatattgttgattatggctgactggttgtgctggtgcagctggtctctctgatttgggggaccccaaatttttgtggggccctgcgctgacggctcagttcacacgccctcgtcgacgggcctgcttttcggttcagaaaccttgaaaatgacagaaaagctaactatgatttgtgttaagcactctcgttggttttttcttcagtctaagcattcatacttaaactgcgaggagatgttcaagtatatatatgattgtaagagatatattaggatatgattgatttgtctttcttatttctaatcatttcttatgtctacccatatatattctaaatatatatacttgtcctctgagactaagtacaacacgtcaatagtatctttctgatgtactattcaacataacctggaattaattaatttaagctactaacatgtctccattcatccccaaattcacagcaatttaattttcttcaaaattcacatctaggaaccctagccctacaccagatccaatgctccgagcaaccctacgtcggatccatcacatccaccaatgtcacccatcctctttgccacagttgccgccccttccatccccttcattacctccaccagatccggaaactccaccactgtccctcctatctactttgccgccgccactacagtcgcgttgtctgctagagagggagaagacgaggagagaggtgggagagggagggtagggaggagagagatagtgcatggagagcaagaaaaaccgatgggcaaagggagatcgtggagagtcacagggagcaaaacttaatagcgagcctgtgttgacggttgttaagtactatctctgttttaaaatataagaacctacgaccgaatagcacatttcctagtactacaaatctggacaaactatctgtccggttctaggttcttatattttggggcggagggagtaccaattttgtccattaactatattagaaaaagttccgtccggttctaggttcttatatgacggggacgtcagatcctttgaggggggtgtctgtgacatcatagtgcaattaggatgtggcctatgttttttttttatttaaatgatgtgacatgtgttgttcataagcattgtgtgcactcgagtagtaccatctttgctagttaagcaagagtgtatagccaacttgtaaggcattgcccctccaaccatattatttttaggttgactattttacgtgaagcgagaatggaagcataagtgaggtgatatttataactgagcgtgctagttggatggaggctggcctgccttgttccgaaggattggctgttacaaattgtaaactaaaattacttgcatcatgttatcttaaatttatgagaaaaaaatgtcgcaacaatggagctggttcatatgaaactatcatttttatactacatgttttcattttttaaaaaaaatatttagcatactaatttaaacttttaagaaatattttttcttgtatactaaagatgtctgtatagattttaggatatattaatttatgaaattttatattaaaaatatgataatatagcttctttatctaattaaagacatactcatgtacttctacttgcttctactacctccatccataaattgaaggattcaactattatcctaaaatataagggatttttaatactactcgttccatccagccattcttaatttaatttctatccaacattattctaaccatcttctaactctctacataccccttatttaatgatgggtatcttagtttttttttcatttctccttaattcctataaaattttaggatccattataggacggagatatatagtaataaaaaagtgcttcattcatagactgatttatttgtacctttgtagattatttacctttacatatttgtataggtaaatagacctcgtatataagttgagaaatataattaagtaggtataaagtcattagatgtctaatggtatgaagtaattggtccaccaattttattagaaaattaaggtggatatttttttggggtaatttttaggatcttcttttatttggtggttaacttaattgttgtaagaaaaacaaagagccaagagccagtgggttcgtcttgtccgtgaggagggaactggatacatgtgttgtacatatgatcaataggtggtttttttttaatatatagatctacagtttaaaataaggtccattggtttgggtatgatgacttcagctcaatataatgcatactcctaccatagttactacaatgtagccagttgagatccatgcttggcacccttcagggtatgagtaagaaaaaatggaggtgatgaaaatagttttttttttgtcttgacttgatttattgtatagacaatacataatttgtttatggtgttaatcgatactactaaattttagtggtacttctggtggtacatatataattttctcttttaaaaattagcagggttgatcattggactctacttcgaaaaatctaatagcttcagtggtgaggaccacgtaaaaaatatttgctcaaactgtgaccctttgctaacatacaagttgatataggtttttattttttttcttgtattatacatctaatttccctatgcatgttcgtggggattaatatttgatgaaatttgttaaaactctttgtgctaattgttaacactatttggatggggacgccataacaaagagatataatatagttacatgtatgtttttttttctagcgaatagtagtctctcgtatggacactttttttttcttctcggacaaatattagtctatcataggaatagggtgttcataatgtgcgtctgcatgcatgcatttatatgagctcatgtgattaccttttaaattgttagtaaaaaagtacttttaaagttttgatgggaagagggtggagcaacgggtggcataagacgacgccgtggcatggcttcttttacctcctcgcaaggagtggtcactgcatatatgctcaatttagaaaaaaccttagagctggaaagaaagagaaaactaccatatgggtcaaatcatatacacactcttcttatttttctttttatatatcttctgtaggtatgtacataggagttttaatttgtatgtacataaggaaggattatatggtttttagacagagggattattgtcatagatataatttaatggttgaaaaataatggatcactgtaacagactcaaaatttcagggaaaaaattttgcgaaatgttttaagtcctgctcttctcgattcttgcattggagtgatcttgcttttaatctttcctttgattttggacttaaactttatttgtaaagttaatcgctcccttttaaattttataaaacctttccatttattttatgtaatctctaactttggctctaaattatatttcctttgaatccattcccgaacacctccaacaaataccctttcaattcccgttcaaccatctctagagcacatgaaatatcaatctctctagagttaatacctttttatttcgagcttaccacactaccaccaaatccagttttatcttccaccaaatacttctcctttgatctttacccaaacacatgaaataccaattcttatttttcctagaaccaatacctttcctttggatctccacctaaatattcctgtagtccataaaatatccttttaaatctccctgagtcaatatacctatcctttagaagtatatcaatctaccaccaattccgttcctgtagaaattcccatccacatatacttccaaatccagttctatactctaacaaatatttcccctttgaaatctcgttcatctaaattatccatttaagatttcaaagtctattattcaacttgggccaatatttgctcgattggtcgtcactttgttacacctcctcatcaatttttatcccttagactaaaccgatataatttcaaattttcctagaatttattctggatcaattccttgatctagacctatcattagaaatcgccattttttctcctttatacaacacctttcataaacccctttgacattcccaaaattctcctattctgattgagccgccaatttgattcctatggcttgatcatatccttggcacaaagaacaatatcatcaccaatattaaatgattgctcttgtgctaagaaatctagtttcattccctttcattcaaaaatccaaattccctttagccataacgaatccccagaaatctgtaccacataatgtcgggctgaagtccaatttatttaccaccatccatttttgccaccaatcctaaatttatccaaagttagaagttaaattattgcctttttgattatttttgtgacaagttttaaaaatttggttcttattgaattaaataaaattagagtattttgatccttattgaattcctttaaaattggaacatcttgatttttatccttttcaaaatttatatcttaaaataaatatttttgattttattttaagaatatttcaaactcctttttgctttaaaaactttatatttaaattctttttataaagttcaaaagaccccaaacttttctcttttaaattttatctcctttaaaatctatttaaagccttccattcaaaattcccctaattttcaattcctttgaatcctattcaaattccttgtccaagttcaaaaagtccacaatcatttatcctttagttttcatcgcctttgaattccaatcgaaatcctctagactcctattcattttgggccgaaattcctcatcaagttccgatgccactcgccccttcccgatgcgccgccactgacgccgtgccatgcctttcctcctccggcgcccaaccctacaacgactgccacatattcgtgccgctgtcatcgaccaatcggagcacagagccggcgccgtctccttcttttccacgttgccgtcgccgagttctccttgctttctgttgatgtgaaaacacgaggcctgggagatctgcttaactctagtgtaggtccaaaacttgcccttgggtgtatgagcgtgccagttgatttgatcctgtaatcaacaagaaacaaagacaaagaaaccatggttaaatccataaacgatagccaatcggctaggtgccgatgaaatatcatttatctttgagccgataccatatatgcatcgatcggcaatcattaataagtaaaaaagaaataaatctactcgatcagctgtagatattaacaatatataatctttatgtcgatatatatttaaatcaagtgattgggatagatcggttgccatgccgagacagtataaattacttagatcgaaatatatattaacaaacaagattatatatgttcatagcatagccgatcagatagatctagcatgtatcggctaatactccgataccactctatattaagatattaaagcaagtagaatataccaaacaaaaagcctaatatacttaaatgcaacaagatcttaacataaagggcagatttaacatgtcaataaaacatataatataagcttagttaaatcagataagatcggctgaaactccgatactaccctaatcggcaaccaaagacaggctagagattgagattctactaagatcaaactcaactgatacagctataagtatgaaaagaaggacaatatctagacaatcaagtcgtcggatgtttcatagggtggtagatatcttatataatctaagtcaacgtcggtatttagcctaatcggctgccttttgataacagatattagccgattataggttaaagagcgatattgccggagattgtataagatatacgataactcgccggattacataaataagattagagtatcatgaagatggaagcactaatcccgagaatgcaagccgccataacaagttttacctcttgttcaagatcgaaaccgatgcagcttaacccgaaagcaagaattcgtcgaaacaaaacgaaagtaaaaagggtggcgatgcaccgagattgtattgaacgtgtgttcatttgattacatggggctcggggtctatttatacgcaataattacaaaatatgtccatatcggacacgactcttatctctaacaaactctaagataccataagtctttgcggcagacttttgcccaaatatatcttcaagaaaattacataaaatatcctacaattgccttctcaggactctatccatgcgtggcaatcaccatgaagcacaccaacctaacctgacaacgtatgccgtgtcatattgtcagattcggctcaatcggctaaccctgtccgactcgaactctgccgatcctagtcgcagccgatttggacctcagccgatccttactctgtttctaggacgatctctatctcgaactccgtctcgactcctttttcacatccgatccttggattaccaaatttgctccttaacacattcctcctccgcaaccgccacaaaccaccgcctcttgttgcctataaaaggatgatgaggttcccccttccttccccacacaaccgagcttgagctctttcttctctctccaccgtgatcagccacaactcagccatcgatcgatctccctcaccagtgctccaccgaccaaacctttttaaaatttaattatcctttaatttctttaaatgcccttttctttattttgggtgaatagccagttcagtccttcaacttttgctcaagggtcaaattagtccttgatgttttataatgtccaaacaagaccctaaagattatcatgtggcttaatatagtccttagacccacttaaaacgccacgtggacatgccatgtcattcatgcatgtaagataacatttaaatgtccattttaaccttcaattttctatcaaataaagaaaagaaaaacaagaagaagcaatcataaaacaaagaaaaatgtcaatttttttagctatcaatgctacatatttttgccaatggtcaaaaccggacctttaaatattgaatttgcatgcatagatgatgtggcatatacacatggcatgtttagagggtctaagaactatattgaatcacacaatgaacttaaggtacttgtttggacaatacgaaatgtcagggactaaattgatccttacgcgaaagagtcaagggatcattttgggtattcacccctttattttaaaataccattttaaattttattttttaatctattttaaaacccccttttgaattcaaatttctttgatttatttaaataccccttttatttctaaaccattcctattttatcccttagccacaaaatagtcgtcgtggaaactttacgcttaccatggagacgctcgcgtggtcttaaaccccgacgtcaaaccgttggtcgtaaaacccggcataacctaatcctaaggttgaagtgttactcttcgcgccccacgcctcgatgcgtacagtggtagaatcctcattactccctcggcctccacagcacgccacacactagctttcaggctctgtgtgatcctagccggtctgctgccactcacggcaatggagtaacaatttccatcctgcaaacccacagaaattttctcaactctctagtcactgtgctgcttaattgtagcatcgactagacgagccaaatatctagccggcatgctacccaaccttagcatcggctaaccaacccagataattagccgttatgctaccatccatagaatcggctaaccgatccaaatatctagccgtagtgctgccctattctagcaccgactagaaaccaaatccaccaaataaactccacctacccattttatcctttccctcaattccaacgtttagaaaccaaaacctctcttttgttttccaaactaaaatctattctgaaccattcctttctcctctcaccttgctccaattttatttattccttggctttatcgtttctttgtagcaatttgcttataggctttatttgctatcttttcgtatccgtaagttagaccgtacaacaagttctatcaacatccaaggagctgacatggacccagatagctacgctgaagccgcggaaaatcatatggcgcaaggcaagacataactaaaattttgatcatatagcaactttcatataatcttcatatttaaatttgatgcatgatatttactcttgtaacatctcatgggcagatgttatatttcataataacattgtggtggtttaaaatgatatttaatgcttttaagcattgttatatgagattatggaaagatacattggacatcattgtatgtggtttattattcagacatctttacaaatttaggaatccggttaaaatgggcatttttgaatgatatatatatatgatgaagtttgttggtgtggggagtttggaaaatttttggtggtttaaccggattataattacccccttataccgtggaaatgacatagttgcgttcatccacacgatcaagtaattggacttagcctagtacattgtcccactatatgaaatactgttggttggctcactaggagcaggattggggtgaacgcatgtataaggaggttgggggcatggttcacaacggtggaacccgtgaaagcagcgaccaagtagctagccttgcctaggcttggcaagtgcccgactgctaggacggatcaataactagtaactagtagtaagtgggaccttcgaacggctctgttgttctcaacctagctagctgtgggcattgtgtgggtaaagctggacagtctctacagaggtgaattaaattattcgaatgtgctgtactcccggttttggagttgtgtcattagggtgattcctactcctgaagtataagtagttttaaaattaaaatgttaaggataaagaagatttatggtttttattattcccttactttatcattattttatttattcatatctcttcacaagtactcacccttgcataatttgacatatagaggaaatgtgctaacaacgagatcagaaggaagcaaggtctacgacaacgacgagtttatctaggctagtatacactcgagcttttgcctgtagagttctttggaattctttggagtttattagttgtagttttagtagttgaagagtttaggagtgtagtactttggattttcttgtatttcaaataaggatatattagtttggatcttttcaccctttaacagttgtataattagattttcttgtatttcaaataaggatatattagtttggacgatcacgagtggatttttggggcaccaagcctaaattgggtttccccacatacttggtattagagctcagcttgactgtaggctgacctagattggttagaataaaacataaggacaaacttaggcttaaaattttgcttaacatatataggaattagtttactccccactattagacgactgtcgagttgaattgcttcttaaatttgatttttgttatgaaaaatgttgtttgtattgcgaaaatttgcatttttcttctagattttactagtttttgtaaaattttatgaaaaaccgttgcaagtttgactgttaagggcagaaattgagatatcagatggtgaggattttggctcatattcttgcaacccttggaataaattgcaatattcaagtgaagatttcttgagcaatatacatatgcaatactacaagtgtctgaattttagaagaatctgttgaacataaatggttagactgccagaagattaaatcatctatatttcatggagcaacaaaacctctcaaagctattggctggatccgtaatattggaaagatattaaatacggtctagagtaatgaccgtgaaaggggaccttatgcatttcatagaaaatgcatatgcttgttggacaaattatgaagctattcagagtgaccagaattctattacatgaattcaatacaaaagggaatgagaacacacaagaggaccattaaaataattcaaccaaacgaaagtttcataagaggtctaacattttgcttattttcctatggaattagtcataggatttctcgatgttttatatcggctcgaataaaggggtagcacactgtagatattttatacgatcatagataaatctataagcgcatgaataccactacagcatttcacatggaagtattccaagggtatcgtatttgtttttccactgggaaggcggcaatgtaaagagttggttcatatagtcgtaatcatgatgtaattaatataccatagcctaaacagggataaatgatgtaataataatgtatgggtagtattttacacaaaggagattcatctctaataataatacacgagatagtgaagaaagacaaaagagacctaaggttcatatgcagttctatatttatggtgtttagactacacttaacaaatacatgcttacaaggctagaactaagttctagccgctcaggcactgctgaaagacaactccctacaggtctatcagtttggttatggcattttacgaactcttacatcatacctggacatgaaggaatacaaatggtaaatagtgctgtcaccacctgccacctacctcatttttcgtgaggtatacccacatccaacgacatttaattaatctaaccaccatgctcacattaaaaaataatggcactaattccccccagtactcccatcgttcggatggacaagttagaactagtacaacccgttaagatcattggaccgatatcgtggcatatatcgactagcctaatcaagtggagcatataattgaagtacagattatacataactaataaagtagtctatgtattataaacactaataagtaaagaagataatttctttgttactcagtcttacaagaaaagtaaaatactagagacatacccgaatctctgagaagactttgaaaccgaagactactctaaacctaactgcactactactagagagaatacaactataggaatgagagaattgttcctttagtgtgtgttgcgagagtgaggaagcgttcttttttttatagctgctaatgatgcttagaaagggcagtatttctcacaaccgtcattgggagcttcatcaggaatgtccatgtgtaaggtggcaatgtgatgagccagaggtggttccgctgaacaaggggttcggccgaccaaaggtccctacctcttgctaccgaccttcaccatgggctgccatgtgggcccctacggtggtgcgcagtggcttggcctcgctggtacgtattttggtt

SEQ ID NO: 13249 - DNA, 1019 bp, Oryza sativa
gctttccatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgtccatgtagggactgtaagaatgaacagatgatcgttgatagcgatgaagtgcatgttcatttgataatgaatggattcatgaagaaatatacctgctagaccaagcatggagagcaagaggcgcctgatatcgcagctgaagaagtgttggatcaggatgtagagaacaccgctgtgactcgagaaggcatgttcgtaccttctcctttaggtggagagaccatagatttggacactcaatgtctatctacaatgttgcatgacattgaagacgcagaggacaacgacagagattttgagaagtttagtaagttggtggaagattgtcagatgcccttgtatgatggatgcaagtcgaagcacagcaagttgtcatgcgtgttggaactcatgaagcttaaggctagtaatggctggtcggacaagagttttacagaacttcttgagctgttaaaggatctgttgccagaggggaacaatttaccgcagacgacatatgaagcgaagcaagtattatgtccgttgggcctggaggtcagaagaattcatgcatgtctgaacgactgcattttgtattacaaggaatacgctgacttggatgtctgccctatctgtggggcatcaagatacaaacgagcaaagagtgaaggtgaaggaagtaagtcaaagaggggaggcccaacaaaggtggtgtggtatctcccaattgcggagcgcatgaagagaatgtttgcgaataag

SEQ ID NO: 13250 - DNA, 2736 bp, Oryza sativa
  unsure (1)..(2736): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagtgtgagttctggatgtccgaagtcaaattcttggggcacgtgatatctgccaaaggagtcgctgtggatcccgaaacagtgaccgccgtcaccgattggaagcaacccaagacagtcactcaaattcgcagtttcttaggtttggcaggatactaccggaggttcatcgagaacttctccaaaatcgctcaacccatgacacagttgttgaagaaagaagagaaatttttgtggagcccgcaatgcgagaaggcgtttcaaactctcaaggaaaagctggtttcctcgccagtgttaatcttgccagatactcgcaaggatttcatggtgtactgtgatgcttcgcgccaaggattggggtgcgtgctcatgcaggatggtcatgtggtagcctatgcctcacgtcagctacgacctcatgaaggcaactaccctacccatgatttggagttagcagcggtggttcatgctctaaaaatctggcggcactatctcattggtaatcgctgtgaaatatatactgatcataagagtttgaaatacatcttcacccagtcagatctgaaccttcggcaaaggagatggttagaactcatcaaggattatgatgtgggaattcactatcatcctggtaaggccaacgtggttgccgacgctctaagtcgaaaaagccattgcaacactctcaacgtccgtggcattccacccgaacttaatcaacagatggaagccctgaacctaagcatagttggtcgtggattcttagctgcgttggaagccaagcccaccttgcttgatcaaatccgcgaggctcagaagaatgatccggacatgcatggactcctcaagaatatgaaacagggtaaagccgctggtttcacagaggatgaacacggaaccctatggaacggaaagcgggtatgcgttcccgataacagagaacttaaacagctgatacttcaggaagctcacgaaagtccttattcaatccaccctggcagtacgaagatgtacttagacttgaaggagaaatactggtgggttagcatgaagcgggaaattgcagagttcgtggctctttgtgatgtgtgccagcgtgtcaaggcagaacaccaacgaccggctggacttctccaacctctccaagtaccagaatggaaatgggatgaaattgggatggatttcatcaccggccttccaaaaacccaaggtggatatgattctatatgggtagtcgtggatcgattaaccaaggtggcccgatttattcctgtgaagaccacctatggagggaacaaactagcggagctctacttcgccaggatcgtgagtctccatggcattcccaagaaaatcgtatctgataggggaagccaattcacctctcacttttggaagaagctccaagaagagctgggtacccgattgaacttcagcaccgcataccacccgcagacagatggacagaccgagcgtctaaatcagatcctagaagatatgcttcgcgcatgtgtcctagatttcgggaagacctgggataagagtctcccctatgccgagttctcatacaacaacagctaccaagccagcatacaaatggcaccgtatgaagcattgtatgggcgcaagtgccggacaccactattgtgggaccaagttggagaaagccaagtgttcgggactgatatcctgagagaagctgaagctaaagtcagaaccattcgggataatctaaaggtggcccagtcccggcagaaaagttatgcagataaccgacgccgtgatctggaattcgcagtggatgactttgtgtaccttcgggtcacaccattgcaaggtgtacacaggtttcagacaaaagggaagctcgcacctcggtatgtgggtcctttccgtatcattgctcggcgtggagaagtcgcttaccagctggagctgcccgcctccttgggcaacgtgcatgatgtgttccatgtgttgcaactcaagaaatgtcttcgagtgccatccgagcaggccgactcagagcaaattgaagttcgcgaagacttgacttatgtggagaggccagtgaaaatcctgcacaccatggagcgcaggaccaggaaccgagtaatccgtttttgcaaggtccagtggagcaaccacgccgaagaagaagcaacatgggagcgtgaagacgagctgaaggcagcccatcccgatctcttcgccagttcctccgaatctcggggtcgagattccgtttaaggggggtaggtttgtcgcgtcccaaatcgactctaaaattcatcctcgaaattgtgaaaagaataattaaaattcatgtgaaagcctccaacaattaaaatgtgcaaagataaaagtcaaatgaggcttggaggatttttgtatatttcctaaaagcctaaaatgtgtaaatcaattttggtggaattttcagagcacaaacaataat

SEQ ID NO: 13251 - DNA, 4147 bp, Oryza sativa
tcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggttttacggaataaattgttgtctaccgtcattattgctttccttccgagagttccctttccccgtagtctcccttcatggcgtgattcaggtaccccaattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgatgagacattgcaccactttattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcataagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttatgttcgaagtgcttgcctttcttccgtaccgggtggtttgctgcaaggaattgtcacgtcctgataaattcatcccgaaataaaaataattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaaatttcagagcacaaataataattattaagaaataaacaaagttaaaaaggttttataaaaagaaaaaccctaaaaagtctttttcccccccttcccctcttgggccggctcggcccacctccctccctctctctcctctcccccgcggcccatcggcctccccccgcgcgcgcgccgctgacgggcgggcccgcccgccaccctcgttgacgggtggggcccacccgtcatcccctacctcgcgccgcacccgccgcctcgcccgtgccctagcgccgccgccgccgcggattccgccgcatcccgccgtccccgcgcgcaataaagagggggaaatcactccctgtgattccctctaccatttacccgctttcccctctctatatccttgggattcgtccggattcatcccgtaatcctcgacggcgtcatcaatggtggccgagatctccgcggacgtttactccctctcaggccaccctctgtccctaccggcgctatataattgctccccgtgcctctctcctccgtttccgccgttcgccgcttgctctcgccgtcggattcgtgctcgcgacgtccacctctctctccgccgtcgccgccgacctccggtccgccgccgtcgtcgctccggacttcctcccgactcggcgtcacctccttcggcttcgccacgtcgtcgtcgaccccgtccgccccttcgcttcgcccgccgaccgccggagctccgtcgccctcgtcgtcccgaaccgcgccgccgccttcctccgcttcggtcgccgttcccgtcgtcgtcgtcgaccggggtgagccgtggaccgtccctttcgcttccctctctcctccgctctctcgggcgccgctccgccgcgccggtggtcgccggcggtgaccatcggggcgcgggcgcgccgcctcccgtcggccgtgccggcgaggccgccttcgggcgcgccccgcggctgccatgtggggcccggccgtcagccgcccgcgccctcgggtgcggctgacgcgtgggacccacggcgccggccggcgcaagccgcatgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaactatgttgatttaaattattgcattatcgctttatttaaattcccgcgttatcactgttttatctagccatgcctatttacctttgttatgaccttattattgttattgttattattaccttgttcaccctaggataaacaaaaccccaactagtgggtactctattcatggttccactagtatgaatttaggtagatgcttcgctgattaaataggataacattaggtggttttacaactctagactttgggaatattcatatcacctggacactttggaatggttggcttatggtggaattggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaggatgggttgggaactatgtcacgtcttccgttcgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttg

SEQ ID NO: 13252 - DNA, 7791 bp, Oryza sativa
  unsure (1)..(7791): unsure at all n locations
ttcaaatggccataacttggccatttgaactcggaattggaccgttcaagtctctaatttttccttaagaagtcaagaacccatttttgtgctttgttctgctattatgtggagtttattagagttaaagcctttttcttttccgttggtcgtgtagacgctgcagcttcggaagatccgctcttcgtggaagttgaagccgacgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgtttttgttattaataccttgttcaccctagattaagcaaaaccccaactagtggacactctactcatagtaccactagtataattttaggtagatgcttcgcaatttaattaggtaacattaggtggttttataactttagacttgggaaactttcatatcacctggacacttcggaattgttggtttattgtggaattggattcacaccatcccctttattcaaaatccccaaaatggttttaggctgggctcggggagcatggttttgatagtagctcctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtctttcgtctgtataccgtggtggtatgtggcacgtggttgcacatgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataacactgtatagctctaggatcgtctttataaaatggctttgggcaactaagtgacttttaaatgctgtttactgcaaaacctaacccctattattatccccttgtacccccttgcattaatcatgcatctgccggtgtgacttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgccaagcctgaagcgcctctgtaataatgtaaatactatcgatataataaagatgtgtcttttatatcatgtttgtatggtgtaccccggcttttcctgggacggggattaatacactagcgttcgggaaaatgcaattttctcggtcgcgacaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtatgttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcataccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcttggatcgtcccatctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttataggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgacgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtatgcaaaacataggtgcaaatgtagtatgacaaaaaaaacattggaggatgaatttgcaaaccttttaggcacctccgatttgtatgtaattaccaaaataaattcaatagaaattttggcatgacctcccctcttttttaaagaaattttgaagcttgctcgggcagctggaggaggaagaagacatatatataggggtgggactttagtcccggttggtagcaccaaccggggctaaagatcaccgggatctttagtcccggttggtaaagttacgactttagtcccggtgatcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgatagcagtctgcttctgtgagaaggaacaactagtttgtagtatttttatggtgcggactactgaatttaaaagatggttgtaagaagtatggtccctactgcatgatcacttcaatttcatcattgagacaagattggtgtgtgtgagtggatgtcacacttcaactttcttcagagatatcatctaaatgattggaataaattattggccttcttggctgaacttttgagaactgcaccaaaagattgatgacattcaggatacaacttttgagacctttacatgcatgtcttgtagttgggttgtcaccgtagcataacaattgtagtgtaattaaatttattcccgttgcagcgcaagccatttggccaatataaaaagtatcatttaggttccttcttatatttaccttagaaaagtgtacagagtaccaaatagacttattatgacaaacattacccaaatctcacatctaaatagctgaaaatatatgcaacagcactcaaatagacttattttgaagttctctattgtgctgtatacattataattttttggtattcacatatctaatttatattgctggttgctaaaaatatgagaaactttgctgagatctgacttataaacagtacatacatcatacatgtacaggaacaatgactgtagatgtgcagtacactatctttgtcaattagcggtaccattcatttataaatccatatagtccatgattaatgaaattttgaagtacatgcactggttaggccaatttctgattcaagtccacatccattctttattattcctttgggatatcaaacatttgacatgtgaaatactgtgttcgtttgtgatatcattcattattcgtttgggatagagttttgaaggaattaaattcaagattgtgttctcaatggaaatggacatgaactcataacttaacatattggttttctaataaacatacttttatattagattgctactcaaataaaaggtgaggagaccgatcgatgggatctggcagtcttaacctgtgattgattgagcgagtcttgttctctgatcctgacgacctactctgctccagattggaaggaatgcggcaccctcacctttacacaccgttagacctgcaccttccaaacttcgttcctctgtgattgtcacaaggggaaatcatcgtgccctacctgggaacctccatctttatcgtctttgccatctggttcatctctggtacgcgactctccttctacctactgtctatcgtatcatctgtatcccctacttcctttccaatcccgcatttgtctccaaaattgttttttttcagagtccagaaatcattcctttgacctcctttgtgcaaagttgggatctttaactacatatcactatgcttattgtttgctttggcagttattggcatgcttctaagtctctaaagaccaagacccaatgactataaacactaccagttagcagcaatctccatcagtggcgtagccaggaacttttcgccgggtagtcctactttggaagtttacatcacatacgaaaattttatcgcaaaccccacatataagtataaatttgggtaaaaggtgatacaaatatagcaataataatatcttaattgactaaaggagctgcgtactggtgaaggccgaaaggagctgcggctccatcctcacaactctagcgcctggccgcctgatctagttgggttcttgggcttgtgttgttgggccagttgggtctgattttttttagggttgggggatctggtctgtgggccaaaatcgaggtagtcacgagcccatcgggactacccctgctacgcccctgatctccatgccattgcttctgcttttacctttgcaggaagatgtggaggcaagctgtccaagactccaagaccgatcgtttgctcatgtgctggtgggccttcaccggtctcgctcacataatggagggaacctatgccttcgcgagctcatgagaagaaggttaaagtcctcttcagcaatcaaaacccctctttctccgatgaagtttgtatgtcgtccctgctgcttacttgccctgcccttgccatcgtttattcaccttggaggtaacaggtatatatggcctctgcatttgttcagggaaagagtacagcaaaggcgactccagatatgtcgccagagacccagcaaccgttacagttgaagcaattacagccgtgttggaaggccctggtttactcctttctgtgtatggtttctctcatcttgtgttctgattcaggatagacagcttactttatttcattttccggttataaatattcagcgcaattaactttgaccatccatcttatttaaaaattatgtaaatattatttattttgttgtggcttgttttattattaaatgcattttaaacgtgacttatatttttgcatatttacactaaataagatgaatggtcaaatttcatggtcaaagtctatttcctcaaatatttatgactgaacagagtaagagtatattcctcttaccttgaatttcattcgttaagtgtacagcactactgatgtacatcttgcattccatgtagttcagaatatagccttttgttttctagtctctagctgacaaaaggtctccctgcttgcagctatgccatcgcacgccagaagtctgacagccatatcctccagttcactgtctgtcttggtcatctctaggaataagttcaccggaggtccctcaacttaacagcgaaattttttgaggccccttaaccacaaaaccagaaatgtttacccctgaacttactcaaaccgttcaccggaggtccctcggcagtatttttgcccggttttgctgacatggcatcctagtcagcaaaaaaaaattaaaaaggtacgtgaggcccatatgtcagctgcacatatttttttcttctcttttcttcttctcttctcttttctcttctctcctctctcttctccttcaggctggcggcgggcgcagccgcgatggctgagcgcggcagcagagcggtggcgggctgtgggcggagcggacggcgggcgagcccggcggtggagcggaggcagcggaggctacgggcggagcagccgcgtgccgtggccgccgtcgtcgtcggctccccatcgtcgtcgtcgccgtgggcgaggctacacggcgcggccgttcggcggcatcggccaggcgtcgcagtggccgtgcataggtggctcgaagtgccggctgacgatgcaccccagtcgctcacgctcctcctgtgccgcggctgcggcagtggtggcggcggcagcgtcgccggcctgatcccatggtcctcccggatgcccagctcgcgcagctgcagcaggagcgtgtccacgctcggcgtgccatcggcgtcgtggacggtggtcggcgcgggcgcggtancctcgtcgtcttcgttgacgtcgcggtagcacttgacgtcgtagctcatacgcatatattccgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcacatgttatatgcaattacgtgcagcggaggagcgcggatgcgggggtgcag

SEQ ID NO: 13253 - DNA, 2526 bp, Oryza sativa
gatgctaggagaggcaccaccggcgggggaaggggaagaggcagaggaagcgattgtttcttggtcgccggccgcctccccctccctcccaaactcgctggccgccgcgctcgctcgcctccgctccgccgccgcgctcgcactccgctactctgtccgcggcctgctcgcgctccactgctcggcccgccgccgcgctcgcgccttccgctgctccgttgccgcgctcgccctccgctacgctgcccgcatccgtgctcgccgctccgctccgccgccggacggccgcgccgcgtagcctcgcccacggcgacgacgacggcggccacggcgcgcggctgctccacccgcagcctgaaggagaagagaagagagagaaaagaaaagagaagaggagagaaggagaagaaaagaggagaaaaaagatgtgaagctgacatgtgggctccatgtgtttttttaattttttttgctgactaggatgccacgtcagcaaaaccgggcaaaaatactgccgagggacctccggtgaatggtttgagtgagtttaggggtacacatttatggttttgtggttaagggagctcaagaaatctcgctgttaaattgagggacctccagtgaacttattcctcagctctacggatgcttggtttacttgcctacttgggtggcttcaacttctgggctagtccgttctacttctgggcttatttcattggacccaacagtttgtgggttgtgatacaagggaaaagttcattttacaccctcgaactcttatgattgtcgaaaatacacccccgaactacaaaaccggatataatacaccctcgaactgtcaacaccggacacttaaccccccccccccgggctgttttcaccgtggtttttgccacatcggctgccacgtcggatgccacgtcagccctcgccacgtcagcgcacaacataacatgggccaagcccatattctctcccccctctctctccctctctctctccttgccgtgtttgttctcctctctcccacgaccggtggcggcagctgcgtcggcggtgtcgccgcggagctgcgagggcaacgactacggtggctgcgtcgagctgcgagggccgcggctgttgcgtcgagctgctagggccgcggcggctgcgacgtcggcatcggcggtggcggggagaagtccttatcactctcctcttaccgatgtcaagcaaaaagagaagagcaaaatgttagtatgcacaaattcaggtctcagattcagatgatgtaattaacctacattgactgtatcttgtgaagacttcccagattgtacaccaagaccaatgcacgtcgttgcttccaccacgcgtcgagctgcttcttccctgctaagccaaatccaagggcgcgtgcggcgatgacgcccggaccttctgttgatgactacgcgcagaggcttccaccggcgaccgtccgcgcaatcggggcagcgccaccgccctcacagtagctccctcccgccgccgcctcgcagctccacaccaacgcggcagccgcagccctcgcagctccacgccgacgtcgatgccgcagccgccgcggccctcgcagtttgacgccgccgccgtagccgtcgccctcgcagctccgtgccaccgccgctgccaacggtcgtgagagactggagaacaaacagggcagggagagaaagagaaagagggagagagagggggagagaatatgggcttggcccatgttatgttgtgcgctgacgtggcgagggctgacgtggcagccgacgtgtaaaaaaccacggtaaaaacagcccggggtgttaagtgtccggtattgacagttcgagggtgtattatatccggttttgtagttcgggggtgtattttagacaagcataagagttcgagggtgtaaaatggacttttcccttataccaactcggaaaaagtatacatttagtccctcaactatcgccgaagtatgattcatgtcctccaaccacaaaaccaggtatatcgacttctccaactatcaaaaccggtgcaaacaatacccctgggtggttttggatgacgtgccacctacgtggcagtcttgaccgagtctttgtcctacgtggcattagaataaaaacaaaaaataaaaaggaatatgttggacccacatgtcattcaaacaaataaagcattgtgggacccactgacatgtgggacccacatgtcatcctccctcgccatcccttcttcctgctccctccctctctcccccccgcctttctcctcaccttggccggagcagcagttgggagcagcagcagcagcgggcaggagtggcggcggtggcggtggggacggcggtagggagcggcggcagcggtagggagagggaggtcctagccgagggcgcggaggtcggcgagggtgtaaacgctgaggggcatgtaggaggtaaggtcaccggcggcggcagcgggtcgtaggtggccttgtcgagtacccatgacgcggtgaggtggcagc

SEQ ID NO: 13254 - DNA, 4080 bp, Oryza sativa
  unsure (1)..(4080): unsure at all n locations
tgttccttaacaccgtccccaccttcatagcagcctctcccgcccgctaccgccaccgctcccgcccgttaccgccaccgctccctaccgccatccccaccgaagagaaaggccgagggagagagagagataagggagggagagggaggaaggaggaagaagggaaggagagggaggatgacatgtgggtcccacaagtcagttggtcccgcaatgctttatttgtgtgaatgacatgtaggtcccacatattcctttttattttttgttcttattctaatgccacgtaagcgtcacgtgggacaaagactcggtcaagaccgccacgtcggcgccatgtcctccaaaaccacacagggtcattttttgcatcggttttgatagttagaggagtcgatatacccggttttgtgttggaggacataaatcatactcgagtgatagttgagggagtcaaagtatactttttcctaccaactctcatcgccataaggagctggaagaagatttttgcggcacttgagtttgaaaaggtgaaggctaaatatgcatagggtgtaccttagtcacagtttggctggaataaatacccacctgtactgtggacaatatcatttgttcctgccaatgttttaaatagcaggataaggcatttagcggttagcttctcaaacagctatagtgggctaaatggtgctataacggctaaattgtacatgagagcaaatagctagaactcttctcaaacagctatagcgggggatttaaaaccctggttcctgctatggaaacccttgtgttactgaaaaaaaattgccttgtataccctttgggcaaacaagcaaacatcactgttaaaatggtggtgactttgtgctgctatgtcttgctgtaaaaataaagttttatatctcgatcatcaatcaggtttgcatgcagttgtcctccttgaagaaataaaatggtagggtttgcccattggaaaagcctgcatgtcctgctacaagcagcacttcagtttgcccgattgaacacaataacactccctgtttgagtgtggacactaatacccatcctatgtgatgctattttgcttccccttttcttgtttggattaagtctacataacccccaacctattgttaggagattacttaacctcctcaccttacaaactaggtatttaaccccctaatcttactaaaaccgtttaattaaccccttatggtggttttgctccctggttttgccttgctggcatgccatgttggacagatggattaacaggcatgctgtgagggtcacttgattttctccggcaaagccttgtcctctatccctctatttacattgaaaatctgtaccatttttatggttcctgacattgccattgaagttggaattgcatacaagtgcaagaattcagtagcacgaacaaaataagaggcggaatataaatttttagacaaaccatttacacacacaaatatgctccacaatctttcatgaaacaagtagaaaaaaaactaagtagcaatcaggtctgacaaaacagggtagcaagtgtctctcacaaaacaagagacatgtagtaggatgcatttaattcctgataaaaaagacaaatatctcatctttccccaacacacatctttggttatagttccatatgatggagtaaaacagtaggtgggcaagtctcgaagtgtttcaagctggtctagccctcttcctgcacttctgttgcacaagtggaacagagcttggagtagcaacacttggaggcagagagcttctgctaatgctctgttgggtgcccacatcaccctacaagatgaaaaaaaacatactttagataggttaagccaatgagcaaaacaatagaaaatctgagaataacaattttataagaccatggtgaatgaggtagcagcagcagaccccactttgcttccgttttcttgtagcatccctcctgatataaccattcttcttactcccagcttctttattccgagcacaggtccggctgttatgagtagtttggtggcacaatttacatctcatcttgatgccaaccttgcttagcttagctcccttaggtttctcagttggctctcttgttctctgagttttgggcctcctgagcattttaacataagcaagtggatgtggctttggcatgtcagaaactggccatttgtccttcccttcaactggctacaagcaatgttggtatgtcttcatgtactctaagatagagaaacttgatgctatgtagtcatccaattgttttgatgccttgtatattgcactgatagcatgacaacatggtagtcctgatagttgccaataactgcagctgcatgttttctgttctaagttgatcgtgtacttcctcttctctttctcttgaacctcaaatccatgctgtccatttcacaacacataacactggccagatctctcaatgttgactttcagcttcttgaatatgtttgggcatattgtaccttgccacttatctgcctttgtcctcattcatagagatgactgganagaaccttgaatccatgatagagttgttgaaagactcacacatgttgttattaacggattcacaattggaccctagctgaaagaatgccctctccaatgttcaagtgcggtggtcatcatgtccttagctccttgaggggtgtcttgtgctagctttgctctattgtagttgaaaagctccctacaagatgactttgtacagttccaaaactttttctgaagcttctgattagtgtaccttttcctccagtttgcatatatatgccttgcacatatcctatgttctactctagggataagctcagccgctgcccttaagagtccctacaagacaaaattcaaaatatttattacaacttatgacccattgcacattttgttaaaagataaacagttaaaaagcatatcttttgctggtcagaaattatcacccatccttcacctccatcatttatattgagatctttttgtagcaacccaataaaccaatacatcaagttgttcagcttgagatcaagtttgcatcatcaagtatctctacagcctggttgctatgcactcctagcttccttgccctgatgtttctcttgatttcctttgcaaatttccaaagttgttcagcttcctcatcattatcagagctattttgctctataggctgcctataatcagagtctgaactatcagatacttgcccttcagggttgctcttattttcaggcccatctacatctttaggcttctctagaatttgagatgatgctcttcttggtttcaattttcccttcttatctgtacatagaacaacagtaagatgtagctctgcctctgaatctgatttcgcttcatcgttagcttctgccatgtcatagccccaatcagcaatctaattatcatcttgcccctcatcaattgctatatgctcaacataaatttctgcaacttgaccattattagacatatgatttgccatttctatgcaagcattgtcatcaagcaaaaaccttagcccatctgacaactgctttccaggatacagccaatgcaagtgtaataaaccactaactggcatgtggtcaccgaagaaacctataatctcaggtaaagatatcttgtcaagctctatgtatgacaatgcagtacgctctgccacataatgcaattgccccctagaaaacatgaattccccactatagtgaaacctgaccggaagaaaatccgatggatccattcctgcaaaaataagaaaaaaaattaatcctaacttttgatgagattaaattactacaaccaccaagatcgtacagtatatattatttgaggtttctagcctccgttattcttaaaaaaaaaagcaagatcatacacaaacaaagcaaatttatgtgtcctctggtaccaacataggagcaaatttctgtgttcataagccctaaaccccaaaatcatcaagcagtaaaattaccgagaaattcacaaaaagtgatgagaatttaactgcctacaatatagcactatcca

SEQ ID NO: 13255 - DNA, 13659 bp, Oryza sativa
atgaatgaatattgcaagaatgagcatatgacatactcaacaagccacacagcaaatatgcaagtgcacaggataacaaaggatggcataatatagctcatttgcagaaaatagcatttaataaatatttaagagaatagtaaaacagttgtataattaatcaatattaaataaacaccatacaacacacccgtgttgcataggcccaaccacatttgaacaaccaaccccagttgaacaaattgaacctccaaaccaggaattaaccattccaaaccaggaattaaattaattaacacattattaccattaatgagtagtgtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtatctcggaaaggaattgtgacaataccccttgtacaatgtcacgcccggaaattcactagtaatttccgaactaatttgtgcattaaatcctcgtccaggaatcagccgaggtacacaaactgacaatttaatatacagattcatcaaattaactaaaacgataaatacttacttaagaggcacttaatcctcaccaagaagaaaactgcagcggaaaataaaatctagcgaagctccggctccactcccacaggcagctcaactggggtataagccaaacgtcttctccttctggatcctttttcttcaactgaggttgattgattattgcaagaatgagcacatgacatactcaacaagccacacagcaaatatgcaagtgcacaaagattccaaaggatggcataatataggctcatttgcgaaagcagcatttagcaaaacatttaagataagtaaaacagtagagtagttaatcatcgattttaatcaacactgaacagcacacccatgctgcacaggcccaaccattctgaacaaccatacccggctgaacagatctaactccaaaccaggagctaagcaaattattaccagatataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccctatggacttctcgccacttctcagtctggcgcactataataaatcatgctatacaaaggataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattttcataacacgattaaccatcgtgagctaccattaaatataaccataaatattaatgtagtatatatgattcatcccattagtgagctaatgtttctaagcattgctaagcaattatatatatacataacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaaaactaataaaaaccaaataaacagtacataaaaagtaaacaaacacgtagatcataattttagatgaattatgagacttgaacggccttatttcgacttcaaatgaatttattatgaattttacaagatcaaatctaattaaagcccatttaaaaagaattaaataaatttaattcaatttatggacaattttaatatgtagatctttattttagaaaaatttagcaactcgaaccacctgaaacggatctacggttatttagttatgattttccgaagatttaatctattagaaaaacgggaaaaagaaaaactgatgacgtcatcgacggcagccacgacatgggtggcgacctcgccggagctagagaggtcggccgggctattggagggcatgtacacgtagaggacgacgagacgaacccgatggtactcaccgaagcgacgaacgacgacggatgacggccggcgacgaagaagcgacggcggcgacggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaacccctcaaaaatccggaagaaacggggtcggattggagcggatttagaggaggaaggcggcgcggcgcgcggctcgggctcagctaggcagccggctggaggttagggacgacactgtagcagggaggcaaactagacttttctgtgtggtttcctatgctaggcccgattgaaggagggaggcaaaacagactttgacagagagaagggcggctcggctgcagctgggccgattgggccggttcggccgcgcggagagagaaagagttgggccgaaatcggcccaacgacttagggaaggatttaaaaactttttccaattaaaataatcacttaaatgatctttcaattgttaaaaatacttccaatgctcaaataattccaagaaaaatcctgaaaatacttggacactaaaagtacttaacaaaattataattagaccatttaatgattaatttaatatgtgggtaattactgaaatgctctttgtatgattaaaattaataattgagctccaaaaaatccgagaaaattccagagagtataattaaccatggagaatttaataaaaattaaatccatccatgctttatatttaggaaattttatttcccacatttaacttcacttgtaaattgatgaacatttaatataaattctattaataatttattaaataatttataaatcctaagacgaaaatcagggtgtgacatacaacataacccattacagcgcacctttcctggatcataatcacccccttataaacaaggcatggactccccagcgacccccgtggacttctcgccacttctcagtctggcgcactataacgaatcacgctatacaaaagataaagccgttgcctacgctggcttgtggttggcacgataaatgtttcacaacagtagctcgcgaaccggtccttaattgtcatgagcacaaccatcaaaaccatatgctcacaacccaccttagtcagatcttaattatcaattaattaacatcacacgacttaccatcgtgagctaccatataaaataaccattattcataataattatgtaatataatttatatttaaccccttttagttggctaatgtttctaagcatggctaagcaaacctatatatagcatttagctgaaccaatccaatatataaggttcatgctaatcaaattataacccataggaaaataaagtcatcttcggccattaattaatagggaaaggctcaccacccgatgacattcgaaaacaatgcacagttgaaataaaataatagctttaaatgggatcaacatgctcaaagggttgtttgggaactgtgtgacttgccttgagcttccgcaaacgcttcggaaccttcctcaacggaaacgctctcctccggaacgtcggaaactaaagcaaataaacaaaatcaataaaacagtacaaaaacaagcataaacagtacatgtggatatttttaacatgtagatcttgattttagaagaatttagaaacttgaaccacctaaaacggatctacggttatttagttatgattttccgaagttttaatctattagaaaatcgggaaaagaaaaagaaaaggaaacgatgacgtcagccctaatgatgacgtcagccctggtgatgacgtcatgctgacgtcatgctgacgtcgcaatgacggccggctcgggttggagagctcgccggagctagagaggtcggccgcggaatcggagggcatctacgcgtagagggcatcgagacgaacccgatggtactcaccactacgagaaacgatgcacgacggcggccggcgacgagaagaagcggcgcggcggctcgggtcgacggcggcggaggggctccggtggtcggcggcgaaagaggaggggcagccgaggttcctctcaccacggcgcacctaacggcgatgacggcaagcggcggcgacggcggagacggcgcggcgacgtgaccgaagacggccggcggcggcggcggacttggagcgcgtcgcggcggcgctaggaggcacgggagagctcgggagagggggcaaacggaataggacgacgaggggaagctttatatagcattggattgaagagatcgagctccaaacgagaggaatcgattcgggaagaaatcaaactcgattttagggataaaatcaaaacgaattcgattcggagagaatactcaacgattcgctttgatttttgggggaaaagaaagaggagaacgagaggaacaaaacccctcaaaaacccggaggaatcggggtcggattgaggcggatttgagaggagaaaggaggcggctcgggcggcttgcgaggcggcggccggaggttgaagacggccctgacatgtgggccccacatgtcagcggctggaggaggagggggcgggcggctcggcttgggccggcatgggccggttcggccgcgcggagagagagggagtattgggccgaattcggcccaacgaccaaagaaggggttttttgaacttttttaaataaaacaatttgtgaaatgttgtttcaactattaaaaatacttcccttgctcaaataattcccagaaaattctagaaaatagaggagcaagcatagtatttaataaaattttatctagcctacttttatgttgaaaattttcctagaaaattagggtttagcttgtaggcttttaaaacaatttctaaaaattccaattaaacaacaatttatatatttaagatttttagggcgtgacaagcagcttgttcgcctcgtcggagttgtgctcgcgcgaatgagagagagagagaggaggtgccaaggagaacgatgagagaaccgctcgtgtttttattcacgccatcctccacacacgcgttgatccaccgtggccggctggtcaagtgtggcctggggttaattaaaggggttttggactatttgccactctcccggatggcgtgttctcaaatgctactctcccggatgacttcgctattccgcaaggcgccacgtcactcgatctgaggacaaaatgaccgtcttgcccttcttcttcatttccccttctgtctctttcatccccttccttcgctccggcgaggttcttgggctccggtgagctccccacctcgcactcctccctccttcgctctgctccttacctccccggcccctgctccattctgctgcggccaacaccggcccctgccttttcttttgtggcatcgccggttcctcaccccatcaccgccgacttcgtcttcctcctctcagcttttctacactctcccccgatgtcggcggctgtgccaggtccacccttagggcttttcctaccttgtcgttcttcacccagcaccaggaggtcggttcggcggtggtggtggtggtgtcaccggctcacatgcagggaggaaggttagagaagagggacctgagctagaggaagaagaaggacaagacaatcattttgccctcggatcgggtgacgtggcgcattgcgggctaaaaaatagcacacaagcaagaaatcttctctctccgatggcaaaatagcgaagtcatccgggagaatggcatttgagaacacgccatctgggagaatggcaaatagtccaaaaccccttaattaaatggttttagtaaggttagggggttaaatacctggtttgttaggtgaggggttaagtaatcacctggtaataggttcgggggttacgtagatttattccttcttgtttctttaggaattaggacggttgtgtataattcaatgatgcagccatgcaggtattactcagatcaacagctataccagcttaaattttctgatccatgagaacatgtacttagcaatttctggctagtttaacacgagtctgcttcgaataaaattgcaaaatacaactcaatcaagatcaattgcaccgataaggtggcctcggcttcggccacggctgaggaggatgatgggccggtgttaacggcaggctagctaattgggcctagagaccggccagtgtcgtggctgtgatcagaacctttcaaaactcgaacacatgcattcagcattcggaatgttcatcgcatgaattcttacgcggtggtccaaataatcagctcgatctatttcgggcaaacaaagctacagagacttgcttgcagcttaattacttaattccaaataaaaactggccacaccatcaaagattattatttttagtgaaaatcagtccttgtccacctgcctcgttggagacttggaatggatcaaggatcgatcggtcgtcatcaccgagttccttttcttgaataataactacagatgcatatgcatgcatcgaatcaggacttgagaagtaaccaaatgattaggtccctgcttaataaaatagttaagagatgtggacagtataattcatttgttccgacgatatatgtatcgatcaaaatctagcgcgcgcccgtccagtggcgactggcgatgtatatatcctttgatcaattcattgatgcatagtgcaagtgtacgatgtgtgacctctgaattatttgacaacattgggttggtacgtgacaacttgttactaatatactagtatttgagtgttacacgttttgttttgttttgtaacttttgattgcttacgttttttctctcctttcccatttttcgtcttgttggcgacctcgtcacgagttgccgccaagtgagcacgagctttgccctgttgcagaccaggaccccgtcgtcgtgcgctctcgtattctcccgagcacgagcgcgcgcgcagcttggggacacgccacgcccacgcgtgaactagccatctatataacgcaaacgattcgctgcatgcttcgtactcatcatccaccacaacatctcctccaatcagcagcagcagcagcagagctgatcaccatcacttcggagcttgtcagcacaaggctaattattaagctagggctcgatcgatctgatcgtgatctgatctgatctgaccatcagcagccatgtcgtttaggtgtaagggcggcgtcgcttgggttgctctgctcgtcgctgtcgcggctctcgcctccgccgctcagggatttccaaatcccttcggtcacgaggagttcacggagagttactacgacgagacgtgccccaacgcgcagagcatcgtgcgctcggtcatggagcgccacgccgccgccaacccccgcacggcgccggccatcctccgcctcttcttccacgactgctttgtcaacgtaagtacaccaatctctccatcgtacgaggaggccaccattagaagcataacgaatgcatttgtctaacaatcatcggtgacatttgcagggttgtgatgcctccatccttctgaacgctacggactccatggagagcgagaaggatgccgagcccaacgccaccctcgccggcttcgacgtgatcgacggcatcaagtccgagctcgagcgcagctgcccggccaccgtctcctgcgccgatgttctcgcgctcgccgcccgcgacgccgtcgccatgctcggtgggcccagctggggcgtgctcctcggccgcaaggactccctcaccgccagcatagacatggccaaagaggatctcccgaacccgaaagacagcctggccgaactcatcaggatgttcaaggagcacgacctcgacgagcgtgacctcaccgcgctctccggtgcacacaccgtcggcatggcacatgactgcaagaactacgacgaccgcatctacagtcgcgtcggccagggcggcgacagcatcgacccatccttcgcggcgctgcgcaggcaggagtgcgagcagaagcacgacaaggccacggcaccgttcgacgagcggacgccagccaagtttgacaacgcctactacgtcgacctgctcgcgaggcgggggctcctcacctctgaccaggagctctacacccagggctgccagaccggcgacctggtgaagacgtacgccatgaacggcgacgtgttcttcgccgacttcacaagagcgatggtgaagatggggaacatacgcccaaagcattggtggactccggcggaggtcaggctcaagtgctcggtggccaacacacattattgatgctcatactgttgagtacaacacaattatgttgcactcatttataagtgtgatatttcctttcgatttaattgtgcattaaactgtaagatgtatttttcttttgtacctcaatttttttattcatttttttataatgtatgggagatcactttgccttgaatgttcaaccactcatgcacaatgcaacatcacatcaataaataatttttttaaagagtactcatttttaaataatgttttctttcaaattacttctgtattctatgagcggatcacatcaataaattctgtgtaattaaatctttttataacaagaccacacttgtagtaattagttttttagtttatttcttttaatgtgttttatttaaatgtttcagttgatatcttatgatatttcaatactagttaatttgtaaatgttgtatgatattattcgaattttatagtaagtattttataatgtttcaatatttaatgttttgaatatgatattaaaacttttcaacattatcatgtttttgcaaaatatggtatttttatatgttttttttgtatgttttgctcgttggcaattagtgtttcatatagttgttgttagtgctgcagttagtatctttgaatgttttatttttctcatacattttacattgtgagttgaaacgttttgacaaagggggaacaaatttccagtgaaacaacgttaattttttaatcaaagtataatcatgtgagatcgtgttataaatatttaattataaggaatacaatgatataattgaatcgtaaattagataattaattgaaccatttgattcacaggaagataatagaaaatttcattgaaatgcattcctatgaaggttatgggtaccgggaatctacatggcctacatatttgactacagaggttggatccatttaatatataatagagtaggactcggtcactatgttgtcttgtatccttaaacagggcataaagccccggctgaatactaccatttatatattaggaaactgaagtagtatccggctaacttttcctctctataaccttctccccaacatataaggtaggtagggggctccctcaagggcaaccagataaaaacctaatatcacatgattaatacaatctgacaaattcaatccaccaaactggataggagtagaggacaacctctcatcgagagggtctgaacctgtctaagcccttgtcttccacatccgtccacttttaggtcttatatccattcacttttaggtctcgtatacttcttgctgatataaaacatcgacaattcctatggtcaattgcataggaaaataagcaacatgttaaatctcttgtgaaacttccgtttgtgttatggttatggataaggcatatctcctaccctacaacttatagaatatacgagtatggtataccttcacgtacacgggttgtttccgtatgcgttgtaggaatctgtcacgaattatggaaaatatctctacggattaggtgatatacaaagtcctaatcggagaggatagagttaacatcaatctccatgccattgcttctgcttttaccttcgcaggaagatctggaggcaagttgtccaagaccgatcgcttgcaagcactgtaagtcttccatggtttcccatgaactggtccttaattgccatgggtgcgactagcaaaaccatgcacccacagcccaccattcagtcgaattttagttggataattacgacctatgaaacatggtcgggtgtctcgaacacgcagctcgtcatgatactaaaaggtctaacactataattatcccattatgtgagctagtggtaattaagcatggctaagcatatataattctagctagatcaacataagtatcacgagctagataaattatcacctagggttgataaaggacgggtaacaactaaacatagcacaagcaagcagataggttataccctgatcccatgtaattagcaaaacatgcatatttatttgcaaatggtaaatcatttataaatcgggatcaacatgctcaaggggaatgtgtgacttgccttgcatcttcacttcgatctggggaggggttcgcggcagaggggtggttgcagtggcgatctggggaagcaaagcggatgctggggtggtgctcggcacggtgatgtcgacgacagcctcagtgctgtgcggggtggttaggggtggtggcaaggtgcggatggacgcgacgggaggtggtggagctcgggttcatggtgaaggggtgattgcggtggtgattcggggaaataaaggggcggccgttgtgtggggaggggctgcggagctagtggtggcggcggcgcagagtggcgatgaccagggcggcagtggcgcgcagctggagtcggcggtagcggcggagagaggtggtgcgcgtggcggcggcgtttcggaggtggagagggagaatggagtatgggccggggtggagcttggcacagcgatgccgatggtggcagcggtggagtgcgggcgtagctagagcagtggtggcgggcggccagagggcgccggcaagcgacggcgatggggattggcacaggaagagtggtggaaggcgcggggagctcgggaaaactgggaaaatgggagagggtggtgcgaggagcatttttataggctcggggaggggagaacgtggccggacggggcggcaacgggcggcggcgtgggactctggtgatgtgggtgagtggatcggctcatcgccgattttctcggggagagtgggggatttgagtggaggagtggaggggatccgatccctctcggtttgggcgcgatggcgcgagcgggagggctggaatcggcggctatgtgggcggctcgggcggccatggcggttgctggcccgggctggaggttggggaagaagctgacatgtcaggtcccacatgtcggccagagggggagaagggaggggggttatgtgacctttggaggggaggggagcgagctgggccggcctgaatgagggaggagagaggagggaggccggcccgacagggaggaaggactgggccaagcccaaagggaggaggggaggggttttgtttggtttttctttttatttaaattgattaaacaaactttgtaactttaaaaatattacttcctgagctccgaaaattcgcgggaaatttcagagagtattttagggcataaagaatattataaaatattcccggccatgatttttaaaggaaatttttaatttcctctataattcacttgattaaattgctttaacttttaatataatttctagaaaatgcattatttaataatttttaatcccgaacgaaaatcggggtgttacagtgaggaggcagtggagctcagcccgggcgccgccgctgtcaccgctccagtgcctgctgccgccactccctcgtctctgcctctcgcaggccacaacaccatgcccgcgcctccgccacttgccgccgtctccgcccgccgtgctccggccctcaccgcccgccgcgtgagagagagaggagcggcaaggagggaggggacagagagaagggacacgtgagtcccacaatttctttttatgtgtcaatgacaaatgggccccacacatatttttttattctacatgccacctaaacacgacgtcaaccccacgtgtaagggagatccggtgaataccgccacatgggcgccacgtcatcaaaaccacctccaaaaccgtaaggggaattaaattgcaccggttttaagtgtttggggttgaaatatccggttttgtggtctaggatcacggattagatttcgatcacttttgagggtcacaaagtgaacttattccgaatatgaatccatgtacgaattcatcacagtaactgtgtgaccgtgatcagaacctttcaaaactcaaacacaggcattcagcattcggaatgttcatcgcatgaattcttacgcggtggtccaaataatcagctcgatctatttcggacaaagaaagctacagatacgtgcttgcagcttaatttattaatataattccaaataagaactcgcctcaccatcaaagattattattttttagtgaaaaccagtccttgtccacctgcctcgttggagacttggaatagatcaaggatcgatcggtcatcaccgcgcgagttccttttcttgaataataactacagatgatgcatgcatcgaatcagaacttgagaagtcaccaaatgattaggtccctgcttaacaaaataattaagagatgtggacagtataattcatatattccgacgatatatgtttcgatcaaaatctagcacgcgtccgtccagtggcgatgtcactaatataaaaaggcaaataggtgtcgccactatacgtgccgacacaccaaaaaccggcacctataatgccttttccacccatgcacccacccccacgcgctaaatattcaaaaccgacacctttatgttcaaataggtgctggtttttaaataaaaccgcacctaaaacttgtgttagtgaaaggtgccagttctagacccaaaaccagcacctttaatcttctccctcccacactagccgttggtgggccctatacataggtgctggtttttttttatgacaagacaaatgtgccggttctcgacaaaaaatcggcacctttatttcaatagtgctttttaagtctgatggtgggccctacacataggtgccg

SEQ ID NO: 13256 - DNA, 9371 bp, Oryza sativa
ggcacctattaggaccatataagtatcggttttgacctcaaaacatgttctagaaccggcaccgatgacaagtatcatcagtgccgtctctcgatcgtatgaggaggccaccattagaagaatcacgaatgcttaatttgtctaacaatcatcggtgacatgcattgcagggttgtgatgcctccatccttctgaacgctacggactccatggagagcgagaaggatgccgagcccaacgccaccctcgccggcttcgacgtgatcgacggcatcaagtccgagctcgagcgcagctgcccggccaccgtctcctgcgccgatgttctcgcgctcgccgcccgcgacgccgtcgcgatgctcagcgggcccagctggggcgtgctcctcggccgcaaggactccctcaccgccagcatagacatggccaacaaggatctcccgaacccgaaagacagcctggccgaactcatcaggatgttcgagaagaacggcctcgacgaacgcgacctcaccgcgctctccggtgcgcacaccgtcggcatggcacatgactgcaagaactacgacgaccgcatctacagccgcgtcggccagggcggcgacagcatcgacccatccttcgcggcgcaacgccggcaggaatgcgagcagaagcacggcaacgccactgcgccgttcgacgagcggacgccggccaagttcgacaacgcctactacatcgacttgcttgcgaggcgcgggctcctcacatccgaccaggagctctacacccaggggtgcgagaccggcgacctggtgaagacgtacgccatgaacggcgacgtgttcttcgccgacttcgtgagggccatggttaagatggggaacatacgcccaaagcattggtggactccggcggaggtcaggctcaagtgctcggtggccaacacccattattgatgcccatactattaagtacaacacaactattttggaatcatttgtaagtgtgaaattcctttcgatttaattgtacaacaaactgtaagctgtattattcttttgtacttcatctgtttattcatttttttatgatgtatgggagatcactttgccctggaagttcaatcactcgcatacatgcacaatgcccgctctaggtcgcccgctctgatactatgtcggatattatagggaagacatgaatactgtaaatatttgacaaatatacatgagtacatagagatcgaggagataaggaatgattacagatatggaagtaatccacacaaatcaatcatatcctaatataactctaactaccatatactctaacactgaccaccacaacacccgccacctgccgtcgcctactcgccaaaatccatcagctctttcttcattgccatcacttacttcattgcaactgattttatttttatttgctcacgatttaaaaggtatgataggatttggaatctatggttcatagaggtagaaggaggggatcgttctggcttgtggttaggtcgggacctagggccgggaggacataaacttaaccaagggcaaaacagtcttatcaagttgctttgtatttccattaaattaattatttttgtcctattaattgcatcagtttggacggcagtggcaaacagaagcacagaaaatcaacttcagttttaaatttgcagtttgtgtttttataatggctatttcgaattaggggttgaaagtagtggcatatttgcaattctccctaaaatataatatctggtcagccaaggagagaaagctatgcaaaatgtctatattgccctcctcttctaaagcctctataagtgatgaatatgttggtgcatctgtaggtgaggtacagcaggcttgaaaccatctataggtgcacctagacacatctgtcccattcatgtaaaaaatacaaagtatatggggcccactgtacaaaatacactggatgcaatctctcctcctccggagaaaattttggtgccatactgaatataaactccaggcactgcaactcggccacgctgaatgacgcttggacaaccgacctaccggacacatgcaagaagacgtttgttgcctcggctccaggtgcagcgcgatgacgaaacccgcggctcagctcgggtccacgcgctgacgcagtcgcgcgcgactcccatcttgatctcctcgctcaccgccgcccctctcgttcaattctgtgccgactgccatcttcggttgttgacggctgagtgatgcagtgccaacggcgtccacgccagcatggcgaagcgccagaaatgtcgcaagtgttgccgccgaccccacatgcatgatcgtcaccttcattgcccaagttttgtcaatttcatgtgtttctctctccattaaacacagaagtaataaaataatcgttgcggcgtctttcaacaaataaccaagctttttgggtgtcctatagctaattcacgttttagcggtgtctaccagcaaaggccacaaactttggatgtcatatagcaaattttgccattccgttgtatggtggctggaaaaaacttgtcaatagacaaacatttatcagcaatgttagtacaaaatacttcaattttctgcatgttctatcaaagttatgcaaattctggcaccatactcccctcgaccacaggggtgataacggcacatgcgacagctgtgcaggcgctgtcctgttgcctattgccctggtcacacactaggtttttatgcgttgcctcatatctaatacaaggcttacttggttggtgacaactacatcatgccgtatcccatcacggtcaatgtgctgcctctacctcgagcaacccttggggcccgagcttgtgggaaggtggcagccgcatatcaagctcagggcccaacctactctcgtaggaatgatgccgagctcaagatacctggccatatggatgacccagagttcaccggccccctgctaggtcgcgggcatatgatattgttctgtttctcctcaggtgcatcttagtcattttgcttagggcggattgctagttgtgtggtccaccaaatctgatggcgtgtccctaggcaccctgagcatccggtggtaggggtcttggtacccatttcactgatagtagtccctggcctcgaccccgggcaccggcacggagcaaatgggaccaaggtcaagatcctccttgttgatatgttaataacttcattgttaactgggtcgttccctcgctcacttgcaacctaggttgggtgctccacatgctcgggagcaggaggaagccccaaagccactaccagaaacaatattacctctgacggctaaaacccgtcaggaataaatgaaaaactgtcaggaaaataggtcctgacgtgtcaacgtcagaaaaataccgtcagaactagcttgtcggggaaaaaataatttgcctgacgtttgtccgtcaggaaaactattcctgacgtgagcgcacgtcaggattaattttcctgacgtgaattgcacagtcagtgatattcccccatcatagataggtttgatagtcaaagagatttttgtgacgggtagaaccgtcaggaaaattattcatccattttttttagtaatatacaatatacagggatgatccatatgtacacaatatctaatagtaaatatggtcattctgatattcatcacacagcacgtaaactgctcaaattcaatattgcattccaaaaatagaaaggtcaaatccatcatcatcatacatagttctagttcactatttcaacataacacacaagcatgaacttctgaagtttgcctggcctaagacacctaatagtaactttcagagtctcaccctccatctatatggttagaaccatatatacaaaatatccaaaagcattagcatatgccgcaactccacattggtatgtccaaaaaccttagtccatctcgcatgacatgtactgcaacagcatcaaggagaggcattcaaacaaccagtacaattgttgctggtgttgttactgccaccattgctggaagcaatatcacatccatcatttttgtggcagccattgcagtcaacttgctgtgagcttacatggggaagaatcagttccttgcaacgattcgaaaagtttatgattaattcatccaattctaattagtaacaaaaaagcatgcccatgcagcaactaaaataacaataatgcatagttatccaatccctgcagcaggtcttgagcttttattttctcaagtaacttatccggtaactcacatgattcttggatacatttggtcacacggctatggtcatcatcctaggtcaatgaacgttactaagtatatatatacatatatatgaggaaataagattaaagtacacaaggtagagagaacatacaaagcattttagggcccttttcctactggttgctgaactactacaagtgcaaggtcatttttcaaaccaggtttcatgacatagatgtagaacaaaattcgccttaccttccaaatcagctatctaaatatataattcaagaatgcaaaagcttaacttaggaaataagcaagcaagtacaaggtatgaaaattgttataccacatcgcgatatatattttctgttcttattagttggagcaacagtccaatcacttttggagcctctaatgcactgcattgagaaaataaaaaaaacgtatgtgaatgaaacagtgttattattataaaatgaaaataaagtgtttactaaagtgtttctggtagtgagcgtgcgatcccaggctaatgactgtggtccctagacatcggcagtgcctagagtgtaatagtctagaccgagcatcacatcctgtcgccgactcgccatagtctaagctggcctgaccttggggttcgcttgaggccccgggacttcggcaatggttggggcgcagtacacgttctggatacttgtcctctgtatacaagtctaagttgcctcaaggtcatacaacaaaattacacagcagttaaaatgtaacttttaagttatgtattaatacttttactttaaattaggaaatatatataatgtagtccaataatctacaatataagtactttatatatacttggagctctctagtactgttagaaatgtgtttaaaaaatatgacttatttggttaggagtctcgggtgatttgtttttaatgaagctacttattgttttaatctagttaattacttttatttgtctcatattgttcgtatattctaatgtgaagatatatattatgcatggttaaaaatctgtgtaattttctcttgaaattgtgtgaatgagcaataactagtcccgaggttgaatatgaatccatcaacgaacttctcacagcaactgtgtgattgatcagaacctttccaaacataaaaacatgcatcggattcatagcatcaattcttacgcggttgtccaaatagttaatcagctcgattgtctatttgcgacaagaaaagctacagagacgtcagcagcttcattaattaataccagttactaataaactataatcaattaatcagaaaatcagtccttgtccatcttccccattggagacttggaatggatcaaggatccatgggtcatcaagttatttttcttgaatattaccccctccatccaataatacgaggcgcgcacgtatattaagattcaacctttgaaatgtttgaccaacatacactttgtataatatgaaataaatttactccatccatcccaaaatgtaagtatttttagctatgaatttggacaactgtgtgcagggtcggtcctgggtttttaggccccagggcgaaaacttatatggaggcccccatatatatacataaactaatatatatatttatagtcttataaacacaccacttaatattcgatgtgataaaattatctatatatatttagagtcttcagctgtggctgtgcctgtgcgagaggcaagagctctcaacctagcaggtagcgttgcgtctgcactctgcagcagtagctatgctgtgcagcgatcagcggcatcggccagcggcgtgatgccgtgatccagcctccaggcgagtaggcgacgcaggcagcaggtcggcaggtggcgtgatcgagggccgaggcgatgggaatcgggaacgggagttagatagatcgcttcgacttcgacgcttcgattttccttcgctcggtcgctcctcttcgtgttccgtcttcacacgatacaggcctgcgaagtagcatacatgggggtgccgtgggccatgggccatgggccatgggggcccctggattttgggggcctcgagcgcgcgcacgggctgacaccccctaggggcggccctgactgtgtccagattcatagccaaaagttgttaattatattttaggatggatgtagtatttgttaaaattatatcattagattgagatttaaatttattttcatatggttatcattttgttgctacaaaccttataatgtatgagaaattataagctaaaaattagttttggagaccataccaactttaaccattcattatattatggggtagagggagtaacagatgcatgcatgcaggcatcgaatcaataattgagaagtcaccaattgattaggttcgtgctaaatagaataatgaagacatgtgaacagtagtttatacatatgttaatccgaccatgcaataatgatcaaagtctagcccgtccagcagcgatgaatatatcctttgatcaattcatttgctgcaaccctgcaagtgtacgatgtgaccactacccgtagagagacacgttttgttttggttcgtttccttacttttcttttctctatactttcccatttttttctcttgttggtgacctcgtcacgagttgccgcacgagctttgctgggtcttgcgcttgcagagaccagggaccccgtcgtgcgcacgttcgccacgcgttaactggccatctatataacgcatgcttcctactcatcatcatccaccacaacatctgcaatcagcagcagccagcagcagcagagctcaccatcacttcggagtttgtcagtaccaaggcgaagctaatcattaagctaggggcctagggctcgatcgatctctcgtttcggagctttgtcgatcgtgatcgatctctcgaggccggagggagaccatcagccatggcgtttaggtgtaagggcggcgtcgcttgggttgctctgctcgtcgctgtcgcggctctcgcctccgccgctcagggatttccaaatcccttcggtcacgaggagttcacggagagttactacgacgagacgtgccccaacgcgcagagcatcgtgcgctcggtcatggagcgccacgccgccgccaacccccgcacggcgccggccatcctccgcctcttcttccacgactgcttcgtcaacgtaagtacaccacaatctctcgatcgtacgaggaggccaccattagagcatcacgaaatgcatttgtctaacaatcatcggtgacatttgcagggttgtgatgcctccatccttctgaacgctacggactccatggagagcgagaaggacgccaagcccaacgcctccgtcgtcgggtacgacgtgatcgaagacatcaagtcggaactcgagcgcagctgcccggccaccgtctcctgcgctgatgttctcgcgctcgccgcccgcgacgccgtcgccatgctcggcgggcccagctggggcgtgctcctcggccgcaaggactccctcgccgcccgcatggacatggccaacaaggatctcccgagaccgacagacagcctagccgagctcatcaggatgttcaaggagaacaacctcgacgagcgcgacctcaccgcgctctccggcgcgcacaccgtcggcaggacgcacagctgcgagcactacgaggaacgcatctacagcctcgttggccagggcggcgacagcatcgacccctcattcgcggcgcaacgcaggcaggagtgcgagcagaagcacggcaacgccacggcgccgttcgatgagcggacgccagccaagttcgacaacgcctactacgtcgacttgcttgcgaggcgcgggctcctcacatccgaccaggagctctacacccaggggtgcgagaccggcgacctggtgaagacgtacgccatgaacggcgatgtgttcttcgccgacttcgcgagggccatggttaagatggggaacatacggccgaagcattggtggactccgacggaggtcaggctcaagtgctcggtggccaacacccattattgatgctcctcttgttaattatactgtcgagtacaacacaaatatgttggatactcatttgtaagtgtgaaattcctttcgatttgattgtgcaataaactgtaagctgtattattcttttatacttcatttgtttattcatttctataatgtatgggagattaccactactacaaatcacctaatagattatggctcgtacgtaccggtcttactgtctcccaccttgcatgaggaaaaatctacataaaaaccggcacctatgaggagtttgaaatcaacactgatgaggctttctgcagtaatgtactttgccccaaaagtcctgtcactctcactctaatgcatgcatcttgcagcatcacccataacatgcaaacatacctccctcttaatataatttttaaatacttatttcttgcaaattacttttttattcaatgatccgattacaccattaaatttgttgtgatcaaatctttataaaggaaacacacatagcacatggttatattccgatgaaaaaatatttagctttttaaaattttatttgttttaaacattgcgtgtggttttatttaaatgtttcagctagtattttatgctatttcactactagttaatttgtaaatgttacatggtgttatttgaatgttttagtgagtattttataatgtttcaatatttacaacttaatgtttcggacataatataaaaatgtttcaacatcatcaagtttctgcaaatacatgttaacttttaattatatgattttttttctatgtttcactcgttagtaatcaatgtttcttatagttgttatcagtgttgcagttagtattgttgaatattatatgtttctaaaatatatttaatattatattgcaagaattatacactggagtgaaggataaatgcggcggcatgcaaaaccgatgaatcacgtgagagcacacactacactggccaaggtcacctgtcacggacccaaaccatcatctttgacggcttcacgcatggtcagtgatcagtggtcactggtgagtc

SEQ ID NO: 13257 - DNA, 5667 bp, Oryza sativa
  unsure (1)..(5667): unsure at all n locations
gatacatcacagatatattccagtcacccccaatataacatcacagatccatctcaaaaatcacagatccccaacaacacagagatgcagttcaaatgccacaattttgcacagcaaattcacaccccttgaaagccacaatttcggtcgttgctcatagaaccgcatatatacttaccaaatggattaaagccataatgtcctcgacctccacaacctgtcaataaggaaaaaaaaaggagaaaacagatgaatagtacaacgtaaaatcgtagttgatcaaatttgatgacaatttagtaaactaccataaatattgcatatatgaaagtaaattatattgcactccataaaaacatatttttttacatcacaagaaattataaaaacatcttttttacatcacaataaattatctagccaagttcatgagtctatttgacatgaaaacatccttttttgttcattatttctgcaagaatgaaggcgcacacttcgcctctgatagcggggggttgatgggtgagatcttgaagccagctctgcctttctgtttaataaataagtggttaattagcacgttttgaatagcaatgttggtattgaaatgagcttattcgctattagcaacaacctcagggtcgaaatctttcacctctcttagaagtgttgacatgttgtggtacacgtggaaaaccacattggtctccgatctgttgtgcacatgcaaacttggtgtcatgataaagttcgtccttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcattattactaagaaccttaacttcaaaaacagtatacacgaagagtattgtcctcttactcttggttgtgtgcgcacatgatgtactccttgtcttgatgggcccataaacaccggttgacatagtgaatcacctcagtgaagctctgtcgtaaattaacctcgttcaccatggatggatcaaggaacccaacctgattaccaaggtgacgactctcgatccaacacaaccttaaaacatttatgtattagaactaatttaattaggagatatagtccaatcatatcacaagtatagaaggtatgcacatacaaggagtagcattttagaagaccagtgtccaacttccggatcctgaaaaggtcgaagaggtcatcaaagcctatagttatataggcaagcgacgataggaatggctggtggtcgtgatgtccaactatggatgactccctcattttccgcttggcattgcttagctccatgtattgcttatgtagctctcggcaagcaatacccatcacggctaacacattgtcctccaccaatggcatgcctagctcaaattgggctggcgccctcacgaccttccccgctttgctcactggcatcgacgtcgcagccttgcccctttttggctccggtgccaactccccgaccttccccttgccacgttcacgcttctggcccttgacaagtggtggggagctatcggcctttcttgtggtctttattggagccaagctttgagctatatctgcaaagtccatatcagctccaccaggagattgaggtactgacaatgccagtctatggggagcctcaattgatagcttagacttgggaggtgtaagctctgtcggtcgacttggacgaggagtcatcttcacaactatgtcttctttgggccattgtatgaacgtcttgcacgcatcgcccaaagtcatgatttcatcattggggggcacgggcagcggatagcctgaccaggtgtcctttactgtatcgatggacaccttggtatacccagctagcaggtctgcgccgtggaccttgtctgtaaccgagggcttgaaatccatgccctcagcgacttcaggagcgaaagttgggtggactctcgctagtaggacacactatgctgcgccttgcatatgtgaaagtttgaatttaatattggaacgtgtaaaggttttttattagatatggatcggataacatcaattacctcgatgtggtccactgcagctagtggtgcgaccgggagaccaggggccggcacctctgtggatgaacaactactcctatgctgtgacggactcgcgtcgtgttgtgcacgaggagttggatgcacagcaggtgttgttcctcggggtatattcatgtcggcgaggaccttgttaaccctttcttccacccttgcattcatgctagcttctagttcttgaatgacctcaaccttaagttcggccttcaaacgagcgtccctctcttcctcggagactttccgtttcctgtattgggagctgtactgcgggagtccatgcttccagggcacatcgctaccaattccccgagtccggccaggatgttctttggttccgagcgcctttgtgaggatgtcatcttcgcgcctcttcggcgcggactcaacctcgctttgtgaagcttgttcagcaaccaagcccaactagaaaaaaaagagtcgtttatacgaacttatactttatacgaacggaaattagataggttaagtagtgcactcaccagttcctgatagacgacggcatcacttttgttctcaaatgtgacagagccgtccgggttgaccttaccccttgcccgcgcgcagttgcgagctctttgttcagggatgtctgaaaacggggcagggacattcgctactgcagcggctgcatcttcttgggcccatattgcctccttgccgatgtaccctgcggtgcccagccgatgcgggtgctcattccgctattgcagtaggcgatgtgcctcgcttgattccctaaagtcttgggtgttcttgagagagcagaattcctcccacaccgctttggttatttgagggtactcatcgaacgacgtatgattgccggacgggttgacaaactcggtgaagagcttcgacttccaattcttccaagctttgcccatcttatggaatgccttccgcttgagcctatcttttgcttcagccggaaatgtgaaccatttctccattgttgtccaagcttgctctttctcggcttctgtgaccttcccggtatctttatggaggatcccgaagttctcacgtgccgctagcccgtagcagttagaccatcttccaatgacagtcctgggcgccatgggcctaccactagcgtcaacctgtcttataacttgcactgtggtcggccatatattttgtgaccggggatttctactagacctacttgcacttgtcccacccgacatcgacgtatgttgttcctgcggcaattctgcagcacaaacagaaggcaacatatgctaaggggtgctagccaaaatttatgtggtcatgtggtgaaaatttatcctataaattaccatgaatttcgggttgttcgaccgctgttgtcgagggatgaccttcggcaactgtctccgtggctgggtttgcttcttcctggatcctcgcaggtgttggggagggcgggtttgcgccgggcgttgtcatggtctaatttttgcgaaaaagcttatgaatttcctaccattatactaaatagcattagatcgaatgtaatacggggtatactataaaacatatggcctcagttttgctcagaaattatgcatcaattaccatcatttgcatgaagggaaaaaaagaggaaatcagctactaggagggaaaggcaaccataggcagcagcatgggaaaacatagacatcaaggcatcaaaaaatgaataaggggcataggggcagcgggggtagcagcagcaacaacaattcatcaaaaaagaacatgtgtacataaaaaaaagaacaagtgtagataatctgttcttatgcattaaaaaaagatcaagtttagataatctatgcacaaaaaaatgaataaggggcacaggggcagcaggggtagcagcagcaacaacaattcatcaaaaaagaacaagtgtacataaaaaaaagaacaagtgtagataatctgttcttatgcattaaaaaaagatcaagtttagaggtatttctgttcttgagcattcatcactggctatttaacataaggcaaccataggcagcagcatgggcaaacatagtcaacaaggcatcaaaaaaaattatcatacacatggcaattcattttataaaaatcatcaaaattcatcaaaatcaggcaatcaggggcaattcttatgcataaaaaaagaacaagtgtagataatctgttcttatgcattaaaaaaagatcaagtttagaggtatttctgttcttgagcattcatcactggccatttaacatagggcaaccataggcagcagcatgggcaaacatagatagcaaggggcaagtgtagataataaaacagcccacaataatttatgtggcagcagcagcaggggtatataaatcatgtatgtaaacaacaattcatgcaattcaactattcatagacaacaagggtatataaattaacaagtgtagataatctgttcttatccataaagaaaagaacatccactgcagcaaaattcatgctaagatcctctattgatgctaagattcactgcaccaaaatcatgtatataaaatctagcccctacattcatccaaaacatccgcagacaactaatcacatttaattcatctatacagcagcaccaacaatcgaaacaacaaatcacatttcattcatctaaacaatgccattcatccatcgaaaaaaggaggaatgggggagggtggcggcgtacttggagaagcggcgtacttggagacggcggcgcaggccgtagtcgtcctgaatcccagtggcggcggcggagaggcancancgaagaggtcgaggcggtcggcggtgctggccggtttcgtcaattcaggcgtcggggaggtcggggaagtagatggcggcggagagggcggcggtgcaaaggtcgaggcggcagtggtggtggagatggtgatggagagggcggcggtggtcagggatcccagcgtcgtggatcccggtgtcggggaggtcagggtcggggaggtcggggaagtcgatggacggacggcgagagtacgagcggcggtgagggtggcggtggagaggttgaggcggcggtggagagggcggcggagagggcggagatggcggtagaaaggtcggcggagatggcggcggagagggcggcggagaggtcgaggcggcgacggtggagatggcggtggagaggacggcggcggtcgagagagtgagtgaggaggcggcagtggagagggaggcggcgagggcggcggagtggacggagatggcgacagagagggcggccgagatggcggaggagagggtggcggcgatggtggatatggcggcggagaggacagcggcggtcgagagagtgagtgaggcggcggcggtcgagagagtgattgagtgagagtgagagcggtgccggatctggatctctctagaagatgtccaaccctaggtcacccctagtcagactcacctgtgacgggcgccaactatgg

SEQ ID NO: 13258 - DNA, 1218 bp, Oryza sativa
cactagcagcctcgatgcgtaacccactgttctgcactgtgcatttgctgtcttgctttaccgtgtgaaaggtatatccatttatgtcatatccttgccaggtggtggcactccatttaggaccctgtgacaacgactgaagtgtttcactagacatgttctgcaacctggcaattcggttcttcagccactcgttgaaagaagacatgtgcttatttctgacccaactctctgatcggcctaggttctcttgtcggataactgcaaggtgttcgtcaacgtacggcaccacctcagtcatctgctgtagtaccttgaaatgagctttatcgtacaccttccgatccaacctaatagtctttcttccaacagtaccaacaccaccaagcctcccttcgtgatgagatcgtggtaatccaattgaagatgtttctgacatgtagtccacacaaaaattgatgacctctttggtggtgtaactctcgatgatactcccctcggggtttgaacggttccgtacataacccttaaggatccccaggtacctttcgcaaggatacatctgcgtcatgaatgctggaccacagcactttgtttgcctcacaagatgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggattgtgtgtcgcaccttaggaggcaaaatattccttattgcaacgggcaacagctgtgtgataagaacgtgacaatcatgcgacttcattcctaccaacttaagatcttgcagtgaaacgagcctactgattcttgatgagtaaccagatggaacatttataccactcaaacatgttagcaaatcaatcttctcttctttcgagagagtgtagcaggctggaggaaggtaaaccctgccggatttcgtggttatgggatgtagctccgagcgaacacccatttcttccagatctcgtcgggcgttgagaccatcctttgtagtacctgggttaagcagtaatcccattaaactctcgcatacattcttctcaacatgtatcaaatctatgcagtggcgaacttcaagatccttccagtatggtagtctccaaaatattgacttctttttccaca

SEQ ID NO: 13259 - DNA, 640 bp, Oryza sativa
attcctgcagcccagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacccctagaagaggaggaagaagaagatgaagttcaatatgcacgcgtcgaccatgaggaaggattatttttgtaatttatgtacatagtttatgtctacatgctgttatctgtatgattctaatatgttcgcaatgatcgacagtatattgcttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatg

SEQ ID NO: 13260 - DNA, 2299 bp, Oryza sativa
aaagaaaagtcagtatatgcaaagtttagagaatattactgtatgtaaaaaatcagcatatacctctctatgtaaaagtgcaatatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaaatactggtgcgtatcaaagttcagtctatgaatcactgtggaaagattcagtatagatgtggaaaatgcagtatatgctatcgtccaacaaagtagagaataaagctccccacataaaaattcagtatatactattgcctaacagagagttcagtaagaaccctgccacaccaaaaatcaatacttaataccgtctagcagattccaaaaagtttccctccaaagaaaaaatgagtatataccgttgaaaattcagtacgtactaccatctacatttttctttatgggggtgggggctaaaacagcattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctatggcccatcgattttgccattgttgccccgctcctgcattcagccgactctagatcgattacttctgcttcaggaacacatgctgttgagagaggatccatcgctggaggaaggggaggagtcatcactggaggaaggaacgaactgctatctctgtaccgccgccagccacacagtcgccgctgaatcgctggtccgtcgccgcgccgccccccaaaaccccaattttcgggataatctgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcctatatatatatatatatatctcataatccatatgattgttatgtaaggtcgttttatgtaatcggaatactatctaaataatgaaaagaaatactgtaattaataacttccagtctctacaattgtcggaggggttgcaaatcttatgtgatttttctagtggtcaagcctacataaataattgtagtgtgtaatcgattgtggtgggacatgcacaaccaagctagaaaagcaaataataattcgtgcgtacgtgcacatgttgatcgggatatgcatgctacggtgtgagatacacgtacgtgctgatgactcctgctaggtaataatagtaatgtaaaaatactccatgcataggacactggagctagcgagtgctattttttttaaaaaaaaataacaatcatttgactattcctttttctagaaaaaaaatatttgtgtaaatagagagatcaggcatgcttaaaatacttttgatgacatatttggtagttctcttaattaattaagtaattgaataaactgttggtcaaagtatataaaaacagagcttatatatattagcaattagctaacattaatacccaggctggacaaaatatccagtttggaacaataactaatcaagtgtaggccacgacgggtatttatcatatatatttagtggaaagtgagtatctataagttgcaaaagaaaaaatattaaatgtggacagcttactgagatagctagcaacatcaatctcacctatctaattaatatgcacttttgagatatatattacatcaatcgactaaatcatttcccgtagattgtactagctactaatggattggtagtggatactgaccactgaagtaatacatactctacttagatataatgttgttgtgtatcatggtataaatgatccagtgtatgcatggtaatcggtcgagactatctagataatacatccgtcgataattttttaaaaaatattatcagctgctttatag

SEQ ID NO: 13261 - DNA, 19508 bp, Oryza sativa
taaagctggtaggcagagacttggttattgtgccctacattgtcataattccagattagttgatcgatcatatataagtactaaaatgtagttagtctatcacaatagagaccaccgacctcaaactcagccaaagtcttcaccttttctctatacagaaggcgcatgttgtggcacacatagaatccgcactggtcacctatttgttgcttaaccgggaagtcttttttgtggataagggtgtcatgtcctgtcttcctgaggcctcctctttgcacgtattgggcccacgcttcatatatcgctagttgaattggggtcaaatcatatgcgttcttatcaattctggtccacttaggtgttatgaccagaaggatccaatgggcaccgcggcattaacatagtgaaagttaattaagtactgaaggaatgtgtcatgctgttgtgtatatttagataacacacttactgttgattataggcgcacataatgtactccttgtctcggcgggaccacaaggtgttgtagatgtaattgaccatttcttgatggtcattctggagatttgtgacagtgaccacttgtggatcaaggaaggcaatttccggtgcatgcttctgacaccattgccaacttaacctacacacaggataaacgatcttttaagtgagttaaaccgattgttattactagattgagttgggcgacaatacttacaaggagtagcacttaaggaggcttgtgtccatcgctcggagcctgtagagatcgaaaagatccttgaagtcgaccacgatataatttgttggaccaaggaatggctttccatcatgctctccaaggatatcggtagctttattcggcttcctggcgttagatttctccatgtagtataagtgaaagtccttgcaagcggtgcccattgcggcaagcacgtcatctccaaccaatggcatgcctagttggaactcctgtggagcgacgtatttctttttgacctctttgcccttagtctcttcctggaccttgcccagatctagcttccttggagctagaagcgaggcatgcacctttcctccccttcctctcccctttgcttcgggtttatcgagagtaattctctgaggggaagagtgtgctttcctactcttcttcatcggtgggggttcatgaatcgccttgctgtcggcctccgttcggtcctccccaaaatccgtgtcgtactgcaactacacatcgtaagattgtgcatgacgatcttgagcaggaggggctgaaggagcaaaggcgggtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaacagctcgtattcaggcttcaccgagtcgacttgaacttttgcacagtcggccctgagttgcactccatgcacttttgtctctggggtcggcttgtacgcaagtccctcggctgctggaaccatgaaggtcggcatcaccctaactgtgagggtgcagctcattggttcctgcgatagattaatcaatttttttagaatattatatatcatatggattcgttaagtctttcatgtattgagtaagttcacttttaccgttatgtggttgacggcgccgtcgaccgatgttggattttccgccaactcagttgatgcgcaactgctgcgtttttgggtgggacttcctaactcttcgtgcgcagcagcagcggcggcctgggggttctgttgctcttctcggatctcttgcctaatcttggccctcatcgactcgagcttttcatcgaattcagatgtcaactcagctcttatcgacgcccggatcttggcttcaaggcgtgcatctttctccgccttgttggaagtccgcttcttgtactgccacgcgtagtctggaaatccatacttccagggaacagaagacccaacgccccgtgtccgtccacggtgttccttattgcccaacgctttcgtgaggaggtcatcctcgcgtctttgagagcaggcctcttgcgaggcttgttgctcggcaaccaactccttctgcattacaatttagtggggttaaataaactgcacgatgggaaacaatgcaaacatacacgagcggcgtgttcgattcctccgcttcttcatcctcacgctgccattcgtcttccttaccagcatatccggcggtgccaagccggtgcggatgctggttcctggtctggagcaagcgatatgcctcgcttctagctctggactcgggggtcgacttcttcgcatggaattcctcccagatctgttctgtgatccaaggaaattactctcttggatctggattcgccgggttgtagacgaactcgccgactagcttagtcttgaagttcttccaagcattgcccataaccttgaaagcagcctgcctgagacggtcctcatgctccgcaggataatcgaagctctccttgaacgttagccaagcaatgtccttctctgtggccggcacgagcttgatgtcatcttgcagaattctaaatttctgcctccctatgaccccgcagatagaccttaatcggctcaatattttccttggagatgccagcaaccctacggcgcccaccgctgttatgcggaaccgttccttagggattttgttccctgtcctaggagtacgtgcccttgaggacccactagttgtcgtcgacattagttctccttgctgagacatcgtctacttttcttcaaaataacaaaaaaacacaattgagtgttacaatctattaaccacatttcacaataatttcagtaatgcacaacatttcatcccaacatgaataaaccacatttcatcccaacatgaaccacattgcatataaataaagttaaatgaaccacatttcatcaatcactacaatcatctatcacaaaattcataaatgcaccacatttcatcccaacatcgacatgtctcactcatagttcaatcacatatcatctacatccacatttcaatgacatgtcattcacagttagcagagggcggcacgatggaggactcacctgaggatgaccggtggggctcggtggagggcgtcgccggtcagtggaggcagcgccgggctcgatggaggcagcggtctcggtggcggcggcggcgggctcggcgaaggaggagttcgcggcggcggcgctgggctcggtggagggcggcgccggtcgggcaggtcggcgccgggcgggcggcgttgggctcggtgggcgtcggcgacgtgtgtcggtgaggacgcgggcggcgacgacgaggaaggccgacaccggtccggtcggtgtagaggctcggtggcggtggcggcgggctcgggggggtcgtcggtgaggaggcggcggaggtccaaatggagggccgaggaggctcggtggtggcggccgcgggctcagcgagggaggcggcggcctcggcctcggcctcggcgtcggtggtgacagcggcagactcagtgagggaggacgacggcggcggcggtgggctcggtggcaacggcggcgggcttggcgagggaggacgacggtggcgctagggttctaaggagacgggaaactgtagcgggacttagaaaaattttcgatccgatctgagaaaccctagttatagtagagtgatgagtcatctcaatcgggctttaccgtagggcccgtcacagatgactcatcggtgacgggctccatactaatgcccgattgaaatgacattcaggcccgtcacggatgagtcatctgtgacgggccctaagataatgcccgatagagatagattaatctctatcaggctttaactaaggcccgccaccgatgactatttttccatttttccaaacaagtctttatatttgtgagtacaaaatatatagctgatgtataataattcattttattagtcataatacattttcggatagtaaatgatttcaaatcgaaatatggtcaacaacaaaattgtagagcctttcaagatctacaacttttattttggtcatttttctatataattttttcccaacagcttgaaattgattttgacaatatgacaaatctaattaacagcatttgtaaatactaaatgatttcaaattgaaatatggtcaccaacaaagttgatcctctcatcaggatctacaacttttattttggacatttgtaataaaacaaaattagccatattaatgactacacatatcaagtctttgcaataaaacaaaatacttcattcattacaatagataagtacaaatgcatcggtcacaaggttatgccttccgtatgatctgaatgagcatatgccacaggctcttggggatcatcgtcaaggtcaatgtgaggtcttacatgaatattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatatactaaagtgaaaccttccttgtcggctttgacaccagtgcgtagattcacccaacggcagcggaacaaaggaaccttgaacttgacgtagtttagctcccatatctcctcaatgcggccgtagtatgtgtttgatccaacttgattctggaatgcatctatacggacgctactgttttgcactgtgcttttgtcatcttgtttgacggtgtaaaatgtgtatccatttatatcgtatccttgccatgtgtgtacggtccaagacggtcccatccccaacaactgtactgtctcatttgggacatctgtggacattgtcacacgattcttgaaccattcgttgaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttatgaacgtacgacttcagaactcccatgtacctttcaaacgaccacatttcccttagaaaagccgggccacatagttttgtttgcttcaccagatgaacaaggagatgaaccattatatcaaagaaagacagtgggaaaaacatctccaggtgacagagggtattcacaatataggtctgcaacccatctagatcttctggatctataaccttctatccaattgcattgaagaaggcgcacagacgttagatcgtgtgacgcattttcggtggtagaatgcctctgatagcaactagcaagatttgtgtgattagcacgtggcaatcgtgagacttcattccaacaagttttagaaggtccaatttaacatacttacttatcctcgctgaatagcccgatggaactttaatatccttcaagcatgttaacattgcgatcttctcatccttcgacaatgtatggcaggctggagggaggtacactctacctgtctctgcatctcgtatgggctggagttcactgcgaatattcatgtcatgtagatcaaggcgcgcgttcaacccgtcctttgtcttcccgggaatattcaacatcaggccaaccaaactctcacacacattcttttctacatgcatgagatcaatgcaatgatggacatcaagatctttctagtaaggtagccgacaaaatatggattttttcttccacatacccttctcctttgtcttgctacgttttcttttcttcccaaactcattgcttatgtccttgaccatattgtggacctcatcttcggacaaatctttgggagcaggctgaagttctctcttaccgttaaaaattttcttctttcttctaaatgcgtgacgtagcgggagccacctccgatgacccatgtataccatctttcgtgatttcttcagccaccgacttcgtgtatgttccttgcaatcggagcatgccttctttccttttatagtttgtctggaaagattaccaagtgcagggtagtcattaatggtgcagtacaatagaactcttagcttgaagttctcctgaccatatgcatcccacgtttccaaaccttctttccaaagaatctccagatcatcgataacaggctccaggaatacatcgatatcattgtcgggttgcctcggaccttggattaacaagcacaacataatatatttccgtttaaagcataaccatggcgggaggttatagttcgcaataagaattggccaagttctgtgagtactactcatgtcaccgaaaggattcatgccatccgtacacagacatatcctcatgtttctagggtcggcagcaaagtctttgtgttttcgatcgatattcctccattcaatcgaatctgctgggtgtctaagcataccgtcattccttctcttcgtggcgtgccaacgtactaacttggcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagtatccaagtccgcatattgcttgtggtacaatatgcagtcgtttggacaagcgtaaattctacggacctctaaccccagtggacacataacctgctttgcttcgtatgtcgtctcgggcaatgtgttctcagcaagaagcatagccttcaaaattcctaaaagacctgtgaaactcttgtctgtccatccactactttccttcagcttcattaggtccaaggtaactgacaacttagtgtgttttgctttgcatccagcgtacagaggcgtctcggaatcacagaccaacctgctgaacttcattccatctctctcattctgggctaggtcctcaacgtcatgtaacatgtcttgcagcagatcgtgatacacatcaatggagaaggtacaaacatgtcatgctcatcttcatcttcctgattatgcgcaccacttctgtctgctactgctccacttcctgattcttgctctccatgcttcacccaacatgtatagccctccatgaatcctcgttgtatcagatgaccatgtacgtcctctccgctatcaaacatattctcattcttgcaatctgcacatggacaacacatgtaatcactgtttcctcttttccgatcctcctccgcggcgttcataaaatttattacgccctttctgtactccgtagaatgacgtttcaaatttttcgcatacatccaacttcgatcaattgctacaaaataaaaaaaaacaaattagaggcacatattataagatcagtattgcaaaagtaagacgtgatgaaattgctcaattaatgaataatattactcacttgattgatccattttgatcacttttgggaatttaatttctattttccttggaaaaaggacaaaaaaatcgccctctacagcctcccaccaaaatagtgaacagtgggatacatttacactaggtggtggtgggtatttatactgtgcaacaaatatctgtaacggccctaaaacaatcaaccgtgacgggcatacaagtaatctctatcgggccttaataaaagcccgtcaaaaaagagtgtcatctgtgacgggcattaaacttatctcaatcgggcctctagttggagcccgtcacagatgaccctcatctgtgacggacttcttttagggcccgattgagatatggaaccctcatgtcaatcgggcctcaactatagcccgtcacagataagtgtcatccgtgacgggctttagttttatgccgatataccatggttatgcgaccatatctcaatcgggcgaaacttcggcccgattgagattacttccttgtgacggcccgcaaattccagttttgttatgggccgtcacagatggaaggatctgtactagtgcgagggccttgtcaatagggagggagaaggatcacgctccaggcaaccgctatggcacccaatttctaggtagctgcgagacggtagggaggaggatcacgctgtcgtcgccgtcaaagaaagaggctgagagggagagcgcgagggaggggtttacttggaaagtagtgtcctagagtgtgagacgtctactttaataatattttttaagttggcctacgggctgaagggctcctgtcattggtgccatttttctccttaaccggcattaatgtttggcccatcagtgccggtaggtttttaaataaacctgcactacttgcaaactagtgctaataaattagttcatcagtgttgggtttttaaataaactgacactgatcacattagtgcctactggtttttcttccgatcgatactgtcgtaatcagtaccggttatttgtccttcagatcatgcatgggttccaggaggagggggcagaatccttaccagtgtcaggtttaatccaaccaacacttgatagaggtggcattgataggctgtactttagtagtgaaatttctactaaaattttgatgtgaattttaactgaaatgctcaatgattagaggcatgcggagtaacatagatgtatactttatattggaactagctgcgtggcccgcgcaattgcacggctagcactcatataaaattatctattatttaatatgaatttactaaaaaattgttaaatagctatcttgttgtatcaagactttgaaaggttaaaccttatcatccacgtgtttctaattttatagtttttaaaagccatgctagttgctaccccttatttcttaggcacccctcgatgtaccacttcttctattcattctccttagaatgtttaaaaattagaccttgtagtttttaaaatttattgtctaatcggatttcatttttataatttttagatgtctcatccactgtctcctctttttattgtcattgtgattttcaaaatcaaacaaaactattgttcgggttcaattttttactttctagaagtcccaccaaaccgccagcggctttgcccccttacttctctacaacctacccgctgcctcctctcttcgttgtcattgggattttaaaaatcaaatgtaattatgattggggttcatgtttttactgtctagaagtccaatcaaaccgtcgtcggctccgtcactgtactcctctacgacttgcccgctgcctcccttctttattgtcatttagattttaaaaatcgaacataattatcattgaggtttactcttttacttttcagaagtctcaccaactgccgtaacaatgctatttaacgacccgcccgctgtccctcatcttaatcgtcgttggattctatttgagattttgtttatagtttttagatgacccatcaaccgtcaccgctctacttgtttacggacatgttgttttcccctttttattatcatttatcgtcattgtattctagatggatttgtttttttaaaaaaattcaatatttttcattccgatgttttgttatttataaattgtattcgtacttgaactcttataattattttatattttacgaatttattttatttttattttgaattttaatttatctcgtgatgggttttagatgatcttctctttcaatagctagtttttatgttttatttcgaaattgggttatttataaattatattctaattaaaatcttattttaatttttctattaatctcatattgtgttatatatgaattactgttttaatattccttatttttattcccagttttagtagtttgtaaaaattattcttaatttaactcttatttctgattttctaattttggaattaattttatttttgtacatattttaattaatctttaattgtgttctacatggactcttctttcaattttttatttttatttcgattttcaattatttctaaaatatatttccactcgaactcttttttttcttcaattaatgtggaaatttctagccttcatagtgaacatggtgactcttttaatttttttatgttttattttaattatttataaattatatttctaattaaaatatcatatttcttttttctctgattagtgattaatgtgagaatttctagcctcttgagtgaatgttggccattacaatattaggtcccacgttgatcagacaatatatatttcttttttttaaggcatgtggcgttatatatatgcctcattgttaatcacccgttaattgatagaatgatttcactaatagtatataacctttttaacatagtaatatatgacttatatgcgtaaagatgttctaggttctcaatatgtgctactactatgcgcttaatttggtctggtaataagctgcaaggtgctgacggtggaacagtggcttgcatgttattgtattttatatacctttgtttaattcaaaaaattcaattgtattgcgtttattaacatttatgttatcaatcttcaccgtataattggttctaccacaatctaacagcttagattttttcttcgattgctatgataacttataatagaaaaaaatataggacgactaagccgttgtcttaataataaagatttgtacccctctagaacgactatgatgattttctaagttatcttaataatatacatagataaaaggaatatctggaaaagacaatttacatatttattgttggtattatgtttttactccaaatgttatttttacgtttattttggaatctatattttcaaagaaaaactttttaattgtattgcttagggtatgcacctatcttgctgtcgtgcacatgctatcgtgccttctggttgctgacgtgcatcaccgagtccgactcatcgcgcagccgcacggcttgacctgctgctgcggatttccgtcgctacctactagtatctatcttcagatcaacaaaacacgtctaaaatagggctatgcagtgctttgttgcttgctgcttcatttattgcctaattcatctaggtcctaaatctgtttagtttcggaaatcggacaactctgttgagtccgtttgcatgtttggtcctagtttgagattgattctaattcagcacgtgtacggtgctccttatctcttactttaacatgccggatttatgttaaatctcatatgttaaaatatagacctaacaatctaacggtgtaaataattcatattttctccgattaatatgagaatttctagcctccacagcgaacgtggtgtcttctttcaaggctgttttaataatataatagatagatagatagatatatgcttatctaaaaaactgtatgtaggaattaatgtgtcatttcacaatgtttaatacatatactaattaatttattaatttatacagtaccagtatagtaaactaaactaatcattgtctgttcgttctaggacctactgacaataatgagagtatatcacatccattcaggcaaataaacaattccatgacagggtaagctttaattaggttctcgtattaatttggttaaagcttttgaaagcatgagcttggttagacaaaaaaagccatcacatccattcaggaggtctagaaaaaaattaccacatcaattagggaaaaaaataaaatatttccaccacttaatcatcgtgttagattgttaaaatgttgcatacaaaattgtgtctgtgaaatctgaagataagaggttgtatatcaaataatgtaattattatactttctaagtccattataaatatacaagatacaattatgtaaataacaactaatacaccatccgttttttgaataattatcaactttgacaaaatcatttattttaaaatactcgtcaccacgactttcgttagtaaaattacaactttgcccctactctggatatttgtcaccgcctatttcatcgcaaatcttcaactaaattgttggcttgttctgcgtacaatgatcaaaatgtctatgagttaaggagagagagtactggtatatataatatcctattttacttttacaatttagctctgcaaaattggtcgattattgcacgggggaaaatacactaaccaactatttcttgttagataattaattagatcattgctgatccgtttttgtattatagtcaatgcaaacagaacagatggagttctctcacagactccagacctactagctgcaactaattaagccagcatgcacatatggacatgaactttatacaaagctgtagctgtctaataacgattgaagcaaccatattaatttgttaacgaaacatccaaccgtgcatctggaagcaacattcgtgtagtaccaccatttattgtgtggccaaggatcggtagtacggacgtcgccgatctgctactgtgtactgtatgtgttgtcattgaggtcatcgtcatagatcgatgcaaaattgcaaaccgcgcgatgcgtatagggacgatgagagggaaattaaagctagcgacaggggctgggggctatggcgaaatcgccgaaatgtgagtgttacccttcgaatcttcgatcgattttaaaccaaataaaaaaaaagaacacgtcaataataattaaccagctagctagctagacgggtttgcgtttgtgtcgtgctaaaagccacataattttgtcttgctaattattagctattagttgtatttattattagttatcacctgtattggagaatgtattggttgtgtatactcaagtattgatgcaaatgtgcaatattgaaatataaattcgtcgtcacgatgtgatttgatttagatatataccaaatgtacttgtgatccaccaagttgggcgatcatgggacaccaaggaggcaattgtattcacgggaagggatctgcctggctataaaaactggacaccttccgccccacttgatcaaggaaattggccggatgcaaaagtagctatcccgctgaaaaagatgggaaaaagggtttagtggccctacaagtactatctatgtggagattcacaaagggggtgtttagatttaggggtgtaaagttttagcgtatcacatcagatattatatagggtgtcgtatggcgtgtttaagtactaataaaaaaactaattacagaatccgtcagtaaaccacgagacgaatttattaagcctaattaatccatcatttgtaaatgtttactgtagcaacacactgtcaaacaatggagcaattaggcttaaaatattcgtctcgcaaattaatcataatctaagcaattagttattttttagtctatatttaatacttcatgtaggtgtttaaatgttcgatgtgatagggtgtaaagttttggtacgggatgtaaacagggccgaagtcaccataaacatctagaaaccttgctgtcgacggatatatcatttatcacttaaaaaattaattagtcgtaaatgcgtgtagctggtgataatgcaaaacatacatacattgatgtgccggtttggtctaaacgaatgctttcttcctccaccttttctaccttaaattgaagaaaaatttattgtcattgaggatgatgtaccatcatttgaattgaaaacagtataaaatcactctcaatggaatgttgcagggtgctggcaggggcggtgaacctgcgcggttggcaaggcgcgcggctgcaacagaacggcccatgcatgcaagggtccgtgcgattaagggcccattgccgatttggattaacttttggagaacaaggacgtacgttcctagctgaaagcacatggttagatggttgctacatatgttgactcattttaatatactttttaaaagtttgtttgttttgcaatgaaaataaacattgttgtacttttctataaacttagtcaaataaacttagtcaaatgtaaacaaatttgacttaagataattccaaacaaaatttatattatgaaaatagagggatggtatactttaattagggttgtacgcctgacgccaaaagaagttagagaaaacttaacactctgcactaggcgtacttgattcctgccaaatgttgctcctaattaaaccccatgcatgtatgcatgtgagctagccgcgaatactccataatccaggcatgcttaattaatatacgtgtgtactccaagtgcatgcataagccagatgtagctagctagcttagctctgatcgcttaattaatttgcaggcatgtaccctgaacaattttaaaaccgttgtgagagatcattagtgggggcaatggaatccacaggggttgtgcgtagcgatgcctccaaagccggcacccaactcgcaagattctcgctttgccaagttgatctcgctcgatcgttagcttgcttctgttttgatgggacttgagcctctctctctggaagaggccaatattgcaatgcaataattttttgaatggaattgaagagacgtaccaatgcaatgcaataattgttttgtctgctggagaaaacagcggaatgtaaccggccaaatactatacgtgcgtcgtcggcggcgctagctttgacgtggatgtctatacatgtgtgtgttgttcttctaagttctaaggttgcaaattaactagaatgcggctaattggccgatgcaaatggagggagttgatccttgaaaaaaataaaatacccctctaataccgagatttattctaaggatgtcatgataccatgcatgaagtaactcgattttaccttcgtgatactacatcaatatcgatcatttttaaaacccatgattatcgttgagtatcatcgtatattgataagtatcatcaagtatgtatggaccaatatcattgaatatcatcaagtattttatcgcgtgtatatcaacaagaatcattgagtatcatcaagcgtactatccagagatatcacgacatagtatcaagtattacattataccaatataataaatcaatatcatgatatctcaaggtaccatgatatgatattatatagtactatacgatacagaatgatagatcgatatattatggactggtacgacacctcgagataccatgatatggtaactcaaattatcattggtatcatcaagtattattggtttagtgataaatattattatggtatcataaatatttcatatgttggtaccaaagactcaaaaacaggctttcacgactaaaagaaataggcctgttcttttctccaataggagttggatgaaaattaagattttcgtggtacgttttttaaactgctaaatcgtgcatttcgtgtaaaaactttctatatgaaagttgctctaaaataacatattaatctatttttgaagtttgtaataatgaaaactcaatcaatcatgcgttaataccatctcgttttgcagaaaaaacttaatcttcatcttcatgaaaaaataacaccaccatactctatcacaaaatgacaaaatgacaaaggaaatagaaaaagtaatcatggacaatcagcaagcctcgacacactgtcgggccgcgacgtcaccttcgcgcggtgtttgctccgcctccgcgcgatgccgggctactgctacttcggcctctccaagcgtccgcccgaaccgtgtcaaataactgcgggctgcggcgctgtccctccgtctgcgtgatccgacaaccgcctgtccgcctcgcctccgtgcgtggccggacccgacccgacccgaccccgcccagctgccgcgtgttgcccggtggggacgcctcatctccagtccacggctcaacgtccacgcacacgcactgcgcagcgcgaggaggccgcgcgccgcatcacatacacgggccacggcctcacgggggggccttcccgtggctagcccacgtattcccctccttcctgggcctaagctagcgcccgtaagccaaatcgcggccggtttccgcggatctccccgtggacctcctcctccgtgtggtgtgatcgccagtaacgcccaggagcttcgagagaattccacaccattcccccctaccaccacgcggcgcatcatcacaatacacagcctctgcttcccccggcaacccaaccgattcgcgctcacgccacctgcaatccgcgaccagacgcgcgggccgttgagatcaacaaacacatcgcacgcgacgccgcgtgagcccgtacgatcgccccctcccgcgccgcgcctccgcactctggttggttgcctcgccggcgatgtcgacgcagtccatctcgcccgccgcggcggccgcgtccgcgcagtactcgtacccggctgccgcggcggcggcggtcccgtcctacttccccgtcccgttccacctccagaacgtgcagcagcccgccacctggccagcggcgcccgcggcgtacaacgccgtctaccccatgccccaagtccagcaggtaggaactctgcccctcttcttctgattacgttttcaaccgctcctttctgtgtgaattctactgcccgtttgttgatgcggtgatggcggattagggaggatctagactctgttgttttagaggcttggagtaatgccagtttggggataatgcgctatgtcatgtttgattcaactgaaaggctcatttggtctttcgtcatccacctttcatccttgggacaacacaatgtaaaagtggaatactcaatggaagccaattcatattgcactataccagtgtatcatatacagtttgtaggttgtgaaatctgtctgcagaatgatgcacagaaatctacatattcggctcatgttatgcaagatcttagatgctacgtcatgatttcatttctatagatgtagggaggcgtgccaatgtttatgttttctaactctgaattattaacatttgatgagagacttgttcagtgcaactgtaagttgtatttcagtgtaaatggaaaaggatgtagcttcataaatcaagaacctgatagtactaatttttattttggaaactagctgtaactagtctattatggtatcaccacgacgcaggttcagcaactgttccagaaagattcacagataatcactcctgaagctctagctactgtgaaagctgctattgcaaatagtgagaaagacaagaagattgaagcaaacaaaaaggcagtacctcgaaaggcagctgggcaatcttgggaggatccaactttggctgactggcccgaaagtaagatctctttctcactatttcttcctggtggttgtgttggaatgttgtggttctatgatctataaaatcttgaacttggcagtgtgactttcccctcgtctgaacttgtctgaatgtctgttatcctcacgtcaacaaaccatcaaacaccttcaattccccaggcaagatctaatgttcgatctatgtattctaataagacaaactttcccctgtttccttctgttaaaggtggccgaggatgtgatatgtagcccaacaggtttcagagttgatgcctgtctcgtggaattaggtgggctttgcagatgatatagtaaacatttcctgtgcctttgccattagtttacatgcattgtcatctcgtttttgcatgcctaatttgattatatgaatatgatatttgaaaatttttcatagagttatacagagaaatatgttctactgcgcattttggtgcaaactattccacttatattttttattctaatgttcctggtgtaattttgatgatacacttaccatcctaggattaatatggtgatagattcttgttggggactgtccaaataaagatcttcccttatatatattgttatcaacaaagcatgaacattattaaaaagttttgttccatatattagtgattgcataaaggatgaggcttttagccaatcaacttactttccacaataatctgattttatcaattcgtcatgttgcgttcctgttagtcaatataacatgtactgtagctcagctcttgcagattgtttgtcatccttatttttagatttttgtacaattaaatatattaactgtatttagcatttttagctacagttttctagttttacatgcttagctgacgtatcagataccactatttagttgtaatacttcatgatgtgtcatccatcatgtaacatgtctaagatgtagcagccttgctgagttgatgtataataatttagcagcagcatgcaatgttggcagcgttaaatacttatgatgctatattgtctttggaatttactagcacctgacatgagtatgtatttgtgctgtcatgtttcgtcataatttgatagaagcaaatatattattctactttagtctgtagcaatgaccaaaaatggtgctataacagttgtttttctcaaatgtgccctctttttatttcaaagcattcacacttacatctgacaaattttccccatccacagatgattttcggttgttttgtggcgatcttggaaacgaagtgaacgatgatgttcttacaaaggcattttcaaaatatccatccttcaacatggctagggtgagtcacaccgtatatagcatggcaagcttttagattcttcattataatacctttttgctgcttcaagatgactgttaataatggacgtcttctgcttcaggttattagggacaaatggactggtaaaactaggggctatgcctttgttagttttgctaatgcgtcggatcttgctgcagcattgaaagagatgaatggtataagttcatgcccccattccctgtcaccatttgcctggattatcgtcgcactgcagatatgattaacacatctaacatcatgcaggtaaatatgttggaaacaggccaatcaaactacgcaagagcacatggaagaacagaatcgactacgaggcattacagaagccgaaggttggttcccattgttatcttgtaagacttcctctttctcttgcagaagtgttcatttaactgatttgttttatgcgtgcagactcaaccacagaagaagttcaaagcgcagaaaaaaagcattctacacaagtgaagtaaattcactctctagagagtgatccctagtgtcatgttgcacatgagtcctttgttgctcctgcaataaacgacgttaaagccttcagcgcccggcggtgcgcttgtcacgtttggcctagtgattgttctagggtagtatggctcgt

SEQ ID NO: 13262 - DNA, 4968 bp, Oryza sativa
gaggcgtacgtgcaaccgaattggtctagttaatcatattcagtagcacatcatgcgtgtttcaagaattgcgtctatatcacctatgaacgctccatccgtgcattgatggacttaactaaaagatggagaaaatatgtgttaacacgtcacatggattgatcttctccagtgttgaaactgccagtgccatgttgccgaccgaaaaattgattccgaacgtggagagtttatcattgacttgttcacaaatgtttccgcaacaaatggcttattttgacgcgaatcggtagcatcagaacgtttgggcttcgcactccagcaaggcccagagagtggacagtttccagtgcaagtcgagttaaggcctcagcaaataccaaatctgatggataccccagatgaacaattctcagggcatataagtacgtaacatgttaacttcctctagcacgggaatgcttttcaacagttgacctttttgcataaagcaacacatacattgtgtatagctgcccatgggcttgcccaatcgttctgagctcacgacattcattattgccctatagttttccaaagataggtggaaaacagcataccctcggcagcactaaatttcattagacaggtaagacaggtttattctgtgggtaattgttgcataggaatgcattaagaagccttcagatcatcaagtccaacactggcctgcaagaatagtatgatggaagacatcacattagaatcagacaattacagactaaaggactaagccttcaaaatgtgagaggccataccagaaaatcatgattctctttgagaaaagggtaaaaggtcgtgcagaatttctcgatatcagcttttatgtcacccgttccactaatgacctccataaatttctctctattaggagcaagcttcattgccacctgccaatttctcatatgagcactcatacaaacggaggaaaagcaaataaaggaagcaaacatgaccaaattaaagaacttctcacagaaaggcaaagcccttctctcacccaattatgaactgaagtgctcttgtacgtattcactaaaagagcatatatgactgaaaacagttgggttataatgattctccactgtattcgagaaagaaaaataatgattttccactagttctaaagattgctaaaacagaaaaattgtctttttagtgaagttcttgagaaggaaccacccttgcattagtttatttaggcgtaaacattctaatttcactaaaataataatgttgaagagattatagtaacaccatgtatatgctgattatgcgggtcaacatagagagaacgactcaactgtaaaactagaactggcaagccaaccatgccatttcttcagagttttggtatatgaatcagtacaagcttgactcatagtccagtcttgatgctcaagcaggttacggaataattcaacaaggaagtccatagccctgaaagtaaaattttgagttaataaggctgcttaagctgcaactgaaaggtgataaattatccaagaaggtttgaagcacctcgtgagccacagaagtccatttgtgcagcttgacgaaccttttgcagtcttgttttgaacctcttcctgaaccatgctgtacaattgctcatattttgatgggtctgaagaatatttattttccagcctctgaagaatgaattagatcagttgttagcaaaacaaactagaaatctgtgggctccaaaagggatatggacacttctaagtaagcaaatcattctaaagtaaatatgatttatgcatctatcacatagataacactagaaatttactaatgaaaatgaggaatgaaacacaatgtattattaacagtgtcatgcagaaaaaggatgcttaccgtgatattaccaccaatgtcactcttcacaagtgccatagcagctccaaatttatctggaatacaaagtcagagaacaaaggagacaaaggaacacttagccacaatagttagagtatgccctgacttaaaactaacaaacgatttaattgaagtactaacacaaccacacaaatgtatgtcaaaacttatattgtttagaaatgtgtatatagcaacaactaagttctaaacccccaaaaaaaactttactgaactcctacattaaatatcatatggtgttaccctcagaaggtcactgaccaattctaccgaggtgatggattggtccaatcaactatttgtagcagcattacaggtaaatcaaatgccaaatgcccacaaaccaacataactatttggtgattttgataggcaaaatccaacaacagtatagaccactgccaattgccaaaagcttgtctcaacttagaaaaccatttactgctccaccgcagtactgaactaaacatagtaaatacaaattaaaaaaggaaccaagctactgatctgaatatggaaatcaaagacagttacccaaaacaggcaagatttgcttgcagacatcaagaaagggcttggtgagtatgacactgctctctgacttaacatgcttcataccctccaacgagggagtgaacactgtctcggccatctctctagctgcaatagaaaacaatgaatgcgtcaacatatcggccgtagcaaacaaaaatccacactaattcactaaagagacactgatcccacaacagtttctaatcactatgacccgtggcaatgaattccccaatcagcaactgctttcagttgcaggatcagttgtgctaactgctaagtacctgtaccaaaacacagatcagggacatcaacaacaagcaattagcccgtgctatccactacgcatcacaccaaacaaactaaccgagcaacaagatttcttctagactttctaccactcagcagaaacaactcgaccctggatcagatcagagccaccaggccacccccgaaccgctaatccaagaagtggaaagcactttctactaatcttccgagcttagatcccaggacccaagaaacacccactgatcacgaaatccacacactggccacatccaaaccggtgaccaagaagccaatatttttcccccttacctcgcgctacctgtcggcggcgtggagacctcagcagagacccggtcgatcggaggagaggggtgatccaaaaggcgccggctttcacccgaggtggagtgcgatggcgagcagtagaagatgccgaggcgaggcgaggccagcgactccgtacagatttattattattaccgcggaatcttactgtgcaccgatccttgtggcgaggccgtaacacaagtcctgatctgagtagctcggaaatgggccggcccattacgcgttgaaagggcccaaacagggaggcccagtaaggtcccccgcagaataaacgctctgacggtctgaccctagatcggacggctggatggcctcgggtggcgatccaccggctcagggaaacccgcgcgctgcctttataggccactcccaccaccgccgccgccgaaccctagttcctctttgcctttccgcttctccgcgccccccccccccgccgcttctcccgaccgccgccgcgagaatggtaggtggatcgccgtgggctcgtcgtcttgccgccgttgccgttccggtggtggtggtggtggtggtgctttggattgcgcgcgtgtgtttgaccggggtttttttgtgcctttcgtgcagccgttcaagaggttcgtggagatcgggcgggtggccctggtgaactacggcaaggactacggccgcctcgtcgtcatcgttgatgtcgtcgaccagaaccgggtaagcatcgtcttctctcgtacgccttgaactgtttccatttgtacccgctttataatttggatctatagaaattatactagtactagctggtgtgataaactcttgctgctattgtaatttgtttctagtgagaaatgtaagaattgttaacgtagtagaatataatggaacgccaaaaatgaatcctttgagagtagcaagtctcttctgtttccgcacagccttaaatggaagaatattctgcatttgctgtggtgtactccctccgtactcgtaaaggaagtcgtttaggacaatgtttaagtcaaacctcgggaatataaatcatgaataactctcaagttgttgagtttgaagatgtaaaaattatatgaatagatttgtcttgaaaaatattttcataaaagtatacatatatcacttttcaataaatatttttatagaaacaagtagtcaaagttgtgttttggagaccgtgtcgctgtcctaaatgacttcctttacgagtacggagggagtacttgatctgaaaaaatgtgcgtcaagtctagaagtttatcagcattagctcggactacttggcaatttacaataatgaactatttattgacaatgaggttttggtttacctatgattgatagtgttgatggtgcctccattggcggatgcattagtgccactattatgttatcgctgctcatttttctaatcggagttaattatattgtagtgctttgattattggatatcacataactctgttttctgtgaatcaccaggcacttgtggatgctcctgacatggtcaggtgccagatcaacttcaagaggctttccctgactgacatcaagattgacatcaaacgtgtcccgaagaagacaactttgattaaggctatgaaggaggctggttagtatgaatgttgtgctaccaatcctatcagcagttatttatttctgtccatgtctaatctgagtggtggttattctatttaagatgttaagaacaagtgggagaatagctcatggggcaagaagctaattgtcagaagaggagagcgtcactcaatgcctttgacaggttcaaggttatgttggccaagatcaaggcagacatcctattctcaattggtttac

SEQ ID NO: 13263 - DNA, 12921 bp, Oryza sativa
gttccaagttggatcagcaatatgtgtaatggtcttagagccagaattagtactactgtttaatggaacctatttcatatttaaattgagcatggttgtgctttagagattttgtatgactgatggctgttaaatagtttccaacatatgatcactggtgatttgtgtggactctactcgttaccagttgagattgccgtgttttgctcgtgcagcatattgcagtcttgagtcgctgcaccgggttattgaatgttacaccacctactgagactggaatattcacttgctcagtcgtgccgaatggcagacgctatctgtttcaatttttcaaatggtaggcgtgcttctacattgaagaatggaaaatcgttccatttcctgagttagatggaaaatccttccattttctgagttagcaattttttctctcattttcagtagttggaaaattaaaacagcaatatacccagtctggactggtaggataaaatttaatgttttgttcatttgggtctgaatttgattgtatgtcatagttgtataatttggtttataaatggatggactgcatgtaattatgttttgagacattttaaaaagagactgtctacgaaaccaagtaatttatgtttgagacattttaaaaagagactgtctacaaaacaaaaaaatctcacctcatccatgcgaattctatctagatcatctttgagccgccttcaacaacacctaacccgtgttgctgactagaaacccaattctatccatctctaagttcagtcactatacaaccatttcgcacactaactctcatcggatccaataagaaggagccgcctgatctagctcttcatcggatcggcttctgcctcccaagtccgatgacacaatagcgtgtatgatgacggggaaggaaaaaagacaaggaaaaaagacatctggttgtgcatataaaggcggagaggaggaacgatggtggctcatggataaagtggcatgtggaccatcagtcatcataaagaaatagttagttttaaagtagtaaaaaaattgagataaaggtagagtaagtatggatgaaaacactttggaaacggacgaaaaccacttatcgtttccgtttccatattcttttcaaaattggaatggaatcagaaacacggatacataaacaaaatcgaatattatcgaatacggtaacacttatttatcggaatataaaaaccccttaagccgaacttctaaaatcaatgaagagatgtagctcgatatcttttctgaaacaataaatcaatatttttagtttttatcattaataatacaagtagtcgtacactttattttcttggagaaagagaactatattcatctataactgcaattgttattactatggcacatagtataaatataaatatttagagtagaaaagtctggagctaataaattgcacatgtgaaacacttcgtttccgattccgagaaaaaaatatgaatccgtttcctgaaattttccaaattcgttttcgacggatagtagcattatcatatccgtttctgttttccgagaaaaatatctgaattcatttcctgaaattttccaaattcgtttttgacggatagtttcaggaaacatatatcctaaacggatagtttgggatatatgtttccaaattcgttttcgacggatatgtttttaggaaacatatatgaaattttctgtttccaaattttccaaacatatatgtttctgtctccgagaaaaaaattcgaattcgtttcagtttcttagatccaggagttggcaaatactacctctgtcccataaaaatcgaaattctagttaatttagaacatattaggctttgttcgttgctaccaagtttctgtacgaaagttgcttaaaaaaatcatattgatccaactttgaaaaaaataagctaatacttacttaatcacgcactaatagaccgctccgttttccgtgcgcggaagatttgttcccgaccactcaaaccgaactcagccttagagcatgtacaatagagccctaacgctggcgataatggttccacgttagctcgcgtgatgcgctggaggaaagaaggaaggtgagtgggcgactatttagtcgccgagctgctcacgaactctaagaagttgggcccacagatacaacacgaggggaagctggtccacgcaacgcgaggaagagagataaataaataaacatagatggttccgttaattaaaataaatatataatgtgtcagcaacttattattagagcacaactattgtatcatgtgtctcttaaattatactatatgatgatgatgtggaagaattggagctaagagcgggctgtactattaaacttgctcttaggaggatagacaaatgaccagaataatcttatttaatgaacccatatatgtatatatttcatagtataaaattgattagaatgaattttgagacaattaacccacataattagaaatacttttttttagtaaatttcacaaaactacacgttttgtagtccaagttgcagaaaaccacacacacttttgacacttggcacttaagtatatatatttttgtagtgtcgtttcacaaaaccacactatcaatgaatggattcacccgtgagatgatgtgactgtttcatctaggacgaggacatatcatcctattaccagccatcgcacgaaattaatagggtgccacatcctcatcctagatggaacgaccacgtcatctcaaaaggtgaatccatacatcgacagtgtagttttgtgaaactaaactactaaaatatatatatacttaagtgccaagtgtcaatatttgtggttttctgtaacttgaaccataaaacatgtagttttgtgaaatttacttttttttttttttttgataaaacctcatagctagaaatctcctgtaacacgggtatcttcccttcgctccgttggcgtaaaataaagaggaatctcgcgtctcgtcgtctcctccgctccttgcgccaagacgagtagcggctgaacacaacaggcgaggggcggcggtctccatctggcgagcagagcaggggatgggaggggatcctggtgagcatccacatcctctttctgattcatctctcaatcccaccgggactacttttgtctggaattcgcttgcgtttgttaaccctagcttctcttctagatctggaagaagcccttctcttaatttcagagccttaaccttaatacaagtagcagtttgtttgttccccccaaaagtttcccaagttggatccgcccctggttgttaacatagtagcaaatacaatatgaacaatgagagtcgaccaaagtggagaaaagttgcctatgggggaaggcagccaggctatgacgataaccacacggacgagtcattccttgaggagatggttatgaacgccaatgttgtcaagagggacctcctgaaagtgatgatcgactcggtctccatatctcagtatctctgcattgttgctcttgtggtttcaacatggacctatacactgaacttggtcattgatgaggtcactcttttgaagctagacactagtctacttcttgccgggttttcgatgctcttgctcacggcaagtccgttctcgctcaagcttctctccaagtatgtcctcaatacatcattcttcatcagtggtctgtatgttttggcaccgatttatcaaaccctcactaggtccatcagttcagattccatatgggcacttgctgtatgccttctgttggttcacctctttctgcatgattattctggttcaactataaggccacctggtgcactcaacaacccaaaattgaccagcaatatctccttgaatgcatcgatagtagcatccgtccttgtagcttcgcgcctgccatctaggctgcatgtctttgcaatcatgctattctccttgcagatcttcctgtttgtgcccctcgtcgcgttttgtattaagaagttctctcttagacttcatctgctcttctcctttgctctgatgatcatgaccctaggcgtcacataccaattgcatcacatgttcttcatcctactgctggcactgcttgtttttatctcaattgtttgcccttactggcttataagaattcaggaatacaagtttgagatcaatggtccctgggatgaagctaaactctgctttgatataactgaataacagaggaaagtgcatgtgcagaattttggtttcaatgttcattatctataattgatgtattaccattagtcttattattctggagcaatttatgtgcatgtatatgcttttcttaacatatactaccttcgtcagaaaataagttactctattacgggacgtgacatatcttagaactacgaatctagacatgtctttgtccaaaatcgtagtactaggatatgccacatctcgtactaaattaacttattatgagacggagggagtgtctacttgttcccttactgtgatcaatatacatggcgggccttatctgttctgccatatattgataagctttctgagcgcattcagtggtttaaactttggtgtacaaaataattaggtacaaacatcgtcacatgtaatctttaatcgagtcaagagagaactgctcagcccagtcacatggatttcttgcaataaggtgcaagtgcagattaaccctaacatattggtacttgttcttgtgttgcctccagtttcgttggcagtgctgctcactgctctgtattctgttccgattatatactgccggagttttttttttaagatataaaagaacgttccatcttttgcgcgttcgcgaaaaaaaaaaagaatgttccatcaaccacgaagccctaacacaacttcagcaacatcagctgggggcattacctagcaaaaaatgatcaggacccatgtacaacttcattcctgtacatgtagttgtgcctggttgtaacagcctttttttatcttaatacaaagatatgcattttgcatatttcaaaaaaaaacaaacaaacaaacgcattcctagctgaggtaagtgcatagtactttattacaggttattgagaaatattcaacagacacaacagctctgaacccaaccgtagtagttcaccactggcaatagcctcagattcacaaatgttcttggaacaaagaagattcagttcactcaaatttgcctactgctagagcatatttgagttaaatcagttgtcaaaaagtgaaacaaatattttgatagttagaaaagtaactgctagttgaataacgatatctgatcgtatgatatattaataacgattacatgatctccaagtttttaaggaaataatgtgacggagtatctaaagggcactaaggcaaaaaaggatattgattatcttaagagtatagtggcagagtggcagaagttctagttgcagtgcacaaaggaaatactacgtgatagtacatattttgctagtaatgaactgctttatttcaataacatttctacaaatatttgatcaacatcagcattaattggaccagcacagttgctggtccgggttcttctgaatggcgtgtaaaatgatttctttaaccatttcttttgcgccaagattcagtaagcaaacttcactcttaagcatatctcagcatcatctgtagcacagaatggtttttacttgttgatcagtaatcatcgtgtgaaggaatccccagtgtcctcactggagcagcaactcacatcttttgctcttcgaagcattatttccttctgtcagcactgattgaaaggcgttcaaaggtcctcaaagtgggatcatcatggacatttcttgcagttttggtaagcgaggacctggtctcaagtcctgttgactggtgaagcctctgcatagttgatgggcgactgctgccactgctggttggaattaggttactgcggttcggatcaatgggatctccagaacttggtctgctgcttgacaagagagccttccttgatgtgctcccattacgagatgatgatgtgggccttcttttatctaaatcaacagcctagcacgcatggtaaaattgacataagccttccagaatacagagttccagctatcatcaacagcaacgtaatgtaaaaacacaacaaaagatttctgcgaaaagatggtcaagactaacgaagaaacatccgtctcattatcctgctaatttgagcagtttttttaggatactgctagaaggtgatctagctgctcaatttcttaccgtcttgggtgcaagtaatgaatccaatatatttctgtgctttgtgtgctctccgtaatggccagaaccagagccagttcttctagcaaatggatcgactgtaccagagaatctgtcaggaacatcctgtcttgctgttgagacaacaccccaaaaaacccctgttattttccaaacttatttcctaaatataaattcaaaaaatgtctatgctactgacaaacctgcagctcgttcagtccgttctgcagatggtcccaccaacccacttgtccttccacttgactggaagcaaggaaaagatgctacacatttagtacggtaaagctttgcattaccaaaaaaagttagaaaaaggaatagcagacatactcgcaatctgttactttctgaaccttgcttcgtccaatcaaatatataatcaagctggtaccctgcaagaattgagaggaaatcattttagatgtgtatgcagagatacttcattgtattatatttgagcataccttcacggatgaatagatctcggaaaagtctcttcaaatagctgtagtctggtttatcttcaaatcgcaaagatcgacagtaatggaagtatgaaatgaactctgtgggataagatttacagagaacctatacaaaattgtgtaaaatatgataaggttaagttgcaattaaatcaaaaaatgtcatgcttcttcatagattttttttgcatggaaaccaatttccattacctcaactgggagtaacattttcttttcactaatttggccatatttctggtttttttgtgccagcttttagaccttgccaaggaagctgaaatggacaagttaacatagatcaataaaatgtattgtcgtataaaatggaattttaaaaaatagaaaacaagcatcgtctcaccttcctcttaagaaatacataagcacatagcccagagactctaaatcatctctcctgctttgttctgtagtgaaaaacagaattaaaagaacgcatatactagcagtcagagtgcaattgactaattttgttgcaagctaaactttatttgtttcaaaggagctacacttgttcataacttttcagtgttgccacattttgcacctcttaaatacatattagtttgcgttagttcagatttttaaaaaataaaatctcttctgatgaaaacgaatcagtaacaggtaaagacacttacctactccaagatgggtgtttacactagcatagcgtgctgttcctgtgagatttttgttctccctatggtaggaaagaaaaacatgtaagcttcaaacatatatccccagaaaagtatgaagcataatcatgcatagaaatataatggtagataaactggtaaactttttactattagtatgaaggaggtaactgctaagtagtgaatagtgatagtgtaacccgtgttactgaccaatgtcacagtatagtactaaaacataacagaaaatggtttatcaattatcacaatcatcattgatcaaattgttgcaatgctgctgtcattactcactactatcaagcatttctcttaatttcaagaagtaaaaacagataacaaaattgtgtgggcttatctatatagttaatagcagatactgcttgccaatatggttaatagcagatactgctccaccggtagtgtgccaagcacagttatggtaatgaaaaattctaaattaagcactttgagctctgtcagataaaaacggtgttgctaccaaaacaatatactttagtatgatttttcataagctgagtgctctactacaacaatcttccaggtgtaaacataaatactttctaaaacatttactagagaagaatttctaattacctgtaaggtatatgcttatgagtttggaggtcccggtatttctttgcaagaccatagtcgatgacataaacctgttacagaattgtaaagatcactcacaacaatgtctacaaaaagttgtgcttatttcttgatgttattcattgtaagatatatcacatatgaagtaaatgcaggctttcgatcatcagttagcagcagtactagaaaggcagttgatatgcatatgctgagtaacagtatgcacaaataagagaaaacagaaatattatccttgtattcttcaagttcttacgaaataataaaacgtatggtaaatcgatgatcacagtcagcagtttaaattctccaaagtctttctacattcataaaaaagatgtttctaaaaaatactaaaatttattatacaagataatttctccataaagaaactagtataatcatcaagcacacagagcacagctgacagctgttgttggtaatatcatagcctctcttagaaagtataattgaagatactactgccaattgacaaaacttcatagcaccaaaaaagatgatacttagaaaccaggccaaatactcgaatcaagatgttatcaatacaaaattatacagaccaggcaaccaacaacatccaaagcgcagaaaaataatgaattatatctaccagcaactgcagatgaatgggacaaacctggcttgctttgcggcctaaacccataaggaagttgtctggcttgatatcacgatgtagaaaccccctagtgtgcatgtactctaccctgttgatctgtatagaacaggaagttagtggttaaatcagacaaataaagtcttgaaatttactttccttgatcgttaattaattgaaatttagtcatacaggtaaccaaaattaacagccaaaataatagaattcagtaagaaaaacccaccatctgatcagcaagcataagtactgttttaacagaaaactttctgttgcagtagttgaataagtcctctaaacttggaccaagaagatcgataaccatgacattgtactccccctccactccaaaccacttcagatgaggaattccagctgaacataaccaagacataataagtgaacaattttatttaaatagataaacagtttcccgtattacacttacttcccccctgcagaagcatgtatagttttgactcataatgaagctgaggatgccttgattttacagattcctaacaaaataagagatgacagaaaaggtttaggtaatttgtcccagtgtcagcaaggacaagtaatcagtgctgacagtgactattcatgtcaatatagaaatacactttccaagtttccgaacaccttattttcattattaccaacattttctcatagaacaaggattgcaccatttaagaaagcaatccaatgcatacaggcttacaatatagaaatggcattcatgattagaaaggcaaagctggttcacaaaactagcaactacgtgaacttacaaggtaagttgcttgaaaagtagatgtgaccaaactactaacaatcatatcgaaataatagaagcttctaaaagaagtgcattgaccactgaaccggagcaataatatcaggagaatccttgaatgctgctttgaaacattgaaatagacaataaccaatgcttcacagctacccaacctagccaaaacatgcacaaggtattccaaaaggcttcgtttccccagacggaaaagctttgtttgcaggtcttacaggatgtgaacagaatcacgggcggctgccctgagtcctaatgttacaagagcagataatatagtatgacaagggttggtgggctgcctcatgttatttacagatgtttcagaataagtgctctcgtaaaccacacacatcacctagatgaagcaattaaataatgtcaacgatccaattggaagctgaaaaatcttcacctcttttttcttacttcccaattctgaacatctctaatagaccagttaggtcggagaaccaaaaaaatttagaagacctggtttctacttgtatgaaagagtatgatactaagcaagaggtcatgtcaacgatttcacaaggacgtatacatgtagcttcattcaaatttctgatcatgcagcaatgcaaactctgttacacctcaggtgatctaatcttttctaggagggcagaacaaaccatattcgcatcacaacatcagcacaaaagaaaccaatgcaatactaattactacaatatatacattggcgtaagaaaaggcttatatatcagaaacgaaatcatcttcacataccaacttgatggctacctcctcgctgctctgtatattcacacctgtaatcgaaacaatccatgaatcaacgacatcatcacaaacagcgtaaacagtaagaagaagaaaaacgaacggtgcctcgcaacgagcggcgatagacgagagatccgagaaccccacgaggaacgtaccaaggtatagctccccaaaagatccgctcccaatcttcctccccagcttaaacttccccccgatcacatgctccatccccgcaagattcagcaccgaatgcgcgcgcgaatcgcctcaccccccacaagaaccccagtcacattgcccggcggccgcaagatttgcgtcccgggaacacccaagaaaaggaagatcccggatctctccccccgactccagcccaagattcgccgccctgagacggcgcgggcagatcgaattggcggcgccgcgagattcaggacgaggctagggatcgcctccctctctgtgggggggagaaatttctcggcaggaatcgtgggggggcgggttaatagatggcgatggacgaaggaagcggaaaatgtgggaaacggacgtgaggcaacggatagataggggtagggcggtggattttcttccttcctttattactactgctagaaggaggaggcgggtggcgatggcggcggcggcggcggcggcggcggcggggggagcgtgggaggaggcggccggtggccggagtagaggtgggaggaggaggatgtggagattatgggtaccccatacccacacggcatggtatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggcatgagacaactagatcgtcagatcaatacacacccggcggattcaaatccccaaacaggagtagggtattacctctcattgagagggcctgaacctgtctaaatcctttgtctccacatccatccacttttaggtctcgtgcgctaccccattttattattgccgaattcatgtttcgacagttggcgcgccaggtaggggtgcgtcgagtttcccattgacaagtgcgatggaaactaaccttcagcattgccggattcgtcgtcgctttacaaccaatctcctgcttcggtttcttcgtcgacgacttcggaaagctctcgatttctcacttggacctaatcaagtcgggaaggttcaagactaccttgatctcgtccggccgccgctatgtttatcagtttcattgaagaaggtggccgcaccgcagtcatcatctgttttaatctattcagggatgcgtatcaattctcagccgccggcatctgtggcgccggcatcttgttggtatcgtatctcccgacgagatccaattattaatccaaatccgagtcaacttgtcctcgcagccaatcgattggagcaatcatcatgggccagcgtcattagcaattgcatgtaacaagcacataagccaatccggtactttctgtgtgcatgggaaaccagccgaccaatcagaggaagccgtcggcctaaatacagctatgcatgcacatcgatcaatactgctctgcccagaaagattactctacaatttagcgtcaagcgtatacagagcaaaatcatcatcaccaagaccatgaaggcaatggttgaatttcccaagtcaccaagattcatcttgtatttcaaggcagggactatatctacgcacatgcatctcgcatcaagattaccaagtatcgctcgctgcctctgccgccactgactggtgtcctcgcctatacggttggttggtcacaccaccgttcatgggcgtccatgcctccgcctacacggctggcctattatgccgccgctgttgggcgtctacgacttcaccgccggcctgcctccgtcgccgccgactggtgcctccgcctacacggctagcctattatgccgccgctgttgggcatctacgacttcaccgccggcctgcctccgttgccgccgagtggtgccaccgcctacacggctggcctattatgccgccgctgttgggcgtctacgacttcaccgccggcctgcctccgtcgccgccgactggtgcctccgcctacacggctggcccattatgccgccgctgttgggcatctacgacttcaccaccggcctacctccgtcgccgccgagtggtgcctccgcctacacggctggcctattatgccgccgctgttgggcgtctacgacttcaccgccggcctgcctccgtcgccgccgagtggtgt

SEQ ID NO: 13264 - DNA, 9372 bp, Oryza sativa
cgtcgccgccgaatggtgtcgtcgcctatacggttggttggtcacaccaccgttcatgggcgtccatgcctccgcctacacggctggcctattatgccgccgctgttgggcgtctacgacttcaccatcggcctgcctccgtcgccgccgactggtgtccccgcctatacggtcggttggtcacaccaccgttgatgggcatcgtcatcttcaccgccggcctgcctccgtcgccgccgactagtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcctttccctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatcgttgcctttgggccgattcctagcacccgggggctcgttggatggaccgagtaacgcaaggtgctaagtattattcggaataaatctaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaactgcttgaatttttctcgagtattatatttacatcagaaactactcatcctatatgtttgttctgcaggatccaaatccagatatgcataaaagggattcatggctttaagcttatctcttatgctccaggaatggatcagtcagaacatcaccaccggctcgccgtcgtcgccgccgactggtgtcttcgcctatacggttggttggtcacaacaccgttgtcaggcgtctacattttcaccgccggtttgctttcgccgccgccgactggtgtcaccgcctacacggctggcctattatgccgctgttgttgggcgtctacctcttcaccgaccggcttgccttcgccgccgccgactggtatctccgtctgcatggctggcctattatgccgtcgttgttgggcgtctacgactccaccaccggcctgcctccatcgccgccgactggtgtttccgcctgcacgctggcctattatgccaccgttgttgggcgtctacgtcttcaccgaccggccgcctcgtccgtcgccgactggagtttccgcatgcacggctggcttattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggggcgacttcatctttattatcttcggcaccgggaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcaaccaacgagtcaactccaggagtcattatcttcatctttgattcggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgagaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttggacgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttattcgactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgctcaatactttggaaatttctttattcacaacatacaagcttctttatagctgttttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgttttggaaaaagcactcgggagatcatggcgaagatgattgaagcactcggctttggagtaatctagttcgaaagaagattatctttccgactgtaaaggtctcaggggctactgtggagattatgggtaccccatacccacacggcatggttatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggcatgagacaactagatcgtcagatcaatacacacccggcggattcaaatccccaaacaggagtagggtattacctctcattgagagggcctgaacctgtctaaatcctttgtctccacatccatccacttttaggtctcgtgcgctaccccattttattattgccgaattcatgtttcgacagaggaggaggcggcggcgtcttctcgggctttcgtggggtggaggcggcgtggctactggcgaggagaggacgagagcagcggacgacgcgtttttttgatttttttttttactagcaaaagtgcccgtgcgttgcaccgggtgatcacggagtgtgtacagtgacaaaaagtgttgtttggtttagacaactaatctgctaaaaaaattatttaccacgaacgtctcaagcacccatgtcaaatcaaagatttaaatcaagattgactggttccaccacaagaaacttatccggttaaactatacccactttgcaattgtgggaatatacatgtgtattgttacctgagaaaaatatgtggacttcaacaaatcgtaaaaatcaatcttattaattttgtgagagtgagtattgttttttatttacaaattgtatttgaggtcaaatattaataagtagacattaaaaaaaatgaaagaagattagacggtgaggggaaaaaataaaaaaataaaaaaaaagagcgaacaaggacaggtcaagaaaattttattatttaaacatttttaataaatagatgctcgtgttacgtgtgttgcaacgggtaaactaaaattataataaatataaaaatattagatcgttaggatttagtttttatgttatgagccctttaaaaaaatatattccttacataaaaaaaagttgtaaaagaaaggcccattagacttaaaaccaaacaaaaattaaaaccaaccctataaatctctatatgtgccggttatatggtatacttgtgctgtttttttattcaaatacagagtgctcatttttttttaaaaaaaaggcccgtcagatctaatccttatccccgagagagcaagcggagagcgagcggagcaagcggcgcctcgatccttccgtctcctcatcttctcgtttttcccgacttcccttatcctctctctcctcccttcattttcctctttctcggggttctctctactgccatcgcaaccagcgacgccctcccctctcccctcaccagtgcgccgcttcccctcccccttcgcacggcgccctccacccggctgacggcgccctcttcctttcggtcttctctctcgctctcctctttctcggagccgaggcggcaggcggcggcgcaagaggggaggcagcgggcgacgggtggcggcggcaggtggagacggtgaggcccagcagcagcgggaggcggtatcggaggtgatggccgcgtccgcccctctgcggcagcggcgggaggagcggtggccgcccagaggcgccctcccaccgctagatccggcgggaggaagggctccggagctgcgccgcctcgccatcctccccgccgccacctaatgcgtcggtcgatccagcggtggcggctccctccgccccctctcgccttcctccggcggcggtggcagcgtcggcggcagccgcgggcggatccggcggcggcgggcggatccaacggcggaggctccctcctccgccgcctctcttctccctccggcggcggtggcggcggctgcgacggccgcggattgatagcgtggcgacggctgagggcagcagtggcgacggccgaggtcggatcggcccctccgctgcagcggcgggaggagcggtggccgcctagaggcgccctcccaccgtaactaattaacaatgtttgttcaattatttagttattaagtaaagtggcaaaaacaccactaaatatgtcgtaaaaaagtattttaaccatgtctagtatgtttgtctatttacgcaaatatttatagaaaagatgaatgatcaaatgaattcaaaaaatcaacttcgaagatgaacgtacagcgtgcatggcaccctcacacgcaagtgggctatgcctgtcatgatgcaaggttaggctggtgaatgcaaaattggtcattctctacaatggtgtggttgaaatcttttgttgaacccggcacatggtcaaacgatagaacttgtacatactccctccgtctcttaatattagaggttttgaccactcgtgttattaaaaaaattatgcaattatagaaaacaaaaagttgtgtttaaaatactttggataataaaacaagtcacaaataaaataaataataattctaattttttttaataaaacgaatggtcaaatagtgcaagcaaaaaaataaaaaaaaatatattaagggatggatggagtaattcagagtacaattggctttttgtttgattaggctgtgtttagatccaaagtttggatccaaacttcagtccttttccatcacatcaatctgtcatacacacaacttttcaatcacatcatcttcaattttaaccaaaatctaaactttgaatccaacttggagcacgagagcaacatatcacttggcagggctacagaatcctgacgcacatcaactcactctcatatgaccatgcaaacaagtacccatatcattagtctgacaaatcccacaatataaggtacaacaaccacatcatcattcatcgtcgcttgatgtgttcacgtcttaagcgtatgttcggcgtgattaaaaagaaatgcattgatcaccacctactcttccgccatccgttgtgaactcgtgattctggtgcaagcaagattcctccacgttgcagacgtggggtggggcttgatattcctggcactgatctacagagtgattaaacaaacctcacagccaggacaacaggaataaggatatactactagcaactgccgtatagcaagatcaggaagatccagcaaccaaacggagacaactaaccggctaaccgcagtataccagaagtagctcgatcggtaagagccagatccagaacacacacactgtttttatctcttggtgcaacacagcctgtgtttgtttttcttgttgcaacccagcctgtgtttttcctgttgcaactgatcccaattctcaaggaaattaaacagatcatctgcatggctatcctctaactttgaataactacttcctcccttaaatataagggattttggatagattagacgctttatagaaccataaatctaaacagagtctatctaaatatattatattttaagacagagggtgtaacatgtggagtattccttctatccatgagtaacttgagcttttcacttaccagcagcttttcatttatttacccccaccagttctataaaaaaactaaaaagtactactagtattactccatctttggcagcagtcgctgtgtttagttcgtgtgcaaaaaatttttttattactgacacacgtttaaagtactaaacgtataataatattaaataaattacagattctgcctgtaaactgcgagacgaatctattaagcctaattgatccattgttagcaaatgtttattgtagcatcacattatcaaatcatggcgtaattaggctcaaaagatttgttttgcaatttgcgtgcaaactgtgcaactagtttttgtttcacatttagtgctcttcatatgtgtccaaacatttgatgtgacgaaaaagttagaagtttgacggagaaattttgaatctaaacaccgccagtgttactttgcaaggcggaaagacgcaaccaggcgcacacggttccaccgcaaaactgccccccaaaccgaagcgcacgctacctcggcatccaccaccacggtgtttgcttgcttgccccccgtgaccgttttgagccgtccgtgcaggcgtgcattcaccagcgcgcgcgcgcgcgcggcgctaggacacgccgtgtcgcggcgcggcacggcacggcaagtaccttaactgaaacccaccgcgcgcgcgcgcgggcataggcgacgccgcgacggtgcggtgagccgttgagcagtgagctactagtggacggcaaaggcgccgcccttctagtaggtttcagtgtaccaagggattaataacaaaatcacgctctgattattttatcgtctagaattaactgtaactgcgtccagatcctgacgcgtatcactccagataaaccaaaagattacaaaaacatatctgctctttttatttttatcgtctaagtttaatagaaaaaactgcatcctgatgctgaatgtctgatgcgtatcacaacagataattaagcaaagattaaaaaacaaaaaaaaactctatctagaatcctatatgtcgggactcgctctacagaccgggacagggaaggtagaatcagctttcgttgacccgctcggcgttagcactcgagagtccccgtccatcctattaatcctcgggcgtagcaccacctcacctagtctccaagctccatcgaagacgacgactcactgctagctggtagctgctgccggtggtgccgatcgactgccggacggcgggcagagacgccatgggagaggagaagagccagcagcggcggcggcagggccaccctctcctgaggggaggcggcgcggggaagcaggccgggcggcgttacacccacggcttctccgcctcccagatggtcgggctcgccgccctgtgcggcgcgctggcgccctcgctcccgccggacacccgcgacgacgactacgacgacgccggaggcggacgctatggcggcgccggtgcgtccgacgccaaggccgtcagggacttccttctcgcctccgccgc

SEQ ID NO: 13265 - DNA, 1253 bp, Oryza sativa
ctacaactcggcctacgcgcttaacaagcttgcttttgcttagtacctgtagcgagagtgaagcctcggccggcgatggtgcaggtggcggagctgatgacgaggatgtgcctccgggaggcgctggcgctggtgcgggcggtgctgtggctgctggggacgcggctggggacgctggcgctgtgcggggggcggtgcgtgtcgtgggggaggtggccgttcgtgctcacgttcgcggagatgccggtggagcggcgggaggaggcgctcgggcggtggagcagggtgaccgtgctcccgccgctgcgcgccttcttcctcgtcgtcaaggtcttctgcctctacgtcttctactcctgggtaaccactcctcctcctcctcctctcatggcctctcgtacaccgctgatcgatcagctgcgagttcattcacgttagatttttttttctcgcgttttgcccgcgccacgcacgtgcgcgcggtgatttttctctcgacggatgcacgtacgtacgcccgtgagggacggactaagcgttgtggggactgtttatgtatttgtcaggtgatttctaaaaaaaaaatcacctagattttttttacccttagatttacatgcaacgaactacaaaagaatataacaaatacatatttaattacacattatttttatctaaattacagtgcacttacatgttatatcaacctaatttataaaatataaatttagttatataggactgtaattttatattttaaagaaaatacaaatatatatcgattttgctatatatttgtcgacaaatttttccccaaaaatttgacagatgtaattacagtacaatcgtagtgtaattacgctgtaactatagtgtaacttgtatgtaactttcaaaaatctctccgtaacatgttatttcggtaaaatgggggtcgtgggaacaaatcctttcacatatgtgtgtgatatgatttgttttcttcctcaccaaaacaaatcttgtaatagatctaacgattcaaaattatgtgaaacttacatataagttacactgtagttacatgtaagttacagtgtaattacatataagttacagtgtaattacactacgattgtactgtaattacatctgtcaattttttgggaaaaaatttgtcgacaaatgtatattttacatgtaagtggttgtatggaggccaaaaaaagtgtcaaatgacagcaaaaaaaatcacacgagagatgatagcaaaa

SEQ ID NO: 13266 - DNA, 14159 bp, Oryza sativa
atgaacataataacctaagtactgtactgtgatgtgtgtattattacatcactggagcaagtatacactagcaggttgtaaacaaactctaaaacgtgtgaaagagataagagagtagagagaaaaaaaatagagaggagattataggctttgtttagatccaaagtttagatccaaacttcagtccttttccatcacatcaacctgtcatatacacacaacttttcagtcacatcatcttcaatttcaattaaaatttaaactttgcgctgaactaaacataaacacagccatagtcgtaccaatgtgcgacttataatacactagtttaaatgctaggctcaggtcaggtactagtataaagatagtgatgcgatggagtagtactataaagaaaagtagggttgtcctcgccccaaaaataaatggtagagttaggtaaaaaaaataactcccactcccccaatatataagtatttttatcatagtgacaagtcatctattttcaactttaattattaatattaaaaaattaaaaaaaccaatcatgtaatattgatgttactaggtttattattaaactattataatatgtaactcttcttatttaatacatcttatttttatagatattattgttccaaatagtatttcgaacatcgtattaaagtttaaaaatatttatatttttaaaatggagggagtactactatccattagagccgcatgttttggacgcgcagcgcctcgtcttggcgcaggccatagcgcctccgcatgcggcgcatcgcggtatgccggtatgatgtcaatgatggcagctaccgtgcccgtgcgccagcgagcgtggcactggcacacacacatgacattggagctgcagatcttttggcgcgagcgcaacgtgcagccgtgcaccaagtctgagcttctagaatgagccttgtccttctctcgctgcatgattaaccttgtactataccattgccaaagctgcagtgatgatgaggtggcggttggtgtccacaagaccacaagttcagtgtggatcatgtgcacacaacgaatttaggaattgcataatcgttaaagctgaatctgaacaggtgaatgcgccttgatgcccagaccaaactttctgctgagtcaggcaacacacagggacagcgacagtagtagttttttttcccccaaacgacgtcgatgtgcatgtcctctctgatagtgccagctacagatatttgaaaataaacttatacagtaatcaatatcacatttcaaacgacgtccaatactgtattactcccttcgtttcttactataaatcgtttaacattttgaatataaaacaaatattatattaaatatatttaatgttaaatttaaaaaattaatttgtgttatacagtacatgttactattttttataaacttagttaaacttaaaaataattagtatatcagataagtcaaacgaattatcaaatgaaacaaaggagtactaaagaaaaatgtaacaaacctgaccttcctgcagattgacgagagctcagagaacccgcactggcgagcgatcgggtacagcccgccgaccgacgaaccgccggcggaggagcacaccgaggcgacgaagcggccactcgacgacggcgtggtcgagaccatcaacctcacggacgcgtccctcccgtcgtccctcgcggagaaaggcctcgcggtgaccgatgacgcggcgcgcaacgtgtgccgggtggagtgcgacgtcgccatcgtcggctccggctgcggcgggggcgtggcggccgcggtgctcgccggggccggccacaaggtggtggtcatcgagaagggcaactacttcacgtcgcgggactacacgtccttcgagggcccgtcgatcaaccagctctacgagtccggtgggttcgtcaccacgatgaacggcggcgggctgctcctggccggctccacggtcggcggcggctcggcggtgaactggtcggcctgcctcaagacgcccgagttcgtgcgcagggagtgggcggccgcgcacgggctcccgctgttcgccacccccgactacgccgccgccatggacaaggtgttcgagcggctcggcgtgacgtcggggtgtacggaggaagggctccagaacaaggtcctccgcaaggggtgcgagaagctgggctacaaggtcgacgcggtggcgaggaactcgtcggagggacactactgcggcagctgcggtttcggctgccgcaccggggacaagcgcggcacggacacgacgtggctggtcgacgcggtgggccgcggcgcggtgatcctgacggggtgcaaggcggagaagctggtgctggaacgcggcggggcgaggggcaggcggtgcgtcggcgtggtggccaggagcaccaacccggcgatcacgaagacgctggaggtgcgcgccaaggtgaccgtgtcggcggccggctcgctcctcacgcccgtgctgctgcagcggagcgggctcaccaacccgcacatcggcaagaacctccacctccacccgaccgccctggcgtggggctacttcccggacacgatgccggacctgaaggggaaggcgtacgagggcggcatcatcacgtcgatgcacaaggtggagacctccggcgccggcgcgccgcaccgtgccatcctcgagacgccgatgatggccgtggccgccacggggacgcagatgccctggctgtccgggcgagactcgaaggagcggatgctccggttcgcccggacggtgcacatcttctccctggtcagggaccgcgggtcggggacggtgcacggcgagcggcgtgtcgcgtaccgcctcgacgcggcggacagggaggacatccgcgacggcttgcggcgcgcgctgcgggtcctcgtcgcggcgggcgcggcggaggtgggcacgcaccggagcgacgggcagcggctgcggtgcgaggggctgaccgaggaggcgctggaggagttcctcgacggcgtcaccgtggtgcgcgggccgcagtcgaggagcgagacgtggggcctcttctgctcggcgcaccacatgggcagctgccggatgggcgccacggcgggcgacggcgccgtcgacgcccgcggcgagagctgggaggcggagcggctgtacgtgtgcgacggcagcgtgctgcccaccgcggtgggcgtcaaccccatgatcaccatacagtccgtagcgtattgccttgcaaatggcatcgccgactccctgtccgctaaaacgacttaattagctcctatcgtatcttctactacaaaattcatccattccagtccattccagaacatcacagcttgcaaattcgattagtacgttttagcgtatatgattgttacgaggaccagaataatgtgcatgattcttgtcgtgtgaagttatggattatctgtaattatctctataaaaaggaaaaaataaacaccgcaatgaaaatgcttcctgcatactttattcagtctagaattcgtcgctcttgcacatatcttttcattacattagagatgcacagtactcacaataagtactagttaaattgagcacagttggagaatagagtgaccgtcgacccaggatgtagagggacgtggaacgaacctgcgctgcactgcacatatgctatcagaaacaaattaaaccatgcgtgtgtgtttaaatgtgttgatggcgcacgggcattttcgaccgggagatatggcaatgctcttgactcagcatttcagaagaggcgtcaacgccagaacattcatgcatgaagcgacaggtgctgtgcaagcagcagttgagtgctccgtctttagccaccactttgcctacccggatggtattgccctccatattactgctgcatacgtctattgataggtgatgccattaatttttaatatatgtttaatcatttatcttatttaaaaatttcatataaatacgtaagacataaatattagtaagaaatttttagtgataaaacaactcataataaaataaatgatagttatatgttttttttaaataagatgaacgattaaatatatttaaaagtcaacagtgtcatcaattaaaaatgtgaagatgacactgctagtttggctcgtggtttcggctatactcaattgtcaactttgctttgtaaaagtttagtggtttcctcttttgtcacaggtgggacgtggatgggatgatactgcaccagtgtaacgatgttatgatagcattaatgtgcatttccaaagaaaaaaaagttggagtgaattaggagcttccgtttcgaaaattctcttcgtgacttcgcgacgaacttgtcatttaatgctgatatttgcacacgtaggtgcaatatttttcatcgaaataaaaaaaagcatcaaaataatcagtaattctatgtgtttaatctagcattgctgcagatgtgcagtattaggcaaaagaacacgacaggatgtgcattgcccttccataattccatttggtcagcatcatatcttctcagtagtttacatcaaaattcatgattattccttcatgattctaacagctattcccagtagtagtttacatcaaaattcatgattattcattcatgattctaacagctattcgtactagtttacatcaaaacagtgcaacacaaatgacatttcactacgagcgccgaatacaagttggtgatggcgaaagaatttagtactagccttcaagttacaatgaatctacaactgtactgtaggcaaatacatttgttagatgcctgggcctctacatcaactttagtcctagcttatccgagtcctctattgtcgaatgtcaactgcataattgaatgaagaagctcaagtaccaaattttagggaaatgcacacccaaaccgttcagataatcgatcaattttgttcacgatcaggcataataaaattacgcagaagcaaatttaagaaaaatgcacaccgcaaacagtccagataactgatcaattttgttcacgatcgcgagaggaaggcgtaataaatcaaagtatgccaaactacgggcacaagccacacaggtgctctgtgacatatgtaatacaaagtgactacaccttcagcttgatttccggcacaatgtagtgcacagttcagcatcaaaagaagggttagttggcatcatagcattagctagcgtccaataccatttcagtattagaacagaacaatatgatcataacacgtcatcataacctatagccaagatgttacagactttacaatcagttatcgcgcatatgcaaagtgtaaagccgtactctcttgctcaaggcaaaaacagataaactccactttaactttggcaaaaagaagtggttgctcagtttggtgccgacagaggtttattaacagtagaccaaaatgtttctaggggaaatcaagccaaaataattccacttcaaaaggatttggggttcccaacttcagacccctgaaatatgtcatgagcaccgctcatcttgtgccagcaaaaaataaacttgatgttggtatactacaaatagttaattatttgacagatgcttttacagctttctcagccgcatcatcaagatcctctgcagtgattaaggtcattccactttcctgcaacaggacatcacagtcaggtacgaaagtttccagtgaaggacgacttggcagatattcctacaaaaaaagaatgcatgcaagtaatttttacctttagaatcctcttcccttggtcaacattggtgccttccaaccgaacaacaacaggcaccttcaggtcaacctggcggtcaagagaatgattcaatacagtgcaggaaagttttatattgtacattaaccagcaagataatctaaattgtcccgcaaaaaacaaaaatataaaatcatcaatccaaggaaataactgtgtcattacattcccaagaaacagtaattgttaaaagaatatttctcaaacaaatacaagagaaaatgttgtggaacagacaagattccacaagaaattgtcatagggttaatctcaaatgttttatacttgatgcaataccagtagtactttcataaagaaaagaaattgttctgaaaaatttaatagaaaactatctcataagaaacttccacatttaatggaaaaggttaccatggaataagaaagattcaataggtatattgtaatttattaatttgaagcaagagggaaccacaataagctgctttagtcattaaatgaaaactacatacaaaatttgaagacaaacctgttttgctgcattcactattccacttgctatcacatcacatttcatgataccaccaaaaatgttcactagaatagccttcactctatcatcggaagtcaaaatcttaaatgcttccacaacctgaatacaagttatataaaaagtttataaatgaccaaactgggaagcataacatgcaaaaacaaaataacaatttagcatggattccaacaaacagattatcagttatatgaaaatcttttaggctgtgttcaggaggaggggttcggttgggaacccctcttccccggcacgcaaaacaaagctcatattattgcatgattaattaagtattaactattttttaaaaaaaatggattaatatgattttttttaaaacaactttcatatagaaagtttttgcataaatcacaccatttagcagtttgaaaagtgtgcgcgcggaaaacgagagaggtggattgggaaaatgggggggaagaacacagccttagtggcgcgattcacatgagatggtagttacaaaaagaattctcagcttattatacctgtccctctgatgcacttccaccaacatcaagaaaattggcaggcgtacccccatgcaacttaatgatgtccattgtagccattgccaatcctgcaccgttcaccatgcagccaatttctccatcaagcccaatgtagttcaagtcagctttggcagcagccacctgtaaaggtattagagataaactcataaatatcttcagtttccattctcagaacaacaaaagctgtaacatccctccagaggcaagtcaagccatcctccaaaagaaggggtaaatgaaaaaaaaaatacatagatagagataaaggaacacacagactacaagagaaagtgaataaaggaaatggcaagcagtaatatacctctctgggatcttcctgtgttgtgtcacgcatggcaaatatctctttctgcctaaaggcagcattgtcatcaaagttcaactttgcatcagcagcgaccagcttgttgtcagctgtctcagcaagaggattaatctacccacataacatgtccaaattagtcataaccagtgcagtggtaaagcgggccattccaaatgagataccatttgttattgattacctcgagcagtgtgcaatcagacttgcagaacagttcatagagcttcttaatctgttctatggaagactgtctgtcagctgtctttggtgccagaccatcaacaactttagctgcatcatcatctgtgattcccttgaatacatcaataggaacctggcaatccagagcattgcatttcaatgtatgatcgatttcattagaaacaattaaaaaaatgcagaagcacacaatgctgttgccaacagagggatattgattagaggcaatagatttaccttgatgatcatatcagggtacttctctgcaagatcttcaatactggttcctcccttgctgcacgctataatgagctgaaaatgagtgaaaatcagttagtctacagcaagaagtcaagaacccctatctgaaataggggaacatgcatattaactacctaatggtttaattctttaagtaattcaggcacaagcaaaaaaagaaaacaaaatgatagcaaaaaaggatttataaaaacaattatgatgcgtctaaattcagaagtgagcacaaaagtaatcctactcgaaggattgattacatcattcccatgtataatttataattataccaaaaccaatacaaaatatttttgagaaaaaaaacaatacaaaagtggaaaataattattggttcacagccttagaatgcttgacctttacaaagatgcttagtgacacagctactgcatgcaattatctgttactaattgtgaagcccattatccgttgactaaagatttatgtgaaccttcatcagctcatgcacactttgttagtttatggtattgaaaaaattaataaaataaacaagtacacatggttgcaaaacaacaacaaactgttattcttgtggaaaattgatccatattttagtacttaccactccttaacatagtctcataaattatcagaatctaggttacaagaaatactgaatctagatggaaaagtgtgcaataccaagcttccttaatttattcaaataatagaacaaaactcagtaaataaaaagagaaaaatgagcaatacaaaaaaattgcttgtgttcaaagacataccggaccagcagtattcctgtcaagggtgatggcgaagtacatctcattaacaagtgacagtttctcacataagtagacctgtcaaaacacaaatcaacgaatttagtacttgacaattttcagtgatttgagcagaaacatagagcattaaaaagtgtgactcttgctttgaaagataaggtagtgaaagacgcagaacttatggacagtcgcatgacaacctgtgtaagcctctttctacatgaaattgcatctaaatttgcattcaaaaaagtaataactacaagatccactatgattagactgaaaaaagaatcaagggaaacaatcattgccacagcatgcaccaaaaaaggcactccgtatagtgtaatggcttcttccaattattccatttatttctcatatggaagtacattaaacggcattggatttacaagttcaatactgttttgggcgaacacagtcatatgctaaagcttaaccttctacatatttgcaacaaaaaaaatatagtgataaaaagctttcttactaaagaatcaataatcaagcaaacacaacaacagtactttctaacaatgctggaaacaccaaatgaaactgtggtagcaaaacaaaatggcaagctgattgcagttcaaattggaatatagatgctgaagggggctacatattactaaaaactaaccttgctcacaatcttcccctgtggaccagtttgttttgttaccagaatctggccaagcatttttgctgcagaggagataacataaacacttaaaagtaggagtacatacacaaataacatgtatagtatacaacttaattgaatgactacgaagaaaagaattgaatgactatgaagaaaagagagcattgcatgtcacttaaaaggccattcacttcaaatcataaggcatcgaggcagtcaaactcagaaccaaaacaacaaataaccaaatcttaagttggtgagaaaggtaaggaactaattaatcaattgaaggaataaatcacctatcatatatggatttattcaaatctgaaggtagtatcaaggatgtcagacttcatacaataagattatctttacttgcatatttcattataacacatgtaattgccaaaaccaaataatagcaataaattgcattggaggttactgtgtagactgtgaagctagactagtgtgcatggaacagttatgtataaacttctaaatcagctgcccattatcatctgaagcaacaaacaactgaagcacatactgggagaaacttgtcaagctgctgttcaatatattcgtaagtctctgacattaactcgtacctgcgaggctttcagcttcctctgccttaacaatatgaacaccaccctgcagtccacttttgaatgttcccaatccacggccaccagccaggatttgactcttaacaactatctgcagttgtgtcatgttttgagtatggctgaattgaaccacaaaatgattcatgcaataatacatagatctaccctacaaagtaggctagggacaacaatcagctagatttgattttggagtaggccagcctaccatctactgactcatctttatagttttacggaataacaaacattttgaagcggaataccccaatactatcttgtgataagcaaaaggtttccccttaaccaagttaagggcttacaagccacattgactataaaccttggcaatattttcctagaagatatgattattttaaagagaccacatgtgggtgtataatctttgaaaaggagaaaaaaaaagtttatatgcagtcctatgactaaacagcattgaaaaattactcaaaacaccaataatagtgtcataccagagtagctaagactaattacaagtaatgttactttccaggcaccaacagtgatgtatttcacccattcgtattatatgaaactatatcccgtatactacagcaaccactaacctcccctctggagaaaaactggtcaggccatcagcagaaattgcagtaaactacattctctatatacatcctaataccatcaaataactgccacaaccaagtctcaaattggccgcacaagcaataaagaataaggaacggaaacatcacctctttctcactagggaagacgttcttcaaggtgtttttgacctccttcaccgatcccgccgccgcgcccctgggcacgttgatcccgtacttccccatcagctccgcgccctgcgatacccacacatccacgaaccctagcgcgttagcccaggcccctaaatcgaagactccaaaaaaaaacccgcaaaaatcgaacggaatatggtgcgggaatctgcgggatctggtggagggggttgcaagagcacctggtactcgtggatgttgaggcggcggagctgctggtgctgccatttcccggcgacggagagggcgcgcgaggccagcttcccgagcgatccgcgaaccatggctgcggcggcgtggggggctctctcctccgatccggaaaccctacaagcgtggagggatggcacgcgtggtctttcgctgttcctctctctctatatgcgggtttgatttttcactcggttttttctctcgtcttcttttcccttttctttcttgcgagagggtgcggcggcggcgtaggagaggaagagggaccagacgccggcgcgtttgactgacatgtaggatcacgacagtttcactgacatgtgggtcccagaactgtggggtccatatgtcattgtcagatgaatgtagggcgcggttgctcaggtatagaggcacttgtgcttcgagcctttgatacacttttcatgggcctaagcggcctaactggtatccctgctgtatgggctggacaggtccagataagctctaagatgaaatgttgttgggctggcctaaatctgtgatttacacacatttaggcagtggccagtttagcccacacagcccagtgcaggaaagtggcactgggaggcacatgcaatgcaagtaatcaaacacgccccaatttgtattcggggagtttaaaattttgagaaacaattagttggtagctaacttccaagaatatggagaaggtgggttttccaacttctagctcctagtttgttttctagattttacaactgtagcttctcagaatttaaacgaaaagctagattatttgagggagcttctgatgctgggataagctgcacctaccggaaactcccccaaataggtcccaagagtcctagaccaccgcggctttacatgttgtaagcacaggtcgttggtattctgatacatatcttattcgtagatatgccaacccaaaacgatggaaatcccatcatttatcttaattttcatagcatcacgaacagcataagagtttaatatgatctcactagattggtaggaccttacataagatctcgaccctacgattctacataagcatcttttaaatttcatgtgtgttgaaaataacgtgaataagcctactgagatttaaaaaaatactatctctgtttcatatcatatgtcgttttgatttttttcaaacttctttaagtttaaccaagtttctagaaaaatatagcaatattttgaacacaaaacaaatgtattatcaaaatatattaaatattggttttgatgagacttggtgttgtagacattgctgttttttataaacttaatcaaacttaaagaagctttaatagaaaaaaatatatcaaagtaacttataatatgaaatgcattgagtaccaattaaatttatcaaaattaatactagagacttcaaattttaaaacatgttacaaaatttatataaaaaatatgtaccttataaaaatctgatagatcccaagcctacaatattatttgaaatagaatgatccaacctaatattccgatcctaacaacctcgcaaacacatttgggatgtccggatgtagtcgtcttggtatgtttgcggtagctgatagctaaatgataacttggatgtaccgtgtactccttacgcggttacgccccaaaataaaccaacttcttctcctaaaataaagcaactatactttcttagaagtacctactattggttcataactatataaattctattccttcaatacctctcacctatccatccagtaatataacttctctattaattagaggcatttaagtctattgtattgctccttaaatatatcttgaaaagatgggatttgaattttttggaccaaaggagtttttgagatttgtttccgtactttcatttacattgaaaaacacatggaagaaaaaacgtggaaatttactcaagaaaccgtacaacttttgttccttttgctcagcaaagaaactgctgtaattaggatgaatacacccaagccagtatacctgtttggcaattggaactcggcaaatgcatggtagttcagactagcaccaatcaaattattctagagttggcatggccacgattgcaagctatcttcgcaagaaagaaaacgaaaatgttcgtgtcaaaagtgaggtttaacttaattggttttttattgtagaacctgcgatagatttaagttctaaatttagtatgagtgctcatatttacgactaattatttttcagtgatacaaggtatacccatcgacaacgagtcgctcataataatttcgtcaatttcaaaatatactggaacagtttctcatagatgcccctaaagataagatgtgtgtatttataaagatgtgtgcgagcccccttatctgtaccctattttttagaaaaaatgttagtgaaaaaaaaaacaaaatgtttactcataccatttgccaccttggcgggtaaacgattgtccatatgtttcccaagtcccgccacgtagcacggcccacaaaaaggcccaaatccgaaccacaataaacccaggtcaatgaccattataccctcgcacctaagccagaactacatacctatctttacacggctgcctcactacatcccctcacgatggcaataccgaagtttcaaccaaatccgatggctaaccctagcaaacccgtgcataaatacaccacccaagccgctcctccccgcccgcctcttcatttcccctcctccctcccctttgccccgccctctcgtccggccgtttcgtggccgtttccgtgggtcccatccacttgtcctcccgtgcaatttacgaaattgcccctatcatcttcgggtggtccccacactccacgactttctcttgccccctcccttttctccctccctttgtttattccccaatcgctatcgccgagcgattccgtctcgtctcgtctcgtctcgccgctgctctgctggcgtggcggcacgggggccgtcgagatgtcgatctgcgcgagggcggagccgccacgtggcggcgggacgctcggcaagcggaaggagcgggaccgcccgtcgtcggaggagcagcgggcgccgccaccgccgccgccgcctctgttcccggcgatgtccgctaggccccagccgcccaggccggctcaccccgctcggttcgtcaagcccatgccaccgccgccgccgccattccc

SEQ ID NO: 13267 - DNA, 10285 bp, Oryza sativa
caatcaatcaatccagccctgccctcctttcggtttcgggatcccctttccccgctttccctgatgcgagaccgaattcctcctccccatccggatccggctggtcaccgttgtgcgtgcgtctagtcggagatcagcacggcgaaaaaaaaaacccgtgtgatttttaatcgagaatttcgacgacgccatgcgtgcaccgtgcagcgtgctgcgccgccgcctgtgccgtgcggaaacggccgtgcaagctcctgcaggccaaacaggccgcggcccgtcacaggcgacaagtcaggcctgccactgcgataccgacaccaaagtatatatgtgctcccgtaacacgtcgttttgttttttttttgtcaaagtttaactgctaatttccatttttatactactccaagtaacattatttttgtgtaataaggaatgtttagtgcttgttgggtggcgcaagattattcacaccgcacgccaggcagggcgcaatcgtgtcaggaaaggccacggaacattatttttcggcccaaccgatggcggcggcgggcacctcctcctcctcctcatcatcagatcacctctcgagcacggcgcaccacctcatcggccccgtactcccccgtcccgttccttcgttccgattcggtccttcgcctccaaggctccaagccacccgcgacctcgagcttcccttctctctctctctctctctctttctctctcgcggcctcgcgtccgcctgcctcctcgcgacaccgcccgttccgttcgagggggggcgaagccgggtgggagggggaagaggatggcctccgaggacggctgcggcggcggcaacccgccgggggacgcagcggccgcgccgccggtgtggaacgccgcacctgcggcgggagctggctgcggcgatctggaggaggacctccggttccagtgctgcgtctgcctgtgagttacgccgcgtcttctctctgttttttttttctccgcccatgttgtagtgacctttgccggcgtatgagcagacgatcccctttcgttgattggacgttcgtgctgcgtgattacgcgccctcgcttttgatccagtgcaattcgccgcttattttcgtcgttgatattttcttttttgcatcgattttatgctctatacattgcgccgtccctaaatttttgcgtagtgatattaagcttagatattgttaatgtaagatctccatctaggaataccggtgacgaattgtagccataatttgctctaggtgacgggaaaagcaattgttgagctcgacatcttgcaacatttaggggaacatctaaataggtttagatcatgctctagacctttgatggcggagggcctgcaacagtctgttttgttgccatttgtctaaactgcgttttacattggccttctcttgtaaatgctgaaaaggcacattgtcttgctgtagtttttttttactttgactggttttgaatctctggtcattgtgttaattcgcaaatgatggcatttaaagaaagcacagatatcttatgtagttgttcaatctttcttgcagggagcttctgtacaaaccagttgttattggtaagagtttgctgttcatgctaacataaagagcaacctgattgcatagtatatattttttgaaatctcatttatcaattactggtgcagcatgtggacatatgtcatgtttctggtgcgtccacaatgctatgcatatcatcagggagtctcattgtgctgtctgtaggcagccttataaacattttcctagtatctgtcaactcctccatcacttgcttataaagcttgaacctgtggaatacaaaagaagggaaaaagaggtactaggtaagtatccaaaatccaaaccattaaacctctttcataatataaacaatactgttcatagaaatgtttgtatttcttgcgaagtatggatactgcatgtattgtgttttgcatatgaataccccgtcaatttcgatgctcttgcagatctagttcaattttttgggggtcatgtttggattgttatagaagcatttatatttcaaaattattttgcgactgcatctaaagtgctagaacacaaccagttctactgagcaataatgcaatttcataatttgaattcaaattcatcaaatccaaattgattggggtcatcagggcagaagggaatgtgatggtgtattcatgtagagggtgaggttgttatggcatcgatggtataggttcctagttggctgtgcaaacatggatgtcagaggatgttgctggcaatatggggatagggatttgtaagttttgggtgagatcattggatgaggaggatattggtgaatacattgccttagagtttgtgtttaatggatattgaaagtgtagaaaaagttcacaatcttatgctgaacaacacagagttttttcgctttgcagttaccatgacagttcttaaatttcacaattcacactatatggatgagtccatccagttttacgttttggcttattttttgtagcaccagagtttcaagaattacagcacgcttaacaaaccaaacatggtttcctcttccaatagctgtttgcctgatttcagtaattagcacgtcctatttttctgcaagttcttactgatgctcttcttttggtttcgactcagaggatgagaagcgtgtggatacatattctccacaaatcattgagtttttaaactccaagagcaacaattgtggtaagaattgtgccatacaactgcaatgatatttgtctcagctctcaagtttgcctgaacttataagatgtgctaccttctgcaagaaattgatggggagaatagacctgaagaaagtaatagtcgacctccacaagaagttacatctgatggcaacactatcaatgggcatccgaagaaagttaagctggaggacgtgtcatgtgctctttgtaaggagctgttgtatcaacctgctgttcttaattgtggtcatggtaagatttaaagctagaataaaaaatgttacgtattgcgctaattgtctcacatactgacttacctttatttatgaaaagtgtactgcatgtcctgtttgtcgtccttggatgatggtgcactcaaatgccaagtttgtggaggtcttcatccaggagattttcctaatgtttgcttggatttggaccattttatcgaagactattttccagcagaatatgacttaagacgagagaagattaagcttttgaagggtgaatgcaatcaaggatcatcttcaggtaagcttatctcacatggtgtattttcttatataccatactgatacagcatattaaaattaaggaaaagatcctattatttttttagaagtaattttctaaccatagggcgatgttgcttatgtgaagtatttctagtatatggtgtagcattatcttctgcatgaagagattggcgtttagaacaagattcagtcaaacttttgaaactttccccatcaataacttttaaaatgcttagcttattttttttaaaagttatgtgaagatttaccctgaaaatcactatgataatatcatcaacttattagaatttataaatttatttccaatataaaattgtgaaagctgtactttgaggactgtaaaaaagtcaaaagtcatgtatgctttgaccgaagggagttactatcttactggtaacaatgagtattatatatttatatgccatagccactatgatttatcctatgatgtgaaatgcgtagatgaatattagcaatagtttgtagaaattaaccacaagattttatactaccccagttacaggtcagtaggccacaaccagtgatacagcactggaagagtgagaggaaccagcttgctgctttctgggacagtcataggaagttggtttcgatctactataattctctacgatactgggctagttctttcaattgtctgaaaagatagcatggataatttgcctttcctgttttgctattggttatggaaagtttgggcacgagttatgaaagtgatatctttgtaaatacgtataactttcgaaaggaataccataactgatttcttctttcatggctaactgtttttttttgtggtgtggttaggtacttcatgcataaaagaaggcaggggtagaccaacaaataaggaaaaccgtgcacatcaggatgatgacttgtcagatgttcatattggggttggatgcgattcatgcggggtatgcacaagttgtgaactttttaagatttggtgaacatacatccaatggataaactgttctagtcgcctagtaatatccaccatgcagcccaaatagtgatttttggttactggtagtactttgggttcactcagtgccagaaaaaaaatgatttcgtctcttaaattattcacactaagttgttgcaatctccatattctatcttgtgatcactttgatgggaacacattttcaaattttatttaagttattagtacttaattcaagtgtagatttgtgttggaaaattagaaatttgtttgcaagacgaggtttacataagttatgtgtccagttgtttagtgttctctagcctttctggttttaaaccttctaatgtactcccaccgtcccttaatataagggaatttggagagatgtgacatccgtccaaaatctcttatattttgggacggagggaatattgttttacacaaaaaggaagccttaaatattttataaggtacatttgtatcatgcctttattctcacttctctgctaatatgaaattgacgaatgcattgcagatgtatccaatacgagggaagaggtacaaatgtaaggactgcactgaattaattggatttgacctctgcgaagaatgctacaatacaaaatcgaaacttccaggccggtttaatcagcatcatacccctgaccacaggatggaacttgatcattcagcactcttcaataggttgatgaggctacaagggatacacgaggagggcccaggagagataatcatagaaggtgcatttgttgctcctgacgctgtggtgcatataatagcagatgatcatgaggaaatcgaggataacggtgaggatgatcacttgctctagaaacgaatcagtggtattaaacctgaatttcggcattgtcctttctttaatgtggaggaggctacatgaatcatgaatggtactgtatgaaatggagggattgaacaaagcttgtaggcgtgtaacgcccatagccccttacttcaatctaatgggaaacatcttatttctgcttttgtaatctacatttatattcttgttaatggaaatacgaatgagaaaagaacggcaccaggtacagcgtatcacaattcacaactgcacaagcgaagaagcatcctgtagttattaatgttttgtaataaataccttttgttttataaatcttcttttgcacgtctagaagcctggtaagctcttttccttgaggctccagacttcaacaaaagggggtgtttagatctagtggtgtaaaattttggcgtgtcacgtcggatattatataggtgtcacatgaggttttcgggtatttatgaaaaaaaactaattacaaaatccgtcagtaaaccgcaagacgaatttattaagtctaattaatccgccattagcaaatgtttactgtagcaccacattattaaatcatggagtaattaagctcaaaagattccacaaattagtcacaatctatgcaattagtattttttttaagcttatatttaatagttaatacaggtgttcaaacgttcaatgtgatagggtgtaaaatttttctgtgggatttaaacatgaccaaaatagaatgtgcaatctcgtccctccgtcgcgagcggatttggatcggcttaaacagtaacagtgtatgtcattggatgtaaattgggcgtgccagattgcatactgtactgtacaaagtactgtagcatgaagtactgtagccgttgttactgtagcattcgatctgagccgttgatcataaaaacggacaaccaaatttgcgtgcagttgttatctcgcggttgcaactttcatgtataactgcacctcatcccaattcgtcgcgagcagctccaggatcacggcgtaaacccaggagcggagccccaccggcacggcgatcaaagtgccgctgctgcatgggcctcccccctccccctcctctcccaccaggaacaacgacgccgcgtgccccttgatcgccacgacccagagctgtgcggtcgtgtggagtgtggacgaactggcctcgggctgattacgtagttccgtgccgtgcgctttcgtttttcatgactacgattatgcttctgcatccgcttgcgcgtggagccgtgcacgcgcgagtgagcgacacggcaaggcaacgaggcaaaggcatagagcacgcgaatgggggtgggtgagtggcgaggccctgacgggagagagaagccacgggaaatgaggtacgctgcgtacgcaacgcgcggggggcgtagtggttgggccgtgtcttcatccagcggttgggccaggtttcagctttgaatcctgcgcgcaaagggggagagcaaggaacaagtccatttcaactctgaaatataggttcaatctaatttgtatcactcaacatcaatatcaaatgttaactccctaaccaataaaatcagtccaatttaactccctcggctatttttgcgggcggtttttgttgatgtggctcattgacctagtctaaccagctgagtcagggggcccatatgttagtgactatttttcttcacctctttctttttctcttccttctcttttacccatcaatgcaattgggttgctggtgagcgagtcccctcgaccaatgcccccgacacggcactctgtggcaccgagctcgttagatctagcccgaggctcgtcagatctagatttgagaggcggcggcggcgacaacatgagtacttcctcgagcgtgcaaggccactccaacaagggtggctcgtcagatcaaactaaagatcgatggtggcaaagacggaggaagctcgacagcggcagtggagaaagttcaggaggggactggtgcttcacatcttaagggcacgacttccccgactcctcgacacgatttcgaccgttgcctcatgcatcatgggccttcatcctaataagacttatgtgttcttatagaggcgcaacccatactaacgtgaatgaagatcttcaaattagctatgtgaggccaaacttcacctcaccgtacactgtgaatggccttactgaaccttcggaatgaaaaagattataaggaagtggacctccaccattatatcagcaaggagaaacttttgatggtatttgtttataatgaagatgaatacgaagttaggatacacaaaacaagaaaatcattagcgcatgattagttgaattttaattattgtaaactttaaatgactttattaaaaaataaattcatttaatatttttaaaacaacacctatatagaaaatttttggcataaaatataccgattagcaatttaaaagatgggctaacgaaagtcgaataaaatatgtaattttaacagagatgaacaccgccaatgagggattttgtaccggtggaaaggaaaattcttcctttctctctctctctatctccgcgggaaaaatctctcgtgtgccttttcattattctaagtttgactagcatgatactagtagcaactaacgcttctcttttcaactccatggcatcacaagctggctagttgctgctggccagtgtatcgccgcgccgcgaaatagacgaacctacagggtgtgtttggttttgcttgcaccattctagcctggtccgtatgttccatccaggcttaccctagcctggataggtgggtgcaaatagggttgttaggttggttgtacgagttaagttggttgattgtacgcgcaaattaatcctgtatacaagagatattatttggtttggtgtatgaggttagaatatggttacctcctcttttgtatggtaagattaccccttgcaattttagtgtaccattcaattgtagttatagtactattcaatcagccaaattttgttaaaatctgttgcatatgtaatgggtgaattggtataaagaattataaaaaaaataaatggtgccaacgatcaataattcgccgctttatatacgctataacaggtgagggaaaaaaataaaaagaaagaaaagaaaaaaaatgtgcatctcgttctcgtcgatgtcatcctcccgccgccgcactaatcgttgctgcaccggtcgccgtcctccacccgctgcgctggtcatcgccgcagccctcctccgcaccggtcgttgtcgtcctccacccgctatgctggctgccaccgtcctccactcgctgcgctggtcatcgccgcaaccctcctcctccgcaccggtcgtcgtcgtcctccacccgctgcgccggtcactggtcgtcgctgtcctccacccgctctgctggctgccaccgtcctccactcgctgcgctggtcaccgctgcagccccctctctttccccactgctcgctaccggctaccctcccggatctggtggccggcggcggaagaaggtgcgggacggcgacgattgaagacggtggccagggattgaagagctcatcgtcgttctctccgtcgagctcgtcgccaaaccatcgcctctggcttcgctctctgtctaggtatgaggaggggggggagaaatgaggacggggcggtgactccatcgcaagctgttgcgtgctcggtcccgactccctattaggaatgcaagtgggtagtcccgctatccgtataaaaacccgtttgctagtttatttttcacgtggtagtataaaatttagaagaaaaaataaactagaagtgagataagcgggctaaaaaaacccgcttacccgctccacttacatccctactcctaacacgtcgccgtgtatagtttgtatacatacccgggacgaggcaggcaccgggcgtcggcaagcgcgtcctgcgtgaccgaccggaagaaactttttcagttgttgcaaccgctagctctcgcgcctttgcctgccttgttgcctcatgcgcgcgccgcaacgcaagagtgaaacacggaggccgccgcgcccgcgttatggcgtaaccgcgccgcagtataccgcattaaggtgctgagtcatccccgtactgtacctgtttctctctctctttttttgacgcatcaatgcgccctctgcatgcatgcatgcatgcctgcctgattggagcccctgtccttggctgcagtagtgacagtggccacagacgatgaccttgtggcttgtgctgattctgaccgtctcgattgaatgacgactactcaaagacacagacacccacaccatgagagaggcacaggaaagagaggcgtgtgcgtctccatatgcgcttcacgcctctctcacggcctccctcaacacgggtataaaaggcgaagcagtgggtagtgctaggttgggttggtgcttggctagccacggtattattgcgtgaaagagggggaggtgaggacgtgaggtgaggtgaggtgaggcagagtgaccacagcgacggcagcgtagccatggcgaccaggccgggccctttgaccgaatggccgtggcataggctggggaacttcaaggtacacgcccaaattctcaccttctgatttctgagcgaagaaaacatgttcatcctttttccttgctcccccgttcgttcctcttgatgaacttcaacagatgcagttgtttgcatacagtgaatggccagccaaatccaaaccttaaaattgcacatcccagtacatgcatgcagtttcctaaaaaagatgattatattctcggctagtagctttgtttgacatgcatggcatggggtggcatgcgcagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggatcgagttcgaccaggtcgaccgcgagcgaggctggtcagtcacctcaacacgcacacgcacaacgggctgcaggaat

SEQ ID NO: 13268 - DNA, 3587 bp, Oryza sativa
gtgcacacgggccccgtcgagttcctctactactggttccaccgcgcgctgcaccaccacttcctctactcccgctaccactcccaccaccacgcctccatcgtcaccgagcccatcacctgtaagccacacgacttaaaggctgtgtttctttactcaatattctcaactccatcctacttgtttttccacgcgcacgcttctcaatctattaaacaatgcttttttataaaaagttttctatagaaaagctttttttaaaaaatcacattaatctgtttttttaaaaaaataattagccctaatttatcatttgctaataagtggctttgttttacatgcatcagtcatgagttcacacaactcatagcagctcatctcacttcgttagtttttgtttaatgccttatcatctcatgggtgttcatttaattaacttgttagtaccgtaccgtgtctcactgttcagtctaataattgttatatatagttgattgcgttcttagattaatgaagtgcgcagatcataaatagtaagcacaaagtggccgatattgactcctctcgtttgtttaatttcatgaaaaaactttttgtcacttgccggagatgccatgccctacattcctagtatgttctcgagttaaaatatgatgaagtagcagttgcactcctcggaataacacattcttagataattaaagaattcgtcgtagctaagaacaacacacatgaaagtaaagaatgaccagcaggatgcaggaatcgaattgaagacactgtacggagtattaatttcagaccaacagctcatcttctaccagaaaaaaaaaatcacaaatgttctgccaacatcatttatgttctctgatccatgaacagtaccacagtatctttttttttttttgcaatgcaccttttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaaggccgtgtttagattcaaacttttttttttcaaacttgcaattttttcgtcacatcaaatgtttgtatatatacatagaacattaaatgtggacgaaaaaaaaccaattgcacagtttacatgtaaatcgcgagacgaatcttttgagcctaattacgccatgatttgacaatgtggtgctacagtcagcatttgctaatgatggattaattaggcttaatagtttcgtctcgtagtttaaggcggaatctgtaatttgttttgttattagtctacgtttaatacttcaaatgtgtgtccgtatacttcaaaaattttgtcacacgaactaaacacaacctaagtagaatacttcttccgtccttcaatgacttttttttaaacaaagttaacaaattagtaataagggtaaaagatcgaagtgctcctcattaataagaaagtagtattgttagtgatagttaggggtattgaagggatacaaaatcttaattcacggacggagggtaggtaagaaagttaaaataagtcttttatgggcaaggttgaaagactagaaatgaaatccctttaggacaaagggagtagtttttatcaaacgttggcaaatacaggtcctacaagtagaacaattcgaaagggattgatcgactattatagttgctttctaagtaaaagaaaagatcatatatctgggaggaggctattacctgaaattgaacgaggtgttttagctataaaacatcagtgtgatgttcatgcataggtcctgttgtttttttataaagcacatatataagagtatgtacctaccctgttaatgcacaattactattggcacttacaacgattttatacattgcagctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgtaagtgcaacactcttctctcatgtatctatcatagaaatgtattaccaacgtgatgacagattggatcactgaattcacataacttgaagttcagcctcgtgagttcataaacccaatgctaacaaacaaatgctatttccttctgcaggttccattctcttcatcatacgcagttccgcacaaactactcgctattcatgccattttatgactacatatataacaccatggacaagtcatctgacgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcattaccaagatacaacttccaagtaatcacttcccctcgcttatgcatttctaaattcaaaggtatggattatggaagatactaactgttctggttttgcactctgcagtatggccttacgtgggagagagaaccaatcaacgacttaattgaaaaggcaatattggatgctgatatgaaaggggttaaagtgattagtctaggactactgaatcaggtgtggagttcttacctttaaagctcgtgtaatgagaatcaaattaatagtttaatggcatggtaaaggttgaaagtagcatgataaaacgtgccaaaaataaacaataacaagaaaatctcatggacatgtcctctgtttcatgttaaaaatgtgattagttgaa

SEQ ID NO: 13269 - DNA, 3172 bp, Oryza sativa
attctcaaattgcttttagagtgtgtataatcctgaatcatcatgagaactgagcatttttttcccctgtttcctcttcaggcaaagcagctcaatggaaacggtgaactatttagacagaagtatccaaaattaggagttcgaattatcgacggaagtggcttagctactgcagtggtgctaaaaagtattccttcagatgcaaagaaagtttttcttcgtacaggcacttctaagatagctcgtgccattgccattgcactatgtgacagaggtgtccaggtataatctatatatcaatttgcaaatcatcgttgtcttgaatatattttggttaatttttctcataatttttgccttaaattgcattacattaatctggatcaggtgatcatgaatgaaaaggaggtataccacatgctcaagtcacaaataccagagaacagggcaagctatttgaaactctcgagcgacaacgtacctcaggtaaaaaaattgttgcaagaaatggtgacaaactctcaagcaacatgatgcacctgtagactcttctactagtaatgttaaaatgtagcttatagactcttctacaagtaatgttaaaatgcagcttatattcatgctaatacttcatgttattgcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaatatccactcctgcgaggtaatacagatatgttatctgctttgttaatctgaaaatatacgacatcaaagaacctcttcttaatagtgctactacctttgtggtcagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagcaacggcataatccattcattatctagcttgggaaccagatggattattcacttattatcttactatgtttgtaatactgagcttgggtactgataagtcatgaggaggcacagtgcaaacgaacttaattccaatagctcagtattttataatctatagtctatgtcagttctgtaacattacgtttatctcttatttgaatcttgtgggggaataattaaaataataggcaatgttttcttgtttagacttcgcaaagtaaaacctgactgatcgcacggtcagtgctcttgagacgagacaaacaagaccaggtaaagctaagcttactcgctggctcgctgctactatcgttttagccttcccttaaagtttgattcgacactgtaaaattcgcccatgacgctctgcacaaaatctttgaaactagtggcaacacagcaaaatcagatgcatcactggcttcacacttctaaggctgtgttctttcctgggtgatctgggtgattgtgagtgagtttgtttcgttttccgcacgcacatttcccgaactatacggtgtgttttcttttgcaaaaaaaatttatagaaaagttgctttaaaaatcatattaatctatttttaaaatttaaaatagttaatagtcaattaatcatttgctaatggctcacctcgttttgcgtatattcccaatctcctcgatttcctctccactatcgtttggtttgaaatgcttcgttcaaaaaggaaaccatcgacccttcaagcacacagcaccagtggtctagtggtagaatagtaccctgccacggtacagacccgggttcgattccaggctggtgcacgttttgttcttctcttacctttttttttaaccgatccgatgactatgatctccaaaaagtaaacacgcagagtatcagagtgtactctctatttgagtaccagagtactaggcatatgtttgtgtcatggaagagttgcacagtgtattcttccgatgactatgctctccacgaagtaaacacgcagagtatccgactatcaactgcatgtattgattcagagtgtactctatatcagagtatcagactactaggcatatgtttcatgtttgtgtcatggaagagtggacagtgtactcttctttcttgcatgccgaaaatgaagggaaatagtgctggaagaaagcagaaatgctccacatacaaatgattccccaatataatgcattgagctagagctatatcatggcagagagttcacattccagaattctttacatcacttggtattggtaaaaggaacaaagaacgggcaaccaagcatactgctttgcgggcaaccaagcttggaaaaaaaggacagcagttcgtatgagctgttggaatatttaagtgctgaaccagcagtctgtaactctggaatctggattgtttatcctattccagagaaaaattactatatcatctttctggacgataccatcaatggctctgcattgacttccttgaatcacttgaatagcagagtagagaattcataggttaaacccgcgccctcgatttagatcctgtggcagtatataaacttttgtcagctaatgcaatttcattgatgaaccagacgagtgcagcagcatagaaccactcatctatacatatggagacacaaggtaaatgcctcacagaatcagcattaataaagccatattttaggggagaacctcaacttcctaaatgcacatatagatgccatcaggaacttactgcgcgttttgtctcggcaaaactcacttccgcaatgacatttgaatgccttcacaggatggtcgacatcatcaaaatcaatcccatagtcctgcaggtaaacacaagatcatggcaaacttcgaaaaatgacttacaacaggtagtgctccatatgctacatgattcaaccaaacaaaggggggatactatctatgggaaaagcactaatgagtatcaagtcacaaggtggccaccaaaaggtcaaaaagcccaaaactaagatgaaagcaaatt

SEQ ID NO: 13270 - DNA, 5725 bp, Oryza sativa
ccaaaaaatggaagacacagaataagctcaatatggtttaacttggactaatatatatcagttacaagctaaagttgaaaaaatacatggtaataatggtggtcgggcgtctcgatctcaacaggtattcctataatattagcatcaaagcacctgaaaaccgtacaatgatatgccaggtcaagaaggaagaagtgttagattcagcagagcacagaagcaacatttttttaagaaatacttatatattcaaaatttggataagactttgttctgttagctagcttcaaataagagtaacattgacttaactatcttgattaagtgctgacatcaggcaataatataggttgcagccaaacaatcactaatctacgacatcaggcaataatataggtgcagccaaacaatcacaaatctacgatgttgttcacagttttgtaacgagaaatatcatataatgacaactgaaaagcacatattaagttagttcacagaaccagggttaaacgctatggtccatgaggttttagttgggaccccactggtagccatttaccagtcacaccaattgtcaattttcaatgaaatttcctacactttcaacttgaagcacacatatcatggagaactcactaaatcgcagaacagtcagaaaatgtacatcaccaggttctcactgggaaaaccagaaagcgacaagaaccagctcatccctttttttacccatcccatagaagcaacagcttcatgtattacagaggactccataacaatcattagacgttctggtaaaaaaagaatccattattataaataataaatggatacctgtggtttataaatcttgcgacgttaccataaaacgtggcatctagacaaagggcttcctcatccttaagaacaccttcagtaccccagtcggcatcaagtaacaatgggtatgtgtgctttgctttaccagtcttttgaattgtacggtcatacaactcaatgttcgttaatatttcaccaacatactcacaaacaaaagcacctcgaggaagtttctcagtactgcgcaatccccatccttttttttcaggggttaagaacacctgaaattttagaaagaacaagaaaaattattaaaacacgtaagcaatgagatgtttactgtgacaagcacatgatcatacacatgatgcactatcacaacaaactgctgcagctaacatcataatttcaacaatatttggcagttgacaaattatcgtcaagctagcaaaaactttgatattattacttacctgtaaatggcgtgtgatgcctcgctgcaccacacggtttccacaatttctagtgcagccgcattttctccagcactccttgatgaatttccttgtaaggtgtcctttacaaggaccaggattcatttctgtgtttgatgaatcagaatttacttctatcttcattcgttcgtttgggcaaatcttgcagtagaaatggggatgtttaagtggttctcgaatcattgagatacagctatctagaaatgctcccttaagaaggccatctgttgtataagcaaactctcctcctgtttctgcagcacacgcacaaggaagtgattgtgccagacaatctctgaaacaatcagaacagcaattgtcatctccgattctagcaagggagatgtttacataggcttcttggagtgtgatattgtgtggtatgtagtgaaatggaggaggaagaatcccattgccatattcattaataattggaatccttaaacgttcttcaccttttgtgatatcattgacatcatgaggtggtctgttggcaccaatatgtagttgatgcggaacaaccggcatattactagaattctggctaactccagcaacagtgcaagaggaagaagtaccaccaaggctcatgacattattaggtggcataaaagcggaattagcttgatttgactgcaatatttgcggcactgaaggtttggacagaatgtccagggcaggaacagtttgtatgatgccttcatgtctaggtccactagattcaacaatacactggcaagtatctttaataagattcttaaaagagaaattgggttctaggctcttgtatttcctaaggcatctagcctccattttcttgcaaattaatttaatgtcaggcagatgaaaatcagaacggtttgccagggaagagttgtatgtgaatgatagtttcccagctccataatttgacaaaactacctcaatgttggatggagaatccttgctgcttacaatttcctggttgctacacgcaacagccctgttcctttcatgcgcaccagatacaccttcatgcttctgatcatggcgagcaccagaagtcctacgtgcatcttcataacgtgaaaaatagaaaatccaaaagacttgattagaaatgaagtaaagagctagcaacaagccaaaaaaagaatataaacatgacagcaacaacaatgacactttctgcaggaagcaaaggacatctctagaatactccaatattgttcagtatcactagacaagcatgctcgcaacagagtagaacagggatttaaaggactgacatttgtacagttattagagatcaaattctagaccaattctttgccaggagatatcaacatccagagctctagacctccctgccccatcccccaaaataacagacataagatcataatccctcagacatccacacataaaattctatatatccaaaaaacagccacatgtttttttttctttttgcaaaaagtgtatacgatatgtgaataaattccacaaaaacaacactacctttcacaaaactataaaaatcacacttctaagcaacaatttcagataactatgtgaacttactctctctctatatatataccattatagaggtatacgtccactctttgaccaaaattgacaacacaattcgaaataatctctggccaaatataaatggtctttaagttaatagtcacaatgcaagattttcacaacttctctgatcgcaatatattggcaacaacattatatcaatattagtttttttcgccgggaaggccgaaggaggccatctgaatatcaatattagttttacttttggatatattgacaaccctagttcaaaaggagtgaccacaaaatcccacagaaatattacttaaataacgggtctttttcaaatccaagtttgaggatcatgattcttattgtgaaagtagtagtaaaaaattctctttaaataataatgcactcatgtctagcaaaatgctttacaatacacgcttgctctcaaagcctcaacaccccattaactggaatttatataaagtattcctttcaactctaaaccataagtaattcatcttttttttaaaaaaaaaacgctacagtgatgtgtaggtaggaagctgattaacagaccaagactatattaacataatgttaacaaattgataaaatagcactgaagttgacaacaatacaacccaacaattaaacttactccatgaattcccaacaataagtagtcattaattttggatggtctatgaattaacagcattatgaaagtaaattgatgatggacacactaatattgcttttatgcagctgatttagatacatttgtcaaatttcaaaatgttgttaccgcaccacgcccaaaagatgttttggaacggatagagtggagagaagaatatttagattagcacactcaggtagacaacattaataggctgggcgacctgtatgttttagtttatacaataaaactagattaatttgtgggaatccatcaacaaagcattaaaaggttagcatttcatataaattattaacactatgtcgcctacaaagatattacctttgcgagtactgggggctacaacttgcggacaagtagttgctactgggacctcaaaagtttgaaggtcttgaccatggcataatacagcagaattattttcaacaattgttgtattctttgcaatgctagggcatgtatgtggttccttgatcagtaattgtgaagaaggcaactccaagtgggccctggtgactttcttcccattaacagttcgggcagacagtgtgcctcgtccctgctgtggtggagcttcaacaaactctctattgtcattgccatgcatcttggatgtaggattttgagaacgcttttttgtcttaagcttcttgttagattggtctgcatcaagatttgtctcattagcttgccttttctgtccttcctggtacatcaccaaaacttgaatcaaatcaaaatggcagattaatgaaataataagatatatggtgctcacataataaagaataaaactacactactgacttaaagaaccaaatatttaataatatgccagaacaaagcaaaaagattatactttgggatctgaatcacaaaatatagcatcagcaagagccagataattatcagcttctatatgcacccagttgtaatcgaataagtttagtagattattcaacacgggcgcagcagtttcctttaggataccaatatcagccatggctctgatagcagcatcaaatctatccttggaaatctttggaggagccatcctgcttgcagtggaacaaatcagcatggcacattaacacgtgatatcctttgagaaagcaagtgataagaaaaaccatatacacatactaagcatggtatcacaacatcttacgaatgtacaatgaagttaagattgtgatacattacgagaagttgtggactaagcacactaggctacaggaccaaccacaagagtactccaggtacaagctaacttatttatccttggagaagggctgtgcttattgctgaattttcaatctattgtgcatgttaatattattctttcagtcagcatttgaaatagattactcaccggataattgccacataccatctacttgattataggaaaaaattaaatattttgaggaataaacttaacaaatagcactataaccagaatggttatatatgccaggggaagtgactagttttcatgacacagcagtgcaacaacaggaaaaacagaaaatgagtaattcatactacttgagcagctgacatccaatctgcattattatctctccatgtgcatgcaaagttagacaacttgagcagcattcagaaatgtataccttgttcagtgttacatgaggcagtaatgttctgtaagatgtgtctatggtttagtataagaattctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatgcagtagcaaaaacaaacatcataaggaaatcatgctataaaactgtgtcagaaattggcacttttaggttatttgaacagtactttctgttcagagaactgttcaagctacagtagtaataatctctttttgaattgcag

SEQ ID NO: 13271 - DNA, 3447 bp, Oryza sativa
gaatattggttttgaaatccagtctaaactttacatgggtgaatccacccatttgatactacaaatatcccattgcaattgtcatggaagaagtcgcagtcctatctagatcactcacatcaccaagtctattgtggttctgaaacataagaatgccatttctgccctagctatattatatcctgctgcatttgactgagttaatccaaacagttgcttaaaaaggcttcagcaaaaaaaaagtgggaaaatcgtagctacaaacctatggaaatatatttcaatatttcccatgcaatcattttctttaataaaacatttgatatctggtcaaatttcccacccaaactatgcgcaactccattaaagcttatttgaatatataatttattatatatatatatatatatatatattctttcttctattttcaatctacatagctataatctagaccaaccatgactagtggcatatatctttctctttttttacctcattaacatggtaatttctaggccttgagagcaaatatgttggctccatttaaccttcactaacttatataatactccctctgtcaaaaaaaatataaacaggcgccccctcgctgtcgctacttcctttggttggtcacccttaaccgttgctggatagcggaccgcctcccgagtcgtggtttgtcacacccggatcgatgtgttctttgtgatcaatgcgaagagacgattgatcatctcttggtcgaatgcccggaatcgcggcaactatggtgggttgcattcaaagctatcgggcattcggagtgcttaccgctcattaacactctttcttttcatggttgtgtgactgtcataagaagatggtcaaggaacatcgccggggtttcgacaccatcgcaacattggttgcatggacgatctggaaggaaagaaacaatcgagtcttcaaccagaagagcagaacttgggtggaggttgcaagggttatgacgggtgaagcggagctgtggcggctagcaagagctgcaatccctgttttggtagcccatgttagtggagaagggtcgcaaaaatttagttggagattaggcttttagttttttgttctcctcctgtaccctgtccccttcgttttgtctttttggcccgctttatacatacatttattccttcttaatacaaagatacgctcctcgtgtattccaaaaaaaaaacacttttggagtttttcccggacattaagaagaggggttaaattacattagggatggttgtgattggttgagatgggaaagtagatgcagaaattaaatgagggatggttgagatgagggagtaagtggagaagtagctatattttctgacggaggaagtatatagaatctagccttttgaacaaatacccaaggctgcattctgatatattatgaccttttgaacaagtactcaatgttgcatgcatctaattcttcacatagaacgcctccaactcccgaacaggaagctcacaagtcggcacaatggtggatttgggggcaatagtgccaaaggcacgcccagatctcacaaattttcacacaagaaaactaagctggagaagcagccttattgtgatcagagcaacaaacgagcaactcaaagcgactgaacaggcacccaaaatacaatacgagcaaagctcctcaacctcggagcgatcacattcgcacacccaagcaacgcgggaggacatcgaaacttcgcagaaataggccgaagaaaaaccctcatacgaggagccctcaccccgcatcacaacaggggcggacctaacgtggtgcatggtgcatgtcccacccggccaaaaccccaatttgcttcagagaaagaggtgcgtatagagagggatgaggaggatgaggatgtgcgcgtacgggagctcaccgcggcgagggtgcggcagaggaccgccggcaccgctgccgctcgcgggatggggatcgtcgcaggcggcggccggcgggcgaggagacgggaggggaaggcgaggggactagggcgcgaggaggaggaattagaggcgccacctgctgctgcgatgtttgggcggtacgcgcttcttgtaccctcggacctcggtcggtctccctgtaacctgtatgtgtgtgtgtggatccactgccatcggctgaaacaaacccggtgcttcgggttggtgacagcttcatacattccattttgcatccgtgttaatgtgttagtattacgtacatcaaccgggtgtgtctgtcaatataacttactttctttttttctcaccttataattaatgacgattgatcttcgttcgtggttgggaggatatcctgaataggagatgaccattttaatccctataaggctgtgttcgctctaacgtgcgcacagaaaacagaacggtccattagtatgtgattaattaagtattagctaattttttttcaaaaatagatcaatatgattttttaagcaactttcgtatagaaactttttttaaaaaaaatacaccgtttaacggtttgaaaaacgtgtgcgtggaaaacgagagagataagttaggaaacctgagtaagaacacagcctaagtgtttttgtttgttggcatgggtggatgagacgatcgaaagagaaaatattccacgtagatactggataaacatatccagccaaattgaccgagtgagagtatcatatttaaccttgaacatgaaccaaacgtgcactttattgtatccagccctacaacttccttaacttgtgattaatctccattcactgtattcttattccttccatagatacaacgttcactactagaaaaagcatttttgcatatggccaaaagcaattttttcagacggagaggaggatcgcctgcagaccaatgactgtgaaaatcatctattttcgcagttggggcaatggcccgcctgcgaaaatccaataaaaaaacaaaaaaaatcacctcgtcgccgtccatgcgcatgcctcgccgccaccgccctcccccggcctcctccggctggatctggaggggaggggatgggagccgccgccgctgcaacgggagccaccgaccacacgcgcgcctcgccgccgctgccgcaccgggagccatcatcgacgtcgccgaccacgcgcgcgcctcgccgccgccaccctcccccagcctccctccgtccggatcggggaggggaagggaggggaggggagccacccacgtcgccgtccacgccgccgctgccctcccccggcctccctccggccggatctgggaggggaggggaggggagctactgccgccgcaccgggagccaccgatgtcgccgtccacgccaccaccgcgtccgcgcactccgccgctgcgcgctctaccgccgccgcgtccgtgccgccggtggagggagggaggggaggggaggggaga

SEQ ID NO: 13272 - DNA, 2835 bp, Oryza sativa
aaaaaaagaccccacgtcaggaaaaatgctttttctagtagtggttgtaagaaaaagtatgttttatctatattcccatgtacatcaacaatgtagtttaaatgaacttgtccatgtctgtttgtgcgcactgccaccggctgaaacaaacccgatactttgggttgtacgcagcttcttgtttcatatttacattcgtgttaccatgtatatcaacggtgtgtctgtcaatatgtcttactttcctattttcttaccatttaattaatgaagattaatctccgttcatggttgaaatgatatcgagatagtcatctaattgttgagcgtgtttagttagtggataagtatgtatgggacagtcagagagaggatattctacaagaattttgaatgagaatatccggccaaaatggctgaatgagaatatcctatctaaccatgaccatgaaccaaacgcatatttattgtatctagacatacgacgtatttcctttttcctcgacttctaattaatctctatcaatggctttcttgtttcttttcatatatatgttttatgggtgttcccgtgtacatcaatggtatagttttactgtgcttatcctacaacttactttttctttccttgagatataattaaggagtattgatatttgtccggcaacgcggctttcctgttttctatcatctttccatttgttctcctgtatgtagcaacggtttagtaatgttgtgtttggcctcacaactttgcttcctctttccttgatttaattaatactacatgtttgtgacttccctatttccatatccatgtttccatatatgctttcatgtgcgtctatgtttaagttttgttgtactagtcctcgcatcttattttctctttcctcaatttctaattaacaaatattgatctctatccagcaaccaacacaatttctcttatcccatgtccatgtgttacaatagtgatctccgtgtacatagttcaagtttgtgcttcatattttctcgacttctaattaacgagcatcaatccatttctagtaattgatacaccttctctctttccatatctatgtttccatctatatacatcaatggttcaattttagtgtgcctagcctcactttgatcttttgcaagcaacaatgatgtagcccccataaataacacatagcggcaagagcagccaggccatgcccattcactgacgtagcacaaatgcataacaatgttgcttctacacgattcatggttattgccttagtcctatattaggcttcattcggtttagaggatttttataggattattgtagaaattaaatccttaggattttttttctatatgcatcattcgtttcttataaatgtagcctaccaaattcctaaggattgtagtcttacaagctaattccataggatttttagcatgaggtaagacctcttgaaaaaaaatcctaaggaatggagtggatgtgaatcctaattaatcttttacttttcatattcttttgatttaaaaatcctatgaaccgaataagccctaagttctttgacgcggagcttgtgcgaaaaaaattaacagtatcgttgtgcaaataggggtgggtgtttgcttcacttggtcttatcatgaaagcactgtatcattcgttgtaattgctgatccatgctactattgcacttctcaacatcttcatataaggggaaggagaggagaacacaacaacataaaagactacaaaatcaatttaaatctctccttcaaatatgggactaatatttaattagttaccttttgtacttgagttaaaacaaacgcacgctataatgatcgttaatcaacctgtaattccatagattggctctagttgctagggagatggactatgaagatcgatgtggtttttgtataggttttattggcaaaacttatgagatgagcacatgggagaactctagattaatgtaagcacaaaacaagccgagtagttgagatgtaaacgcgactaattgagatcccccgtaaggtgacaccgataggttgtgaggcccacatgtcagtgagcagtactgcacaagcagtactgcaaatgacctgtatccaaacgcgacatgtggacaggggagcagtgtctagcatatgtatgtattatagatttttaaatgttgcacataatggtctttgatgttcaataagtatttttatgatgttttattatttcattcttacaaattttgcaccgatgttatgtaaatgttttagtatgcactggtagagaaatgggctttactcccggttcgtaacccccctgtagtcctgattttctaaccgggactacaaatccgggactaaagatcgctatctttagtccgggtgaaaaaatcggaagtaaaaatctatttttaagtcccggttggagttaccaaccgggactaaatatagagtatctttaccgggactaaagaggctagctcaggttgcaactttattctattctttccttcattgtttttcatatatagattcattatatcccatcccaaaatcccaaatcaatcaaccccgaatagtctccaaattctcaaatcaatctctaaatacataacaaaatctttaaaaaattacatcacaacttctacaaaattcattacaaatacatcacatattcacatcacacacaaatcaaatacatcacatattcacatcacacacaaatcaaatacatcacatattcacatcacacacaaatcgtctcagatccgaatcacatatttaaaaaaagaaagaaataaaggaagaagatgaacggcctgcagccgc

SEQ ID NO: 13273 - DNA, 22281 bp, Oryza sativa
  unsure (1)..(22281): unsure at all n locations
ggagtaaagcttatattgatcttttttcccagttggtaacaccaaccgggattgtaaatagatcttggactaaagatcaaaaaattcatcagagctttcaaactgggactaaagatgtttttattcccggtttttaatataaccgggactattgtgaaatctggtggaccgaccaaagatggttcctccaccagtgatgatactgcagtttttatactttatttgtttctcgttttataaagaatgtttcgatatttttgtttgtttgatgtttggtcttttatcaattaaaacagtttaaccatatctttttttttctttcttggatcaagcatccgacgatcgaagctacgtttttttctctttttttttttaaaaaaaaagaggacgactagagacgacactgatagaattgttgcaagttagatgctacaaaagtggagatggtttttcgtttcttgagaggatattatctctcatttcttgcatgccacttaaataaaacaagttcaagtttaaatttgacttcgataagttataataaaaacaaattaattttttaggacaaaaacaaattaaattgaaactagttttttttgcggggaaaattgaaactagttaattaacgtgtgtatatttgttataacttgtaaaagttaagggtgtgtttagttctttgggtgtaaagttttttaagtatacggacacacatttgaagtattaaacgtatactaataacaaaacaaattactgattccgcatgtaaactgggagacgaatttattaagcctaattaatccgtcattagcaaatgtttattgtagcatcacattgtcaaatcattgcgtaattaggctaaaaagattcatctcgcaatttacatccaaactgtgcaattgatttttttcccacatttaatgccccatacatgtgttaaatatttgatgtgacgtttttagccaagattttttttatctaaacaaggcctaaattaattttaacttacatgtttgcatagtgatatactcactctgtttcacaatgtaagtcattctagcatttcctatatttatattgatgttaatgaatctagatatctacttacattgtgaaacggatgaagcatgtatcttttactaatctatcttaccagtttttttaaaaaatattttaattactatttagattacatgaaaaaagaggtgatatataaatctcaacagatgaaaacactactactgtcccacgaaagcaactgattaacccaaaaataagagaccggatcggagacggcgccgcgcggtgctacgtacgtgaccgagtccgagagtgactccactcatcgtaacgcctacatactatcctccgtgcttatatacttcgatgcacgtgcgcccgacctcttcggctcttcctcgtgttacccaactgacacgctcgtgaaaggcctcgctcactaatcactatggagccggaggaggaggaggaggaaccaaacatgtacaactcggaggccggggaggagaaccacgtcggcggcttctacgagtgcacgggcctccctcgcgacgcggatgggttcgtcgccgccgtccacgaggtgaacccggtgcagttcctcgccggcgtcttccgctacctgggcgaggacatggcgggcgagctgctccgctccgacgacgacgacgtgctgcactgcccgagcatcgccgcctcttcctcgccggaggagctcctcgcctgtgccgcccgcgcctacaccggccgcgaccgggagcgatgcggtggcagcgtcgtggagcacttgtacatgatctgctcctgcttctgcccgcacgcggcgacgacggcggctcatgtgtcggcgcccgtcgtcgccggcgctgatcacgtcccggccccgtgcgacgacaacggtgtcgacctggcttttacgcaggacgagttgaccgcggcggcggtgaccgtgggcgaagtggacgaggacgaggtggccgtggcggcggcggcggcgacagtggacgcggccgtagacgagatcgtcctgaatgcactgggattcaatgagtttgctcgcgacctgaaggagaccatcgaagcaaaggatcgtgaggacgcgttgcgcgcggagggctcgtcagtttctcccggcgttcgtccaccggtgtagccgcgtccgcgttcgtgttgtcgtgtgacatgtttccgcccttacgaatcggtgtcgtaatagctgtggattttttctggacgtccggagttggaggtgtatgctgtagtacgtaatacttcagttaacgttttgcacaaaagttttgcgctttggataattgaatagttatccaacctaggtctgcttataatccatcaccaatataggtctgcttgtagtccttcaccaacacagatatgatggttcgtgccctatcaaacattcttttccttgcaagctaactatactactctctttgattaaaacaatgatgtttaacccctattaaaactcttaaaacgttcactattaacttatctaaaaaatacttagctccaaaacataaaaaaaaagatgggtatatttattttgattttgtaagcttagtggatcttataaatttaacttttcaatagaaaattattgtcaaagtcacatataaaaataccttaaaagagttaaacgagctgtagtacctccattatgaaaattcacatttatgacaagtggtttgaaattccctaagaaaatattgttgtattggatgattacatatgtagaaaattgtttttgtttctcacgatgtgactttgtggctcatgttttacgagattcatctctctctctcttgtatgcacgagcaaatcaagtcgcgcacatggctggcccaccaaggcccacgtcacgctctacgcagtgaaacaattcagtcggccacgtgcccacatgtggaccccagactcatgtgattgcgtttctcccgtgcgatcgtgctagaatttttatgttttttcacctatttttattactgactttattttaatttcccctataaaaacatacaaataataaaatttattgttgttttaagcctttgttgaaaaaagtggcttcatgtttacttactacagtaatttgattgtaaagttttaaatttaagttgaaaattttattaagttggttgaaggttttcaaatttgagttaaaagttttgaattttaagttaaaagatttcaaatcttcagttgaaagttttcgaatccaagttgaaaattttaaatctgaatttaaaaatcttcaaatccaagctgaaaattttcaattctgagttgaaaaggttttaaatataagttggaagtttataaatcttcacttgaaaatttttaaatctaaattgaaagttttctaatataagtttaaacttttaaatatgaacttaatagttttcaaatctaagttgaaatgatttcaaaatttcaaaatttgattcagtaaaaaaaagaaaggataatagaaaaaagacgtgtgcggggaatttttttagaaaaaaaaataaaaagtaaaaaaccaagagacacacgcgggaggttagcgagaaacgcataacaaaagtgggtccaccactttctttcaccccgtgcaatatttccaaaaaatggtgcgtacgcagttacgcaccaattagccacaccctaggttctatcataaatcacgatacaatcttattcttctttgctcgagatttgtgatagagcacacatcacaataaaaattgacgctttcttaaaacaaaaaaacctcaggtttgactcccgctcaggcgcccgatgggaggaggttaaaatcgggcgctgacggcagcgttcgatttacgtgcaaaactactttaaactgatttttctcttaaattacttatccaaatcatgatccggttgcaccattaaattcgttgtaattaaatcttcgaaacaaggccactcctagatatattccaaaaaaaaattagcttattattgaattatttttaaaggttgcacgatattccattaggtatattggaattgtttcactaagtagatcgaaaatgtttcactcgtttaaattagatgttgtttcaccttatataaaaacaatgtttcagcaaatagcgaaagaatgtttcagttcattgcaacattagatctatacatagtgaaacattgtggtacactaggtgaaacatttttcagtggaacaaaaaaaataaaccaaattcccttaataaggagtttccaaaatatgtgggggtttttttgcaatggaaggtttcgttcactgcaacattagatctatgtcatagtaaaacattgtaagtacactaggtgaaacatcttttgtggaataaagatgatggataagtgggtgggccaaacaggtgctcacgtgggggagggcgagcgatcgattttcccacctccccggtagaccgatgctgggcattctccggttttatcacaaatcgcggtacaatttttctttgtgtttgcttgagatttgtaatagagcacatgtcacaagaaaaaaaatgacgcttttttagaacaccaacataacaaaaaaacaaaaacccatccaaagcttaagcccacggacgcggtgcgagtgtgcgacgagcccagagaggcaaaccaaacgtccaaacctccgcacggcgccgccgcacgatgcccccggcgccaccgttctcctcccacggcgacttcgtcgccgccctccaccgctgcgccaccctcgcgcacctcaagcagctccatgctcacgccgtcgtcaccggccgcgccgccgcgcagaccaccaccttccacctcctccggttcgcctccttccgcctctcctgcctcccctacgcccgccgcctcttcgacgccacgcccagccccaacgtcttcctctactccgccatgctctccgcctacgccgccgcctcctcccactcgcaggaacacgcccgggactccctcgcgctcttcctccgcatgctccgccgcggccgacccgcgcccaaccagttcgtctacccgctcgtcctccgcgccgcctgcgccattggggtccagctggtcaggtcgatccattgccacgcctgcaaggacgggttctacgggcacgattttataaggacctcgctcctcgatgggtactcgaggtacgggatgatgggcgacgcgcggaagctgttcgatggtttgactgataggaacgtggtctcctggaccgcgctggtgtccgggtatgcaagggcagggaaggttggggatgcgatagtgttgttcgaacggatgcctcagagggatgtgcctgcctggaatgcgatcattgccggatgcacacagaatgggttgtttgtggaggcagtggggattttcaggaggatggttgatgaggggttccggccaaatggcaccacagtatcttgtttgctgtctgcgtgcggacatttagggatgctgaagattggaaaggtgatccatggttatgcgtggaggagctgtgttggttttggctcatccgttgtgaatgggttgattgatatgtatggtaaatgtgggaatttgatggaggcaaaatggatctttgatgcgttttctgataggggtctgaccacatggaattctctgatcaattgccttgcactacatgggtgcagcgagagtgccattgcggtgtttaattcgatgaggaatgaaggggttcaacctgatgaggttacttttgttgggctgttgaatgcatgcacccatggagggtttgttgatgaaggtcttagatactttgaactgatgtgtgatgagcatggaattgagccagagattgagcattatggttgtgttgtagatcttctttgtcgagcaggacggtttcaggatgcgatgaattttatcaatgatatgaaagttcaaccagacgaagtcatttgggggtcattactcaatgcctgtagaatacacagacacctagaactggccgagcatgctataagaaacttgttggatttgaatccaagtaatgctaattatgtagtgatgcttgcaaacttatacagtgaaggtggcttctgggaagaggttaggaaagtaaggaagctcatgaaggaggatgttacaggcaagaagctgcctggttgtagctggattgaggttgatcgcaaaactcgccggttttattctggtgatgatggtcaccctgagtcagaggatatctatgacactcttgataagttagctaccacaatggaaatgcaggctacatttgcatagattaataattcatattcaaaaatcagcatcttctaattctgtacatgactgaaactgttgacctaggcagcattatgctggtagatagatggtcgtgttcccttaaacacttaccctgagctatttatggctgaggtactgcttatatgccactactggggtgtacttctacaggatttatccattgtaatgctgttatctttgcatatcatgaaggtatgtgtatattatggatggccgaatatgcttctgcttactcccattttgtatcccacacctggtgatcttttttcttaattctgtcttcagtgctgccactgtgtttcccttggttcggaagtaacaaactgtcctatctggcatgtaatacctgctgctgctcaaccattataggtatggataacacctctatgtcggtataccatgaccaacctttgttttatggtccagtcttcacaaaatctacgctcgctgataatttgttgtcaaatgtcaacagggcatattcttgttctttttccccctcttgtacaggagcaccaaagtaaaggagacataagctaaagatggagtgaagaacagatgataaagagttttctataaactaccatttttatctgttatgcaggtaattttatattaattcaatttgtggagaacccttgcaaaatgctttcattatcaagtactttggacttttgagcctggactaacgaaaagcattacattaacagctggaatagctggttgagacttgagacgagggatatacggaaagctgcaatcagttgcatattggcctctcattatcatgtatgattgtaggagcatggttcaaagaatatgttctgctccttatctgctttgcagtaagaccaatacacattttatcattttatcttccatatcttatctcggtttctcttgatttgctctcatgtccaccatttcctccctccaattcaaagcttcttcttgtttaaacttattatgtaattcgttctaaattggtgggttctcaatctatcatctttttatcctgtctctgcaaggtgcaaaaaggtgattctttgaaagaagattctgggtacggagggaattgcgactgacgagatgcttacagttcatctgctcatgtgatgtgtcacatggcagaaaacatggagaaatgagcgccatacgttgccatgctgcgattctagagatccagtcatccagacagtggaaaggggggtcgtaaaggatggcgcagattatagaataaccatacagagtacaattgaaatggaccaacgatgaaaggaaggaaatctgagaataaattccagtgcagtgccagtgtcagtttcccggtgccatgcctgaccatgtaaattgcgatccgtatgactatccaaaagaatggcaatggctgtagtcctctgaatttagtgagttgaaagtgacttgtgagactaaataaaatataagcgactggctatggctttgatcctgtagccactagccaacgataactgataagtgcagtaatgtctcagacaatttttagggcgagaacttttatggtacaatgtactgctagtatatactataagtatatatgatctaacggtgtagattgatttgattttttagttaattagattgcagtataaagtttgaaagggtaattttgtcttttctttgttattctatcatcaaatcatgctatcgttacgtccttcgtcatccaggaccaggtactcccaattagattcaatctgaacagaaaattactaaagagttattttattttctatcaaattcctaatatgcccttctatatactgtcagtatatactggtagtatattgtaccgtaaaagttctctcgacgagcgatgacagtggatcgaagattggccgaatatgccatgtttgacagtggatcgaagattggccgaatatgccatgtttttggaagatttactccttctgatgttccaaagaagggcgcccttggcatgcatgtcagtgctagggtatgcttagaagagcttccggcggctgtatcttataatcacaagtttcctcaaacaacctagtttttcatccaaatttggagaaattacggaatccaaaaaataaaagcaagtttttacagcctttttaggttcttaccaacttcttctaagaatcttagaacttgtttggcagagctctagctccagctccatctttcctatagctggagtccaaccaaacgatttcagctctacccaaaaagggatccatctttcttatagctggagtccaaccaaacgatttcagctctacccaaaaagggagtggagctgactagagtactctcgtaaaaatgaactagagaggtgaaactggatttacgcagctcgacaactccactacagacccaacttctaaagttaaatttagaagttgaagctctaccaaatgggaccttaaactcccataaacatgtcctaagcttagaatctaaaactccttcaaatgtccaaaaaaaatctaatcgtgggaatctaggattaagtttttttatgagacagaatgagtatgtgcctctaaaatctctttaggggaagaatttttttaaaaaataaaagaaccggaggactgccaataacattacaaagatagcttgcatgtactccttccgtatatgtgcatagctagaaataaggtcttttagggagttatgctttgagattatttggtgacctacgatttacaattttcattgcattttgtagaggtcatgcacgcttatatacagtggtgtgaatgtggcatgtgtgttaagtatatgcatccaattatactctcttgaaaaaagaatcatttttaggaagagtacaacctatgccctacaacaattgaagcttgaatcaatatattttgtctcctacattcttaattaatcggagcatgatcagggcatcagtagcaggtaatacctaaaagggtactagtgatgactgatgaggtccacatgaactagtaagttaaaattatcatgtactaacacaatgttaagtacaaggaccaccaagaggttgagacttaccagtgaggtttaaaagatcccatcatataactattaatttggagacgtttcacatatacttgaaagttgcctaagtgtgacaaatgattggcatttcctttttaagtctttaagtctaaatacctcaagtagctttcaagcgccataaaaaatcacgggtggaacgagttaagaactaacctagcctggagttcctccatgaccttatcactccaagacagaacgacaaggcgatcatttcaaattctaatatcatgagcctagcctccctccggtttcattttaattgacgttttgaacaatgacacggtctacaagatatatttttgaccttatttttctattataatatatataataaataaatacatatttatttttattatagtgctttaaaagacaaatctatatatgttgttctagttcctttaaactaaatatttttaaagttattgatggttaaagttataaaagtttgaccttaaccttgtccaaaacgttaattaatatggaaccaaaggagtatcaatactaatatctcctttggaaacatgaatttttctctcaattcacgcgatcattgatctaattcattaataaaatcacatacaacttcgataaatttgttcattctaagggtccctttgaaacataggaatttcaaataatttggaacgaaatgtatcaattcctataaaaatcctataaaattaaatagggggaaaaactttgcttccattatttgagagtgcaccaaactggcacatatctctgctcctgtaccggtccaaagtcaaacgttaatacgttatatgcattctcctagcagtcgcctatacattactgaacacgcattcgggaagtacaaaaaaaaatcatataagtggtgtacaaactacaaataccacagttgtcaaccttttatttattattacgtatggttttttttttcaacctgatagcaaacacgggctctctcctcatgtggtcacccgatcattgacaaagaaaggtagattatacccgtttccagtttttccacctgacaattatatcacacatgatactttgttgtacaaagcaaagctctacttgagagttgagataaagggatttttgctaagattttgtgtaaatttatatcaaatcttagtcaaatcccctgttccaaacagatgatctcagataaaaaatactactatctttttcttcctattatacaatcacgaaacctgcagcatcagatcaaccttgaaaaacgcttatatgcatttcgttcgatcgatgatgctgcatgtatgtactactagctcagctcctccggttccactagacatggcctcccatctcggcggcgacctgcgtgccgtgcgccgacttgagcatgaacccgccgacgctgcggtccggcttgccgctcgcgtcgtcgtcgtggtacgcgtacgcgaacccgccgtggcgcgtctggtccatgccggccatctcgtcctcggccggatgcgcagcaagcccagcttgttgagcaccaggaacagcggcgccatggtgaagctcacccacgccgcgatgaccaggatgaccactatgtgcgccccgagcagccggccgccgccgcccatgaacagcccgtacgggcgcccgggctggccgaagatctggtccacgtactccttgcgcgcgaacagcgccgtgaagatgaccccccacgcgccgcacccgccgtgcagctgcgccgcctcgagcgggtcgtcgaacttgagcctcgccgccagcgcgttgaggccgatgagcacccacgccgagacgaacccgcagatgatcgcggcccacgggtcgacgacggagcaaccggcggtgatcgccgcgaagccgccgaggaggccgttgcagacgtcgatcacgttccagtgccccgtctggagcctcttcccgaagagcgtcgtgagcgccgccgtgctgccggcgagggtggtggtcacgccggtgcgtcccaccgccgaccactgcccgtggatgctaccgggcgggccgtaggatttgaggatggtgaggaacgagccggggttaaacccgtaccacccgaaccacagaaggaagctgccgagcacgacgagcgacgcgctgtggccgcgcagcgccaccgagcggccggcgtggtcgaaccgcccaatgcgggggccctcgatgagggcgccccagagtccggccacgccgcccaccatgtggacaacccctgacccggcgaagtcgatgacgccggacccgaagagcagcgaccccgacgtccgggaagccgaggcccacccgtcggcggaccagatccagtgggacaccaccgggtagacgaagccggtgaggaaggcggagtaaatgaggtacgccacgaactgggtccgctcggcgatggagccggacgtgatgcccgcggcggcgatggcgaaggcccactggaagaggaagaagctgtagtcgaagccgacctgtgggacctgcttgaggccgaagaagtgcttcccgatgaagccgttggacggcgccccgaaggcgaaggcgaagccgaagaggtagtagaagagcgcgccggcggcggcgtcgagcacgttggtaagcatgatgttcatggtgttcttggcgcggacggacccggcgcagagcatggcgaagccgagctgcatggcgaacacgaggtacgccgagaagagcaggtacgtcgagtccacggccgacgtcgtgtccgcgaactggttgcacaggtagtccgtcgcgttcgccgccgccgtgcccagcagcgggccgagggtatccgcgcacgttgccatcctcgccgcctcgacgcgcgctcaacacagactgtagaggagaggggaggagcaatggaagtgtgggctgtgggtggagtggggagcggccgcgtcggatttataggcgacgtggagagggagcgagaaggaatccatgacttggggggtgtcgttgttgattccttcaaagtgtgaagggcccacctgccagtgaatctttggctacctctgaaatgtgggacccctatgatttgcttgttgatttgtccccctcctgttcgtggtcgtagttcatcgaatcccgtggaatctctctataggcctactgtaggctgcggcctggaggctgtgtttagttttttgatataaagtttttgaagtacacgcatacatattttgaagtattaaatatagactaataataaaataaattatagattctgcttataaattgcgagatgaatttattaagcctaatcaatatgtcattagtaaatgtttactatagcatcacatggtcaaatcatgacgtaattagactcaaaagatttgtctcgcaatcccatatttaatgccttatgcatgtgtccaaacatttgatgtgatatttttggctaaaattttctgggatctaaacaacgcctgagtcgcaatacagtggtttgtactttcttttaaaaagtaaaaacgactgtttgtacatttcgtcctcctctatatttgtctatagtgaagcacttgttatatttcctcctctgtttgtacttaaactttctttacttttttaacaatattatttttattatatttccacttgtaacacttggaaatattttataatttctaaatctaattggttcaccatgtttctaaagaaaattttggttgcacgaaaagacacacatgaatatgttaaccaaaacacatgaaatccttcaagctttctgagtggtactatctccatttcaaaacatatgaatttctaaggccctgtttgtttcagtttaagattattataatatatattattgagctagattactataaactgaattataataagattataataaaccgatatagaataagttgttagctgtttgtttatctggattattagctgtttgctagttattagctatccaataattaaaaaaagcacctttagagtggattaccagattatagtaatctggcttatagattataataatctatcataataagttatctgtttgtttcagcttactcctaataataatcagattataataattctaagtggaatcaaacaaggcctaaattgtttaacaaacattgaggttaggtcatagtctttttttactttagtatagttaattttttgaattttgaattgcttggattccctaaacccttccaagcatatgattagctatgaaatcattgagataatcggaatgatggaaactactacttatattgtgatgcaattgaattctaaaaatccttatattttggtattcatggagtacttttgaagctttcaccaaaacacagggctacgaattgaacccaatgattaatgttgtgtttttcctgtaactctaccatcatgtaatgattgtcgctctgcctttttaagcggctggtgctggttgaacgggaaagtattttctgaacctaggtgagctgcacctaggctcattaccgctagatgcgcctcaagattcggacgtacacgatacccacctgctatatgtgagaaacctgagaaatcatcacgaatcgcttaatcgatcgggcggcagacgccctaggtgcagctgcacctaggtgtagaaaaaccgcgtccctgttgaacatgtactccctctgttttttaatagatgacgctgttgactttttctcacatgtttgatcatttattttattcaaaaaaatttacgtaattataatttattttgttatgagttgttttatcacttataatactttaagtgtgacttatatcttatatatttgtataaaatttttgaataagacgaatgatcaaacacgtgagaaaaagtcaacggcgtcatatattaaaaaacggaggtagtattatcgttcatggtacttctctacccacctgaaattttcgttgtctatcatcgaagaagatcagccgttgcacctcatgctcaaagtgcaggtgctcgcgaaaaagtccagcacgagaattcctggaaatcttttataggagtacgtacttctctaactgtcaagctaacctgtacaagtgtgcaccacccaagtaaataagccatcgcagctatctcccattttgcaccggacttttggaaaccacagatcaacgtatctcctcattggcacaccacctgtcgataggcagctcacgcacgacgatgcgaccatcgtgccgaccgcgagaccacggcgagaggcataaaaacaaccgatcccgagatgggcaggcatatcggcgtacgcacgcagcccggtgagacccgccgcagttggagcgcgcatcgccatcgccgcgagcccgcgaagtccacggcgccctcgtcggcggaacaccccagttgctgacgagactgacaggtgacagccgagacagccagaaaagaaaaacgaagccggctgtactaacgacatcaaaaagaaatgggagccccgtctgtttcagacgtaatggcaatggtaatactaattagtaataagataagctcccagttgacgctccacaactagccaatttccatttcgcatgttcgattattccccctgacctccatgccatccagtgtgcatcttccgtgtcccgaagagctgctcccgagtaaactatgcctgaatccagagtccggaaacacatatgcggtgtctggatctgccgttgacttgtggattgtgattaaggaagtgttctcctctctgtttttcgtctgacatcaccgtcctgctgccgattatagtattttgagtttacagtggatttggcctctcccctcatttgctgaatcttatgaaaatgttttagctgtttgctcctgacagaatagtgtgacctatcatgtgaaacgcgagcgcaattgtactgtactatcatgtgaaacggagtatttccgatttcaaaccgtattacctgccaaccgtttcatggtgtcaggggtacgcgatccgaggaggtcgtatattgtactcattgagcactagtttggcgtatcgtaacgttgagcttcatttagaaatcagaatgtacagaaaaaaagagttcgctgcctgtgattcagttctgaatctgatcgagctcacctgcatctgtgctcgagcgttggttcgtttcgtaatttattgcagcttgaattttgatgacagctgttactgtttctggacccttcgagatggcgattgctcgagctcgctacgtcaacaggagggccgttgaatttacccattttccacgcttgcgtacgtacgttgcggcggaggaatcggcttgctcttgttttcttttttaaaaaaacgcagatatattgtttttttactccgtacctctgatccaactaaccgtatgctgtatagtgtatatacagttcttatcttaatcaggaacacggaaatgtcgccgtcgtgatagggggggccgagaaatcgaaatgctcgagaggtgggggtggtacgtcgtgtggtaccgtgctgtattgtttttagttttccacgttctcatgatcgcctcctgggcagccggcttctatctgtggaggaagcaccacggagaggagcggagagggagggcgcggatcatcaacggcgagccgcgagccgcacgggaagcgcggcacatgcagatgtaggcaatggcgcacggcggcgcggcctgaagccctgaaccgcgcggagaacgacgctctccgtctctccgagtcccttccgtgcgagaagccactaccgcacggtgcgcgcggggatgcagccatgcaggacgaacggggcgcgcgggggagtgcaggccgcagtccgcagtccgcagggcaagcggtcataataggccgttcgcagaagcgtaaggaaggcctttcatggctcatctgtcacttgggggttgggcggctgggcctactttgcgattgggcctcagccatacgttccttagcggaaaaagtacaccaaaggtccctcagcttgtcatcgggatagaaaaacgtcctcgaaccacaaaaccagatatgcggggtctcttaactatacaaaaccgatcacgcgaggtccttcggtgattttgattccgattttagtctatgtggcagctgagtcagcgtgggacccacgtgggtcccacatgtcagactgtccacgtcatctctctctttcccatcttctctccctttctcctctccatcactctcttgttagggactctggtcaggccgacagccgatcgatgggtgtggaggagggggctgaggcgcagctgttgcgacgtggtaaattgctcggctacctagcgacggcgggagcagggggtgcggagtggcgtcggcattgcgcggggaggctggtgcggcgcgtgaaggtgctatcggcgggccgacgcagtgcgtgaagacgtggtcgacagcgacaagaggccagcttggctaggaggtacagccggcgactgtgcggagagcgggtggacgcgggaggcacaactacagggggcgtcggtggagcagtgtccacgcgtcaatggaggatggttgatggtggagcaatagagcgttagctatggatctacaagggaagagcgacccagtgtaaacctagcccgatcttggccgggccaccaacgatggcgctttgggcgtcgtcttccctctcagaagtgttgtcgagccatcctcttcctctaactaggctgccgcgtgaaaaccctgtcttggttctctctaagaccttgatggagaggagcagcggtgctcatcgtcgctcttctccctagagatgtcgtctaggaaggtcccttgccaaaactcctcttaggcagctggtgcatgctcgctctagatgtcttgtgctcttgtgacgatgctctaggttatgcaagtcgaccacgttggcgggccctaggagggagagtagttccttcttctctctcaccctctccctctcaatctcaaatacatggctagaattgagatcggtggtcaaccgtagggcttggttttgggcggtcttagctgtagtttgcttgttggtctagtggcgaccaatcacgctttgcgatggtcggtccagtgcaagctttctcctgaactatgtgtatttgttgttagtgcgtggtggtgaaatttttttcttccctttcctggctactgtcttccaagatactagccttgtactactattcaacgaatcatcgtgttgtctggtggtgctgatcgttaaaaaaaaaacttgtagtactactatagcagtagtctagtacaagctagtttctccataggaggatactttggaccatctcgcagcgattctcccaaatggcatatgccgagctccacgttaacatcataatgacctaaatactgatacaaacaggacacgtctaaacatgtacaagaaagccacaaaaatccatacaggtgcaaatgcagagaagaaaggaagcaaatatcaaaagaaagccacaaccaccatgggctgaagtgccaccacgcccacacgactgcctcagcttatatatgcacacttcacaaaacactttccccaaacggacacgatcgatatgatcctactacacaaactggcccgccgcggcttgctccggcgactttctgggctccacgcgagccgtctccgccgccgacttggccctgacgcggcgctcgccttcgtcctcgtccacgtacccgaacccgccgtggcacgtcgggtccatgccttccatctctgtcgcgggcgagacgcggagcagcccgaacctgtgcagcacgtagaagagcgtccccatggtggcgctgacccacccgacgatcaccaggatctgcacgatgtgcgccgcgagaagcctcccgccgccgcccatgaacagcccgtacggcctccccggcaccccgtagatcagctcgacgtactccctgcgcgcgaacagcgcggtgaagatgatcccccacgcgccgcacccggcgtgcagctgcgtcgcctccagcgggtcgtcgaacttgagaatcagcgacagcttgttgcagccgatgaggacccacgccgacacgaacccgcagatcaccgacgcccacgggtcgaccacggagcagcccgcggtgatcgcggcgaagccgccgaggagaccgttgcagacgtcggtcacgtccagtgccccgtcagccatctcttgccgtagagcgtcgtcagcgcggcgacgctccccgccagcgacgtcgtcacggcggtgcggcccaccgccgaccactgcccgtcgatcgtgcccgactcgccgtagatcttggagatggtggtgaaggaccccgggttgaagccgaaccacccgaaccacagcaggaaggtgccgagcacgaccagtgaggcgctgtgccctttcatcgccaccgtgcggccggcggcgtcgaaccgcccgatgcgagggccctcgatgaaggcaccccacaggccagcaatgccaccgaccagatggacgacgccggagccggcgaagtcgatgacgcccgacttgaacagcaacggacccgtcaaccggccggccgaagcccacccgtcggtggaccagaaccagtgcgacaccaccgggtacacgaacccggtgaggaaggcggagtagatgagatacgcgctgaagcgcgtccgctcggcgatggaaccggacgtgatgccggcggcggcgatggcgaaggcccactggaagaggaagaagtcgtagtcgtaccctgtctgcggcatgtgcttcagcccgaagaactgcttcccgatgaagcccttggacggcgtcccgaacgcgaaggcgaagccgaagaggtagtagaagagcgcgccggcggcggcgtcgagcacgttggtgagcatgatgttcatggagttcttggcgcggacggagcccgcgcagagcatggcgaacccgagctgcatggcgaacacgaggtaggccgagaagagcaggtacgtcgcgtccaccgcggaggaggtgtccgtgaacctgttgcagatgtagttggccgcgtcggtggagttcgccgcgccgccgagcagcggcccgaggctgtccaagcacgtcgccatggtgtgtctcactagccaagtgtggcaaggttttgtgctgcttcttgctagggtttaggaactaatggaggttttggtgtgtgattctttgaagtagacgagagaatgagatgctggactatttataggggcagaacacattggaatccatggttgatggttgtttttaattggatgattcgtgatcacagacagcgggaaatgcaaaaccgaggtgcgcgtggatgcatgtatactgttttggattccttctaacatgggagtggattctaatacctcaaggggatatcccctcgtatacctttttcttccaaattcgatgtaaatagctatggaaaaaatctgaaaaaaattaacaatgtagagtataatgatacctactagtccaccaaaattcatattcaaattcgatctacacatcgagaaacaaaaaagacaaatttagatataaacagtacgctactattcatacgctgaatttgtcttttttatatctcgaagtgtgagttgattttggacttaagattttgtgaagttgtatatatgtgttgtatgaatgttgtcaatttttttcagaatttttcataaccgtttagatggtttttgagtaaacgagggaacatcccctcgagggattagaatagtttcccttctaacatcacatatactagtgcctgaaaacctttttttttcttttttgccaactgcaatgagttgattaatttttttagtggcagcaaccaatcttttcatccaacaggtgtgatgagtaaaagaacgagcagttcacctctattaatgaatgattgaatattactgagataattttatcatccttaagaatacattgcagataccattttttaatgtaaaatttggcacatacaattacttttttttagtgaattaaatttctcttgaaataaaggtacgctgcaattttatttttttgttttgaaatttcacaaaacaagatttttaactgatcttgatatcatatttagtttcatgtataggttggttcattcataaatttaagttcattgagaaagacatgtgattcacttatcttcaaaaattgtcagtgatgatttaatttgttacctagacgtctcggcgctggtgttgtaagactgttaaaattatcccaataggtttacactggttttgcgacagtgatatttgttttgtttttacttaagtattgtcttgacttttgatgatgagcgactcaactagcctgagttcccgctttgctcagaaagtttcagacatcagtaatttatgctgggttgggagtatccgacagatccaagcaaggtcgcatacgcaagatgccagattcaactaagatccaatgtcactatcagaaagtcgtgttgttgccatcacagctaagattcttttatgcattcaacattttttaaaggaagattcagaaatgttcttgttattatatcgtctgaagaatcgcattttgtcaacttcaagtattacaggttttaatctggtatctcctcgcatccttgcacgaggtagttgcttgtcgtcacgtccgactatacgcatactgttgtgtcatgaagttgcatatatacaaccatatacttgtatgcgtaatatccattgactttgttgattaactgtttaagttcttcaggcatgcatgtaaacccagcagcggataggtcgtacctagcagaacatggcgacaaaactcatcaatcgagatggtatatgatgtgtgcaatgcgtacttagcgaacgattagatattcgataaggttattggcacaaacggagataaacccatttgcttccataccataccggcggcttctgtcttggaagaaccttgtgattaatttgcctccctgaagaactcgtgtctgactgaaaccatgtaatcaacaggtagtccatgctaaacctgcttgctgactactgagtactctgtaattgtcaatcagatctctgtgttggtctggctacattaacctgtacgatattttcactgaaactatatgttttaactcactgcaaatttatgttgtttgtcttcagaaatgagggtgtcaacatagattaaccatgtattcttacttcttggcatagcagtaggtaatttcttccagtagaataaattcagatgatgaagcaattcttaggtcaaaactctgacaagactggataagatgtggtggatagggacgcaattgcttcttccttgcaagtatgacttgcagatgctgcgtatctaatttttacactctggaaatagatcacgctgatgcgattaaataccaatgttttataacttttgtcgtgcctgctaccacacctgtatgcatatcagaaggttgaccttcagaagttcagagaatggacggatctatagtaaacgaatcgccattggacggaaacgagtgtttcttattagcaaattgcaaaccgggtgtcctcagcgagacgttgatgtctagtgacaaatagttttcacggatgagataaactagtcttttcggctccagggatcaaatgtcaataaacgccaccgtaaaagattttttttctcttcttacccaaatgctactcttgacttattgataaaccaatgtacagaaattgtactgctcgttaagtttatgagatatactagtcacggtttctgccttctgccgcagctgatttggggatctctctacgttactgttgtatgtgtatttcagtcacccctgaacttatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13274 - DNA, 691 bp, Oryza sativa
ttaagtcttcaccgaccggcttgcctgagccgcccccgactggtgtctccgtctgcacggctggcctattatgccgtcgttgttgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtatctccgtctgcacggctggcctattatgccgtcgttgttgggcgtctacgaccccaccaccggcctgcctccatcgccgccgactggtgtttccgcctgcacgctggcctattatgccgccgttgttgggcgtctacgtcttcaccgaccggccgcctcgtccgtcgccgactggagtttccgcatgcacggctggcttattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggggcgacttca

SEQ ID NO: 13275 - DNA, 693 bp, Oryza sativa
agcgtgcaggcggaaacaccagtcggcggcgatggaggcaggccggtggtggagtcgtagacgcccaacaacgacggcataataggccagccgtgcagacggagacaccagtcggcggcggcgcaggcaagccggtcggtgaagacgtagacgcccatcaacggtggcataataggccagcgtgcaggcggaaacaccagtcggcggcggacgaggcggccggtcggtgaagacgtagacgcccaacaacggtggcataataggccagcgtgcaggcggaaacactagtcggcggcggacaaggcggccagtcggtgaagaggtagacgcccaacaacagcggcataataggccagccgtgcagacggagataccagtcggcggcggcgaaggcaagccggtcggtgaagacgtagacgcccatcaacggtggcataataggccagcgtgcaggcggaaacaccagtcggcggcgatggaggcaggccggtggtggagtcgtagacgcccaacaacgacggcataataggccagccatgcagacggagataccagtcggcggcggcgaaggcaagccggtcggtgaagaggtagacgcccaacaacagcggcataataggccagccgtgtaggcggtgacaccagtcggcggcggcgaaagcaaaccggcggtgaaaatgtagacgcctgaca

SEQ ID NO: 13276 - DNA, 11749 bp, Oryza sativa
agccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcacccttcaccagcgctacccggacgagttgcagcactcgccctaccgctaccaccctcgtcgcggaggagcccgcgacttcgccaccttccgggatgctagctcggaggatgacgctaccatcgtgcacctggcacgcatggtggaggcgtacgacgcggctcgtatcgacttccatcagatggtgcgccgcggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccgcaagagcacctccaggcctgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactgtgtcggagcctgtcttattttatttgcctaagcaacttgaactttaatgaaccaatttaatagcagtaataaatttaagaattatggtagtcgtgggtggttagttttaattgttagcttctctctctctgtttgctggttctgtgtggggttttcagatggtgacgaccaggagaaatgctgttaccggtgatggcaatcaacctgaaggcagcaaccacaaccaccagggcaacccacctccacctcctcctccgcctccgccaccaccaccagacaccaacgccattctcacccaaatcctcgcccagcaagccaacatgatgactactttcctccaccacctccaaaatccgccacaacagaatgctccacctccacctccccaacactctaaactcgccgagttcctccgcatccgcccacctaccttctctagctccaacaaccccgtggatgcgttggattggttgcatgccgtggggaagaagctggacactgtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgctcgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgcactgtcactctgtaccgagggccggaacaaccggttgttttctttgcacccccagcctctgtcagaagttcagaacttcatcagataggactgtcagaaatccccatagtcagggagttcggagacgtgtttccggaagaactacctggtatgccgcccaagcgagagattgagttccggatagatcttgctccaggaaccactcctctgtacaagcgaccctatcgtatggcagcgaatgaactggccgaagtcaagaaacagttggaagagttgaaagaaaaggggtatatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgacctgttcgatcaacttaaaggtgccactgtattctccaagattgatcttcgttccggatatcaccaattacgtatccgtgaggaagatattccgaagactgcattcaccacgcgatacgggctgtatgaattcacggtgatgtcgttcggcttgaccaatgctcctgccttcttcatgaacttaatgaacaaagtgttcatggaatacttggataagtttgttgtggttttcattgatgacattctgatatactcacaatcagaagaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctctcgccagcttcggcctcatgaaggcaattaccctacccatgatttggagttagccgctgtggttcatgctctaaaaatctggcggcactatctcattgggaatcgctgtgaaatatataccgatcataagagcttgaaatacatcttcacccagtcggatctgaatcttcggcaaaggagatggttagaactcatcaaggattatgatgtgggaattcactatcatcctggtaaggccaacgtggttgccgacgctctaagtcgaaagagtcattgcaacactcttaacgtccgtggcattccacccgaacttagtcaacaaatggaagccctgaacctaagcatagttggtcgtggattcttggctgcgttggaagccaagcctaccttgctcgatcaaatccgtgaggctcagaagaatgatccggacatgcatggactcctcaagaatatgaaacagggtaaagccgctggtttcacagaggatgaacacggaaccctatggaacggaaatcgggtatgcgttccagatagcagagaacttaaacagctgatacttcaggaagctcacgaaagtccttattcaatccaccctggcagtaccaagatgtacttagacttgaaggagaaatactggtgggttagcatgaagcgggaaattgcagagttcgtggctctgtgtgatgtgtgccagcgtgtcaaggcagagcaccagcgaccggccggactcctccaacctctccaagtgccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagcttggtacccgattaaatttcagcaccgcgtaccacccgcagacagatggatagaccgagcgtctaaatcagatcctagaagatatgcttcgcgcatgtgtcctagatttcgggaagacctgggataagagtctcccctatgccgagttctcctacaataacagttatcaagccagcatacaaatggcaccttatgaagcgttgtacgggcgcaaatgccggacaccgctattgtgggaccaagttggagaaagccaagtgttcgggactgatatcctgagagaagctgaagctaaagttagaaccattcgggataatctaaaggtggcccagtcccggcagaaaagttatgcagataaccgtcgccgtgacctggaattcgcagtggatgattttgtgtaccttcgggtcacgccattgcgaggagtacataggttccagacaaaagggaagctcgcacctcggtatgtgggtcctttccgtatcattgctcggcgcggagaagtcgcttaccagttggagctgcccgcctccttgggcaacgtgcatgatgtgttccatgtgtcacaactcaagaaatgtcttcgagtgccatccgagcaggccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaattcatcctcaaaattgtgccgagaataattaaaattcatgtgaaagcctccaacaattaaaatgtgcaaagataaaagtcaaatgaggcttggaggatttttatatatttcctaaaagcctaaaatgtgtaaataaattttagtggaattttcagagcacaaataataattgagaagaaataaacaaagttgaaaaggtttataaaaagaaaaccctaaaagaagtccttttcctccccttttcccttcttgggccggctcggcccaactcccccccctctctcctctccccgcggcccatcggctcctccccgcgcgcgcgccgctgacgggtgggcccgcccgccaccctcgctgacgggtgggtcccgcctgtcatcttcctcctcgcgccgcgccgccgcccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggtgtcttcaatggagccgagatctccgcggccgtttcctccctctccggccgcgctctccccctctcggcgctatatatttgctccccgtgcctctctcctccgtttccgccgctcgccgctcgctctcgccgtcggattcgtgctagcgccgtcctcctctctctccgccgtcgccgccaaccttcggttcgccgccgtcgtcactccggacttcctcccgactcggcgccacctccatcggcttcgccgcgtcgtcgtcgaccccgtccgctcctccgtttcgcccgccgactgccggagcaccgtcgccctcgtcatcccgaaccgcgccgccgcctctcgccgcttcggtcgtcgtttccgccgccctcgtcgtcccggggtgagccgaggaccgccgttcgctttccctcttctctccgctctctcgggcgccgctccgccgcgccggtggtcgccggcggtgaccatcggggagcgggtgcgccgcctcccgtcggccgtgccggcgaggccgccttcggccgcctcccgcggctgccaggtggggcccggccgtcagccgcccgcgcccgcgggtgcggctgacttgtgggacccacggcgccgaccgccgccagccgcgtgctcccggtccaccgtggaccgagaggctgacgcgtgggccccactcccgtggacccggtccgcgcgccctctctctcggctgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacacccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagagggggaggtgtgattccaattccacaataaaccaacaattccagagtgtccaggtgatatgaatatttcccaaagtctagagttggaaaacctcctaatgttacttaattaaattgcgaagcatctacctagaattaaactagtggtgtcatgagtagagagtccactagttgaggttttgtttgcctagggtgaacaaggtaataataataacaataacaataataatatggtcataacaaaggtaaataggcatggctaaataaaacagtgataacgcgggaatttaaataaagcgataatgcaataatttaaatcaacataattttacaaactggattcaatatgttcaaagatgatgtgacttgccttgctcgctttcccaaacaccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaacgcatttattgcgtcagccgggggagaggagcgcgcggaccgggtccacgagagtggggcccacacggcagcctctcggtccacggtggaccgggagcacgcggctggcggcggccggcgccgtgggtcccacgcgtcagccgcacccgcgggcgcgggcggctgacggccgggccccacttggcagccgcggggcgcgcccgaaggcggcctcgccggcacggccgacgggaggcggcgcgcccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggatgacgagggcgacggagctccggcggtcggcgggcgaagcgaaggggcggacggggtcggcgacaacgcggcgaagccgatggaggtgacgccgagacgggaggaagtccggagcgacgacggcggcgaaccggaggtcggcggcgacggcggagagagaggtggacgtcgcgagcacgaatccgatggcgagagcaagcggcgaacggcggaaacggaggagggaggcacggggagcaaatatatagcgccgagagggggagagcgcggccggagagggaggaaacggccgcggagatctcggctccattgaagacgccggcgacgattgcgggattcaaatcggacgaatccgagggagagagagagggaaaagagggggaaacgggagagggaatcgcggggaatgattcccccctcattatggcgcgcggggacggcgggatgcggcggaatccgcggcggcggcggcgctagggcacgggcgagcggcggacgcggcgcgaggagggagatgacaggtgggtcccacccgtcagcgagagtggcgggcgggcccgcctgtcagcggcgcgcgcgcgcgggggagccgatgggccggaggggaagagagagagagggaggggctgggccgagccggcccaagaaggaagggggggggaaaaaagacttttagggatttttctttttataaaccttttcaactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattcctttttgaaaatgatttttattttgggatgaatttatcaggacgtgacagtttgagccttttcttttccgttggtcgtgtagacgctgtagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggtcttcgggcctctgttgcaaagcactaccgtacttccacatgtctagtgggtaaaggcttagtttgtggctcaatctagttataacaaaagtacacggattgga

SEQ ID NO: 13277 - DNA, 33152 bp, Oryza sativa
tgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgagccttttcttttccgttggtcgtgtagacgctgcagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggccccgggcgggtttgagtatctgtatgtcgcgatcgacaagttcactaagtggcccgaggcttatccggtcgtcaagatcgataagcactccgcacttaagttcattaagggcattacagcccggtttggggtgcctaaccgtattattacggataatggcacccaattcactagtgaacttttcggcgatcactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccgcatccgggcccgatcactctgcgtcaacgacctcgtcctacgccgcgtccaaacgcgtgctggattgagcaagctctcaccaatgtgggagggtccgtatcgagtgatcggcgtcccccggccgggctccgttcggctagccgcgggcgacggcacagagctgcctaacccgtggaacatcgaacaccttcgtcgcttctacccctaatagggttcgggtgtcaggtttcgggctcgggccaaccccgtacccccctcgggcgtgcagggttggccgggggctaccacacatgcatattcttatttctcttctatctgtatttcaataaaagcattttcgatttcctaaaggctgtgtctgtgctgttgtttccttttgaagaatcttgacttgaaataggtcactcgtgctcgatcctgccctcgggggctcgagtcggctaaaatcgccaaaaggggcccagaaccgagccgtgccccggggcgtggtgaactccgggggggaatcggcaaaaacccacaaccgggtcacccataaccctcggtcaccacgctcccggcctggccagtctcgacacgtggatctccccaggcactagccccgacccgagccatttgaggactgggacctgggcacgagcccttgttcgagctaagacacaaaaggaccatggcacagatcatcctcgttctcatacacacagtaaaatgaaattgacacagaaatttctttattttgattgcagagtaagttaatctatacaaaaaggaggcccgaaggcttcggaagaaagaaaagaagaaaaaactatttaaagattggcggggacctggaggctcactccgatgcacccgggtcgccagcctcgtcgccactgtcgcccacaccgccgtcatcgccctcctcgtcggagctgagggcgaacgcgagccgaggggccgaaccctcgaagctgtgaacgatatggttggcggcgtcctggaaccgcgcgcgcgcgccgtcctcagtcccgggagggaactcgtccagcgccatccatggggagaagtcggggtccctggcctggtaactcgccagtacgagctccaccgctcctcgggcaaggtccctcgaggatgacttaatcgtcctctcgagctcctcggggagccgttggagagtcccggccatctccgagaggcgctgagcgaggcccccctggttggcggcgtacttcgcagtccgcccgccccagagacccgcctgccgcccggcgcggtctaaacgggacacggcgtcgcgaagcatgctgggccctatctcgcctgccagacgaagggcctcgacctccccggtggacgaattcagcgcgccctgcagatccgcgatggtgtgttcggcagctgcgaggcgggcggctaagtcgctgtcgcccgtggccgccccaccgctacgcgcccttgcatccagctcccttgcctgcgcctcgagttcagcggcccgttggttcagtgcggccctctcggcgcgggcaccttccagattgcgacgcgcttgttcctcttgcgcagcttcgcggagggacgcgctctccgccagcctttgcgctgcggcctcggcctcctcgagggctcgctcccgctcggtgagcgcatcctcgcggaggcggagtgcggattcttcttcggcacaggcggcttcgtgcgccgccagtgtgacctcccgaatggcaacggcggcctcgcggtccgccaggtccctctccacgacgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctcctcctccacctccctggcgatctcctccagcaccttccgacgggcttcgagctctgaggcatgccggcggtgtgccttgcggctcacctccaccatggcctccaccgagtgtcgcccctcttcgacgcgcgcccatgcggcgtcgagctccgcccgctctgcttgcagggcctccatctgggcacttaacccgtccaacaccgtggtgtttgcgacggccaaggcctgcaaaaggggctctgcgctcagtggggcaacggaaggcgtgggggagagccgcctcggtgaggatgccgcgcggcccggcccgccgatggacgtgccgggctcggggacgtcccccggacctggcttgtcctgagtgttgcccgagggagtgggcccaagcgatgtgcccgcggcctcgtcgcgagctgcctcggaagttgtcgccgcctcggcttggcgaagtctggcttcctcccgagcggcttcttcagcctggcgagcccggacggcctcccgggcggcctcctcggcttcccgtaggcgatccgtggcttctcgccggtcagattctcgcctccgggcctccgcggtcgccgtatcctcggcctcagactggccggacttggaatggcgggagggacgcgacgagatctcgctgaaacagaagaaagaccagaagacaaacaagatgggtgagtgaaaactcgcgttgggagaatgaatacagccacaatgggcgtgggacgaacctgcgagggggtcggttaaacgactaccttggaggggaaataaggtttccccgggatggttctgtccccccatcttgcgaagccgtttcttcttccgctccccctcgggctgcggcgtcggcgcggccccctccgggcgcctgctgctgacacgcgccgccccgccccctcggggaggagatggggaggaggaaccctcttgcttcctcttccctcgggcgtcggcagggcggcagccccccgagcccccgtcacggagcccggaagcacgaccccctcctggggtagattgttctcccctgcagctcccgcccgcgccatcatggcctcgaggagcctgctcctctgaggccccgaccgccttcatgatggtcaggatggtggcgcgatctggatcgctgcagagggggaggactccttgggggatgagcgatgcctccgcggagctgagattcagcacccgttggatcattaccttgaagtcttcagggacccagtcccatttgaccccccggtgggtcctcatacagtcctcggacccggtgtactcccaggcaccccgggcgcgccgctggagtggtgcgatccggcgacgaaggtagtcgccgtacaccatggcccctgtgagcccctgggatcgcaggcccgccaggcggtcgaggacggcgtcgtagccatctcccagatctaccggcgcccgccagctggaggcctgcgccgggggctggttcggaagtcggaggcgcgcttcgtcggcgaggggggtgtagaaccagtcgctcttccagtcatcccacttcttgtggaggacgcaaggaatgtagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatagcggaaccagccctgccattgcgaaagggaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcgcaagcggcgaagacaaggggaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtgaatatgcggctgtggcagtcgagatggaacatatcgtgcgcgcgttaattgcactcgccgaccgaagtgccatcaccatatctccaggcaaaacgaaccggctcgtcccgattcgtgtgctactcgagtaatgtggcagtcttgaagaggccgctcattattgacagtcgagttaccattgccgatgtgcgtgatttgcgaccgttgggtttctgcccaactgtagagaccagccccacttgtcaccaggcctaagtaagtggcgtcacgcccgaccgcttccctcgaggagggtgatcgccctggcataacgccgggggctactgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatagctcattcatacaatagttgcttactatactattaatatatggccccagtcatacacacactgtgttttggagtccgtgctgcagctggctacagatctgtagcccgctgctattctttttcattttttatctcataaaaatatgtttatagctaactaatggtatgctattgtacctgctctaagccagctatagacatattttaaaaagataaaagaggatagagaagtgcagtgggctacagatttatagtcagctgtagtacggactccaagaggcaatgtgagtatgacatgtgggaccagatattaatagtgtggtatatgtttctagttaactattgtatgaattactattactcaatccttcccaaattgatcatcatgtaaaagaatctaaaaattcttaaattgatcatcatataactgcatggacacggatttcagcagaatacagttaatacagcatggaagaatgtgtgcatgctatggtgtaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggctcccagggcggcggccatggtggcgcgcgcctcgaagacctagcactggacaaggtggcggaggcggccgacgcggtcgccgccgcgtcgagcgccggcgaggtcgtccgcgcgatccacgccgtcgccgccctcgtcttccccgtcgactccgctgccgtagccggtgaggctccgaatcctaatccgacatgctccctattcccatttatctcattcgccgtcacttggggtgtctgatggcctctcttgtaggtaccgtggacgaacccttcaggagccaggtgaagctctgtgctaattttaggccttttatttcgtccatctgagaaaaattactagtagttttatcatttgctatttttggttctggcataaacaatgatgtgtgatttctaataatcatggaaggggtctgtgataaaaaaaatggggaagtcttgagtttttgttttgacctgcaatcacaaaggactgtatgccgaaatggagcagtaattctgccacaaaaaatagaaatggagcattaagatatcatagtgaactattggttatgtggacaatgtttcagccgctgtaatgtcataattgtggtgcatatatttgaggaaattgatctctggaaggaattactccgaaactggattgataagcatccacagaattttccagttgataaacctataactttggtcacacaatgggtaatcgaattgcaggaccttgctaggtgagctgtagcagcacacattttgtaaaacctgtgtcatttgataatgcattcagaatacagaagatcatgtttcatgcttgagagataaattagtatggatattcaaagacacatgcttccttcaatatgattcagccaaatagccaattggagttccatccttttaggccatgatgtaacagggagaattattttctgtactttcagataattaatggcgtaagcctcagcaatgatgaacggggatcttggaggcatgctttttaccatggtccagcatttcctactatatctaagattttgcttggccgtaagtttactcttgaatctatcactgcatatatactttgtaccattgatattctttacatgtacaactctcctgtttgcttataatgttatctgccagtcatacaagtcatacttcatttgtattgtttatcgatctctacaatttgattactatacactcaaaacttcttgattgttcatcacagttaggtcagttgcaaagttccttcagttataatcccattctcacactttggttgtccagatgttgccttgaagtggttacgtcagatccgtgcctctgcaaggaaggaaatatatgattcgttttttgtcaaaggacctccaactgaagtcattcaagctcttgttcctgctttgtctcacaaaggaggctctaaggaagatcataacattatgtgttcaaatattgaaaggttattcatgaacaatctatcaattctattaagtttacacctgaatcttttattggtccaactttgtttgcttttactataagtctatagcacatccttctttttgacaattccctgtgagttcaaaacttcaaatattacacccaaaccttgtaggacaaaatttcaagtttcaacacttcgactacatgggtctgtactaatatcatgtatttgtccaatcgtctgctttgtattcttaagtctattttatgctcgagtcattaggaaatcaaacaatctagcatgcacacttcatctgaaaattcatgggtctgttcctatctggtatcttccttttttctcacccgataactatgttttgagcttggtgtgtcattatttccccccatttcaggctgttaattctatgtttggtcgagaataagggggtcagccagattattgcagagtttactgtaagcagcaagcacgatgatgacaacttgaacccaggcagagcagctttcatttcaagggttgctcaactacttgcatctgttccagataaaacaagaatgggagcttcacctgcactgacatcatcgtatcctcacccccaccgccccaaacacgacacacacaaacacaaacatctttgttatttttttcctttccttttattctgttagctttttctcagctaatatgtatttatttgcactatgtttgttcctccaaactgtaagtccttgatggaaaccaaggtcattcttcaagtgtgttgtcgatcagcttcttgttgcaactgaacaagcggctatggagttggctgctggcgaagatgctaatggactagatgcctccaattctgtgttcctcttcgtgggtgaagtgatatctcgtgttagccgtcgtggatctactggtgagtattcatccttcaggatgtagcttgacgtgtgcagtgtgctgttagtttatctgtttagacatttctatttactaatgggggcagttctagttggtgcagtaatggtttagcaatgcatttgtgtctggtaggattatagtgtattcaactcaacatttatgtttgcgatggtctgctctagggtgatggagcttatccttttttgtcctcatataatccttaatccttatgcaaactaattcaacacagtggtacacatttggttttctctgatggtccactaatagtcccttcagctgaaattttaaacatttaaggtagcctgtttttgggtttttatccagtgttcacttttggcaatcacagtagacttggggtctgcaatgcttgagatgtcacccaggatagcagtgcctcatgtcatggctgatcatcctagcacactgttctagtcattaacaacttcttgtttgtaatctatgtagccatccttttccctactatttgttgtatttctgataatatatcttgctcttttcaggcattttagttgctgagctgattcctaggatccgtagtcacttaaagagatgtatggaatctgatcataaaaccataagtcctgacaagatcaagcatgtttcccaattttggtttaatgtggttgaggctattagagaccagcattctgttgaaaggttggcggaagagatgttgcgccaacttgcatcacaacatacaagcgatgaggaggcatactggattctgtggactttgtttaatcagagcttcatgcacaaaactgtttttgaggtgagaatgagatagtacatgtgcgcattttaatactatgcaacacttgacgtgcttgttttttagtttatccacattggttcatctgtgtctggcatgctacatttatctgtgaaggaaaaagtacttctgaggtttatttttttcagttagtggatgttttaggtaaggtgaatgatagtcttcagataccctgtatgtctttgttacttcattcctatgaacgacaaacagggtgccatgtatgtttacttaactttcagcatgggcttatattatgggtgtctattcagcgtataattggcatgcagcgattgatcaaataatcttcaacgtgtcttttcttttcttttctttcatcctttaattctctgtgctttcttcagggcaatgtttgttgacaaatttttgcgttggaaaacattccctctatgttgtctgagatggattcttcactatgctgtctttgaattgccaccaaattcaggcatagaaacacagaagcaaaggacatcgagcttccttggtacactgcaaactttagtcagtgtttggtccaagaaagagtttgtccaggcatactcagtggagcaacaagcttgtatcctttgaggcactcaaaactgtattacattacacactttttatttgcaaattatcatttgacttgttccccttaaacaacactcagacatcactgcagcaattgggttgtgtttggagaagatgtcaaaaagagaattagaaacaactaaagatgtattgaacaatattcttgaaggtgtaagctgtgagtatccccccccaccccccctgcattagcttatcatattattattatggtaatactgaatgctcttttgctgtaggtaggttagagagtccaattgatttaatccggaagatggccagtgctattgcattgacattttctaaagttgttgatccaaacaatcctctataccttgatgataactgttgtgagaatgttgagtgggactttggggttttatctccgaaggaaatcacagccccttcaaaggatgtagaacttataagcaaactgaaaccatctttgcctgagaacaagaaacatgctggtgagagaagggcaaaggctattaaacatgatacttcagagaacagggcaaaaatcattgagatcaaatcactagattcttgtgaaacgtctggttctgctgtgaatgggcatttcggagaggaagaatgtgatgaggaaataatgaacattgatgcctccagtgattcatccctggagccatatgatctgtcagacgatgactcagatttgcagaagaaattcacccaattaaaagatcttgctgctgcactacgaaaacctgatgatccagacggtgtaagtttctatctagtgctacctgtactttccagagcaaattattgtaaaattctgatcatcctccctttttttttacccaaggttgaaaacgctctgagttctgccgaaaagcttgtgagagcatcacctgatgaactacgccacaactcaggtgatcttgttagagcacttgtgcatgttcgatgttctgacgtggcaatggaaggagaggaagattctgctgaagaaaagagacagaaggcattagttgccttgctggtaacctgcacatttgaaccattagatgttctcaccaagttgctgtactcatcaagcgtggatgtaagtcagcgcattttgattattgatgttatgactgaggccgcacaggagcttgcggaaactaaaattgtaaggagagagctgcggcatggaaacttgatatccgacacctctccctcttggctagttcctagtgatcagggacctgctggtgcaggtccttggagggaagtctcagaatcaggaacacttctgaattggtcacaccggtatgaaagagaagttccatctagatctggtcaagttaaatcaggaaaatctcgtaaatggggtcttggaaaagctaaagatttgcagacagagtggtcaaaaaacagatttcctttatatgctgctgcttttatgctccctgttatgcaaggatatgataaaagatcacatggtgttgacttgctcaatcgggactttgttgtcctaggtaaattgatatacatgcttggtgtctgtatgaagtgcatggcaatgcatccagaagcatcagctgttgccccagctcttcttgatatgatcagatctaggtatgccaagcctaaaacaagcatttccgtgttaaagactttcttagttataaccaagtggtacgattttgacattggattttgtttctgcagggctgtttcgcaacatcccgaagcatacgtcaggaggtctgtgttgtttgcagcttcttgcatactgatagcgctgcatccgtcgtatgttgcatcatctcttatagaaggaaatcaggatgtttctactggtttggaatggatacgcacatgggctcttcatgttgcagaaacagatcctgatacagaatgcacatcagtaagtactctggtctatatctgttatcgatcacttgttcgtgttttgttcgtcgacgtagagagcaattatggtataataggatgacatttgtttcttaaaaccacacacaataataataggtcattttttgacgaacaaaggagtacagttatgctggttttgtatcaaagtttgtctgcatcgcctaatcatttcagtaacctacccttatatgctttagttttctgtaacctactcatttctctcattccttcagtatacaaattcagtgacccagctcttttcagcaatttgtaacgaaaaacaggacatatttttacttataagctggaaaccagtttttacttaaaagagaccaattcagtataagctggaaactcagtaacttttcacactgtcatctaactcctcccattggcatgtttgtcttcaagatggctatgacctgcctgcggcttcattctgagatggcccttcagacatcacgagcactggaatcggcggatcacagcaaggccagcagcagcagcagcaggtcgctaccttctaagcttgataacatcatcataccatttgccaacatgatgtgatcgatgtactagattaagttgtaaataagcatatattatcttgccatgtaatattagaaattccaggtcagctaattctgattaggcttgatattgtcatattacagggttttttaatctgggatttgaaaatgctagaatttttgtcgattcgtgtggagattgtatggaagttgtcctgatccagattaaagagaattgatgaaaattgtacccagattgatgaactgactaatagttgatgatgatgagtaaaagagaattggacgagtcatgcaggggcgaggtatccgtggggaccaccagccacaggatggggccactcctcgagcgttggatcagccgcgagggacgatccgacggaggagattcgtccggtccaggtatttaagcacaactttttgcgcttcgcagcacaaccacttttccgcatctctctctctctcgcgtctcaagagcagcggcaaaggtgagaggtgagatctctctcccacttcatcctcctctcctctgtggtttcatccgccgcctccatccctaaaccctacttcttctccgaaagcgccgtgagattcttctccctactcttcttcgatcttgctccattggtggtggtgtttgtttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgtttttttttttggctcctgttttgcagttggtgtgttgcggaggtgtcagtttctgaatttgtataaaccaaatgccctcttcttattctttttgctgttcctgatgcaatctgcccgtcttccttacgtattgatcaagtagaacggcgcctcgttctcttctcgaattttaaggcgtttcggaatccgaaatttgctaagattttacctggccgtgatcatttttttcctcctgttcttggcttccctttcccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcatttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggcgttcggtgccgtactgtactgttaggttgttcttgctttttttcttctgttcttcattctctgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagttccgctatgggtaacagccttcctgtagaatcgaagttcacttttgaagaagagaatgacagaattaagtatgttgtgtcgtctatgcaaggatggggtgagaaaatggaagatgctgtgagtaaacttgcagccttttgtatgaaaaaaaaagggacagttctgcaaaatactgtgactgacatatgccctctatattctctagcatgcagctattctaaatcttgatgatgccacgtccacgtctttctttggtgtttatgatggccatggaggtttgctttcattctcattttttttttaatttcaaaccctccaaattgttggcgtaactgttatgtcatgctatgtttgtctgtgtgtatcactttgtttatctctgcgcatgttttgaaaactttgtggtatatgttgaaacatttacctgtcaattttcaaataaatatgatgctacagttatggataatgaacaagttagctaatcagtaatcacattcgtgtggcatgcttgcaaggataacatgaactacataaaaagaaattttaattcatgagagataaaacactgcatgaatatgagttactagtaatataaatggtgatgataatttagaggataattacagattaacaggttagtttttttttaatgatgcctattcaagtgttgttctgctactaatgttcacaacagtgttttgatttataagcttctatgcaatagaagtaatcttgatccatcgtattgagcgagacgccatactgaattgtttttttctatctcaggagctgaagtagcattgtattgcgcaaaacaatttcacattgagctatgcaatcatgaagactatcacaacgatctgattaatgcactggacaatgtgtttttaaggttattttggcctactttacataattttgtttatagctgcacttggaaatgtgggatatcattgttcgtgtgattgctgcagcatggatgagaacctgcaacagtccgatgcttggagagagttagttattcctcatgataatggatgtatgtattttctcaaggctggtgtctgtgctaagcctttcccacaggtagtaatcttttaacccctagcatcctcaaatattcatatcgtgaagaagttactcaaaattgtatttgttggacagtgtgcatattgtatctatgaaaaaggaaatggaagaatgtgtttgatatcgagactgttgttctttcttgtgatgtactttggagttggaggagatatgtttaaccctaatctcgactaattgctcctattaaaaaaggttcaattagttacatatcaattggctggtttactgagttggaggccaacaggttcttaagttctcattgcaccttggttcttatcatactatgctatccaaattgaggtattgtttgcgatatcccttcgatggttatttctttcatacattggtttggttttcagaaatgtttttctatacctgttggctttcttgagctattttttggtagccttttccttctaacaatgttgtgattctgtgttatatacttcagtttggttgttgttttcccaggcgacatatactgggccagcgtatgaagggagcacagcatgtgtggttgtcatcagaggtaaccaaatgattgttggacatgttggtgattctcgttgcgtactctcaagacagggtggcctggtatagtgattgtttccctattgaatttctggttaatacctaatttgcaagctcgttcattgtggtgcctaacatttgtgcttgtttccattttgtcaataggctattgatttatccttcgatcacaaaccatgcacaagaactgagtctgaaagagagagagttcaaaatgcaggagggagatctcttggacttaggtgtgaacaagtaatggggaattatgtagtcaaggaacaatgggtcctcggtgattttgggggaggtgtaacaatctcaagatcaattggtatagtcttgtctggatctgtttttcattgattgcatgtaatagcacaaaaagaagcacattacactgtgattggcgttttacctacttacatttcaggtgactttgctttcaagaagaacaaagatttagatcgtgaaaaacaaatgctggtatgtgatccggacatcctcgctgtaagtgtaactaagtgtaaataggtccgtttggtagaatatgaagttcagttttgccgggttgggatctgatggaaaattgccctttcaatgtcaggatgacataactgatgacatggagtttcttgttattgcaagtcaaggtctctggtaagtggtaactcttcagcaaaaaatacctgtcaataactattggatcatttttatgtcaccagtactcattggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcatggccgactcctgcgccacggctgacaccagcggcagtgccagggctgagagcggcgagctcgtccccactcccagcgccaacaacaccgtcacggatgaggtcgatcccactggcactgtcgcagccgacgacaaggtcgatcccaactccagcgccaatgccgacgctgacgacggcgctcccaaaccttctctcggcgcagtcatcgagtccgacgaggtcgccctcgatgccactgcaacgggccatcaggtggccgtgcgtcagcaggaggaattcgacccaaagaagtgttggatctgcggaaaaggctacaagaagattcttcttgaaccttcttcggccagggcgagaaacccacttctggctcacgctaagacgtgtgagtcggaagacaagaaggcgaagaagaagataaccaagtatatgatgaaagccaacgtcaccaaccagtatcattgatactgtacgttaactacttgcacctgtacgttaactactttgcttttggtgaagttttcctcattcttctagctctatgtgatacgttttggttttaaatcgattcatgcattggataatggatgttggtgaaatgaagggagtaatcagtcatatggttggtttaatgggaaagtctatttgtggattaagtagatccatgccaccatttagcagtgatggctattcggtcaagtcttccgataacaccaccatatcttcagcaactcacagtcgaatgaattatttttctaacttattttgtataaaacgaaatcctaattgcaaaaattttagatctttctgtatcctcaaggacttaagtgtgccaaaagatctcggtgggtctctccttgatatcccaaaaacttcatcccaaagttccattacaaatcccaaggttcgaattttgaaattcaaaacttgcctaaatccttgtgaatcacccaaaccctaaatccttccctcccaaaaaaattcaaattttccgagaaaatcatccaagcctataattttattattcccttaaatcctcataaattactgtgcacaaatatcaatatcaattcatgcaaaaattgcattggctgagtgcataatattaatagcgccatgtttcaaccaacaaagaaatattatatcaaatttcatttgcgtcgattttgattttggcctgaaagaagagtaacttcattgtgagatgattcactatatgaaaatataagagctaacaacgtcaatttgtgtcaattagtactaaaatcaacccaaatactataatctactctctccgatccccaaaactctcttgcgtcttgctgcccaaactcgtagaaccaaatatttatgtccgaggtgatctccttggtgttagacgaactggatgactttggtacaaatgctgtttcgccatcacgtgtaacaatgtcgacatggatagtctcaggccagtcatacagcctcgggaggaacaccttgttttgcatcaatctaagcttagtcttcctcaacattgtcgtgtatgtcccggtgaacaacgcatgtccttccaatgaccgcatcttctcccactccatcgtctcttcgttgagcttgacgacatggataggcgcaccactgtagccgacgaggacagccatgagcgcgccttggtcggactcaaacaggtggctatcaacttggtgtttgattccaaagcccttaggtttatcgggaactgtaaaattattgtcgtggttgcatggatcatacaccgccatcttcccgtcttcaccaagaacatacaacaaaccaccatggagcaccgggttgctgatcggcgccgccagaagttgcggtccttccacgtcaaagtccgttaattcccagggcccccactcgccgtcgtcttgttgggtcgcacgggcgagctgtagcgcgtacgtcgtgttgacgcaatacatcctccgcgcgtgctcatcgtagacaataaactcgaatgaatagaaaggcatctctggcagctcatacatggtgccggctacgagatcggcttggaggatcaatctaggtagacacagcgtgaggtgttgtccactggagcagcagatcctagccgcaattttgggcaccttgaggagcgtgtcggcgatctcgaaacacctgtggtagtaggggctgtagtacctgacgttcgtgacgccgatgtcggcggcgctcaggaggagaggcgtgatccacgccgggtagaagggcgacacggcggagcgccagtgccggcacgtcaatgcgaagctcgggtgggtcgaccacccgagccgatccaggacgagcacgagcatgtccaacgggagagacgaccagtcccgtagtccctgcgccgccgtcgcagtggcctccatctatctgcttggcgaatctcgagggttcgtgcaccgcaatggcctgcttggcgcgctgcgttttgtgctgctacggagctctgctttcttgacgtgtttcctccggactcatatataggtcggcttccgcttctgcttgtagtttgtatacccggcacggttggtttttgttggttgctatccaatctccatagatgcatatgtggtgatccctctttatccccggcccagattactgtttccttttactgatttaccggcccaaagtactagtactataatttgtttgaattttgatgtcgtgtaggaattcatgtcctaattggtactagtaatcgtaggtcgtaggcgtgcagatttcttcgcttctctttcctatatgccagtaattgcactgctcaaagcctctcctcgtttataaagcaccgccaaattcgttcgttttcaattgaccggccgtatcctacctgtgggacagtcggccatcaaaatcatggaggaggcaggcgatgcatctgcagcagtactggatcccaagcttgctcctctgcttctgttcggccacggcgacgccacgtccctgtacagcgtgccggcgagagcactgctgccaaggagggtgggcgacggcggcgtcgacgacatgatgagaggccaccggtggtggaccacggcgcagggctggctgctcatggcgcgccgcggctcgccgtgcactttcctgtgggaccctttcaccggccgccgtgtcgggctgccccccgaccacgacggcaccgtcctcgccgccgaaggcagcagccatcgccggaggtgcctcctctcgtgctgcggtcccatggacccggccagctgcgtcgtgctcgtcatcgaccacgccgacacggtgctctggtattgccgccccggcgacaaccactgggtgaagaggcatcagcaccagtacctccagcctgggccgcctcaccacgagcaccgcggcatcgtcatcctggcgttacgccagctcacggcgatggacggcgagttctacaccgatctcatcgaccatgtcgccgtcctcgagttctcactggagccggcgttcaccgtgaccgccgtagacgacgacgacaggaggccggcggtgtacatgaaacgtaccagcatctttgtggaatcgaacggggagctgcactccattctcttctctcacccgattggatgtgatcggattgtcgctggtgttggcgtttacaggctgagcatggcgacgacgcaggagcaaagatcagcgtgggtgaaggtggattcgctaggtggcagagtgttcttcgttcagataggctgttttggagcgtcacttgatgcacggacaacaggcttgagagggaactgtatctactactcggggttcaatgggaaagcgctgtgtgtctacgacatggaacgaggaactacggctgtaatcaaccccggagaacatcttccatatcaccagtcgcctaaaatattgatgccaaccagatgagcatttcttactccattcgttcgaaagtaatatggtaatctaaaattggatggcatgcattaaagatgtacaccaatgtagctatatctcgtctattaattttataagatttaatttcataagatataatatttttctatgaaacggggtaaaaatgacgggagatttgcaataatgacactgcaaacattgacctttgctataatgatactggacacatatttcatagacacatatggacccatttgtcatccactcggagtgtcaagacagcgaagccctaatgtttgttgtcccaatattgcaattttctctaaaaggaccctgggtgttgcagcgagagatcttgctatgaatgatagctcaacttggtaaattatctttgagaaaatagtttacaaaatattaaaatccagaagaacaaaataagagtcaggttcaactcaaagccaatttttcgagtacagtatatatatgaaaatgggtactcctagggagtacatactcccgctcctattgaccgtccatcgaagcaagccccgatgaagcccgttaccggatccacacgcggtggacaaatttccgtccgcggtaatcggaaaatcgaaacaatgttgagctcgcatataaatccctctcgacagccctgatcgataaatcaggttgtcaacgggcgattcagagcgaacaacggcgattttgtgacatcaatccatggcacaggtgatatgagattctctttccgtcttctttgcttttctcgtggagcttcctcttgttatatcagtttttattgctcatgcacgagaaacgatctttaatacctgttcgagactagtaatcgagactaaactttttgatgtttaattagtaccaattgaaacaacatgtagtaaagatgcatactaagtaaaaaaaaataatagtatgtgagatttgaattcaacatctcgtagcataactgtacaatactagcagatatattcatagttttattttatttcttcttaacccttgtttagttctaaactttttcttcaaactttcaactttttcatcacatcaaaacgttcctacacacacaaacttacaacttttccgtcatatcgtttcaatttcaaccaaacttccaattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacattgcccgtgtcttgtgtgtttccactttcgcgaacattccacagactaggagcttagaacctcacccagggccctcggccgaaccggcaaagggggacctgcgcggtctcccggtgaggagccccacgctccgtcatctgacgcgccaggtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggatgacgtagccaacttggtcatgacggcacggcagcacctaggtgttggtgggcggtcctccgccaccaagacctctggcgctgctaccaccggctccgtgtcgtcaaggcggagggcgcggcgagcggcggctgttgctcgccgttcggctgccactccctcgtcagcacctctgacccgggaagatcagcgtggggggccagatgcccgcatcggtatcgagcgccggcgtaatggtcgacgtgctacccacgcaacggagggtgcctcctcgtccggagtgtcacctcaacacggacgcggggatcagccctccgtgcccccggttggtggtgtcggctgtagagcctttgtagcgagccttcggaacgtccgttggcccccaaggttccggcccaccatcgccgaaaaatatgacgggagcgtcaaccccgccgagtttctccaggtctacacgaccgggatcgaggccgccgggggtgatgacagggtcatggcgaatttctttcccatggccctgaagggacaggcgcggggttggctaatgaacttgccacccgcgtcggtccactcttgggaggatttgtgccaacagtttaccatgaactttcaaggcacatatccgcgcccaggtgaagaagcggacttacacgcagtacagcgaagggatgatgagtcacttcgctcatacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcctggacctggaacccctccggttccggtgtggcaacttcggccgcccccgggtccgctgctcagacagggcgacgtgacaggaggaggaagaagaggtcggcccattccgacgacgagggtcatgtcctcgctgtcgagggcgcttcgcgggccacccgaaaggggaggcctgcgagcgacaaaaagaaggaggccggcgctcccagcagggagcgcccaaccggcaagtggtgcatcgtccacaacacctccctccacgacctcgcggactgccgcgcagtcaaaagtttggctgagcggacgagaaagtgggaggaggagaggaggcaggagcgccgagagggtaagtccccggcggtaccctccggcaatcggcgaagtgaggccaagcagaaggcccccgtcgaggacatcgatggcggcgatgatgacctaggctttcaggagcctggggccaccattgccactgtcgatgggggagcgtgtgctcacgtttctcgccggagccttaaggccatgaagcgagagcttctggccgcggcccccactcatgaggcgacgcgtcgggcgcggtggtcggaggttgccctcaccttcgaccagaccgaccacccaccgtgtgttgcccggggaggacagatcgcgatggtggtttcccccaccgtttgcaacgtgaagttggggcgtgtcctcatagacggggggggggggggggggcagccctcaacatcctttcccccgcggcctttgacgccatcaaggccccggggatggtgctctggccgtcccagccgattatcggtgtgacgccggggcacacatggccgttaggtcatatcgacctaccggtcaccttcggtggatccgtcaacttccgcacggagcgggtaaacttcgatgtggcggacctaagtctgccctacaacgcggtcctagggaggcccgcgttggtgaagttcatggcggcggtccattacgcttaccttcagatgaagatgccgggccccggtggccccatctctgtccatggcgacctcaaagtcgcgcttgcttgtatggagcagcgcgcggatcacctcgccgctgcgtccaagcccgagggtggcgacgagaggcttggcacctccgttcccgccgccccgaggcagcggatgatcacatgcgacgaggtcccggtcaaggaggttgccctgggtgacggcccgtccaagactacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtacggccgggcgcaaggccgatccggcagaaagtgcggcggcaggccccggaacgtcaagccttcatccgcgaggaggtggcgcgacttctggaggccggattcatccgcgaggtcatccatccggagtggctggcaaacccggtggtcgttcccaaggcgaatggcaaacttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactacattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcgaccaagaaactttactttcagatctggcggaaactttcgagagtctccgctccgcccgcataaagctgaaccccgataagtgcgtgtacggtgtacctgcgggcaagcttctcgggttcttggtctctgcccgaggcatcgaggccaaccccgagaagatacgagctatagagcggatgcgcccccagcaagcttagggatgtgcaatgcgtcaccggttgcatggccgccctaagtcggttcatatcgaggctgggagagaaggcgctacccttatttaagctcctcaaacgctccgggccgttcacttggacggaggaagctgaacgtgccctcactcagttgaaggcgtatctcagctctcccccagttttgatcgccccggagccagatgaacccttgctactctacttagcggcgaccccgcaagtagttagtgcggcgttggttgtggagcgcgatgaggacaatcctcattccgcgcatccccaccctgtgctggcttggcccgggagagagcagggaggagaggcccccgagccgaacggtggcccaaggcccccgacgaccggagctggccctctgcccgcttgtcagacggtgccaggtgcccccgacccccaggatggcccgggggccactgcgggaaggccgcacctatcgccctctgacctcgaggttaaccctgtgccgactcgacccgggagagagcagggagaagaggcccccgagccgaacggtggcctaaggcccccgacgaccagagttggccctttgcccgcttgtccgacgatgccaggagcccccgacccccaggacggccccgaggccactgtgggaaggccgcgcctgtcgtcctccgaccccgaggtcgtcggcacagaagacgagtgcgccccgcgaggccgcttggacgaagagcgccccagggatgcggcccctggcgaagaggatcggccccaccgaaaggtgcagcggcccgtctactttgttagtgaggccctccgggacgccaagacccgataccctcaggcccagaagatgctttatgctattctgatggcttcgaggaaactgcgccattatttccaggcgcatcgggtcacggtggttacgtcttaccccctcggccaaatcttgcataatcgagagggtataggacgggtggtgaaatgggcaattgaactttctgagttcgatttgcactttgaaccacgtcacgctatcaagagccaagctctcgccgattttgtggcagagtggaccccggctcccgaacccgtctcactccccgaggccagctcgggcccctcgcagctgcctcacaccgcccgctgggtgatgcagttcgacggctccctgtctcttcagggcgccggtgcgggggtcacgttgacctcgccgagcggagaaatcctcagatacctggttcgcctcgattttcgggcgaccaataatatggcagagtacgagggactccttgcgggacttagggtggcagctggactggggatccgccgcctcctggtgttaaccaggtctgtatggagtaccggtgctctgacccgcagatggatgcttacgtacgccaagtacggcgtatggagcgccatttcgacgggatagagcttcggcacgtgcccagacgggataacacgattgccgacgaactctcacggctcgcttcctcgcgagcccagaccccaccgagcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaatccatcaaccggcccaggccctgcagatcataccactttcatggccatttgctgtctgggggctcgatatcctgggaccgttgtcgcgtcccaaaacgactctaaaattcatcctcaaaattgtgccgagaataattaaaattcatgtgaaagcctccaaca

SEQ ID NO: 13278 - DNA, 18845 bp, Oryza sativa
aacatagtgcaaataaatacgtattagctgagaaaaagctaacaaaataaaaggaaaggaaaaaaaattaacaaagatgtttgtgtttggagcagtgggggtgaggacacgatgatgtcagtgcaggtgaagctcccattcttgttttatctggaacagacgcaagtagttgagcaacccttgaaatcaaagctgctctgcctgggttcaagttgtgatcatcgtgcttgctgcttacagtaaactctgcaataatctggctgacccccttattctcgacaaaacatagaattaacagcctgaaatgtgggaaaataatgacaaactaagctcaaatatggttatcaggtgagaaaaaaaaaggaagataccagataggaacaggcccatgaattttcagatgaagtgtgcatgctagattgtttgattcctaatgactcgagcataaaatagacttaagaatacaaagcagactattgggcaaatacatgatattagtacagacccatgcagtcgaagtgttgaaacttgaaaatttgtcctacaaggtttgggtataatatttgaagttgtgaactcacagggagttgtcaaaaagaaggatgtgctatagacttataggaaaagcaaacaaagttggaccaataaaagattcaggtgtaatgaaatagaattgatagattgttcattaataagctttcaatgtttgaacatataatgttatgatcttccttagagcctactttatgagacaaagcaggaacaagagcttgaatgacttcagttggagatcctttgacaaaaaaggaatcacagatttccttccttgcacaggcacgaatctgatgtaaccacttcaaggcaacatctggacaaccaaagtgtgagaatgggattataactgaaggaactttgcaaatggcctaactgtgatgaacaatcaagaagttttaagcgtatagtaatcaaattgtagagattggtaaacaatacaaatgaagtatgacttgtagagattgtagctggcagataacattataagcaaacgggagagttgtacatgaaaaaaatatcaatggtacaagtatgtttgcagtgacaaattcaagagtaaacttacggccaagcaaaatcttagatagagtaggaaacgctggaccatggcaaaaagcatgcctccaagatccccgttcatcactgctgaggcttacaccattaataatctgaaagtacagaaaataattctccctgttacatcatggcctaaaaggatggaactccaattggctatttggctgaatcatattgaaggaagcatgtgtctttgaatatccatactaatttatctctcaagcatgaaacttgatcctctgtattctgaatgaattatcaaatgacacaggttttacaaaatgtactccctccatactcgtaaaggaagtcgtttaggacagcgacacggtctccaaaacacaactttaacttcttgtttctataaaaatatttattgaaaagtgatatatgtatacttttatgaaagtatttttcaagacaaatatattcatataatttttacattttcaaactcaacaacttgagagttattcatgatttatattcccaaggtttgacttaaacattgtcctaaacgacttcctttgtgagtatggagggagtatgctgctacagctcacctagcaaggtcctgcaatttgattacccattgtgtgaccattattaaagctataggtttatcaatttgatgcttatcaattggaaaattttgtggatgcttatcaatccagtttcggagtaattccttccagagatcaatttcctcaaatatatgcaccgcaattatgacaatacagtggctgaaatattgtccatgtaaccaatagtgttcactatgataccttaatgctccatttcggcatacagtcctaagtgattgcaagtcaaaacaaaaactcaagacctcctttttttttatcacagaccccttccatgattttttttttttgagacagagagcggagaccctcccatttcattaacgaaatgataagattcttacaaaaggttcagagcaagtaaagaaactaaacatcacacaagcccatggggcctgacccaaaacatgacagccatgttaactacagcagctcaaagatgaaaataaaccgaagacattcagcaaaacagccagcattcaacaccccaaacgcctgacttgtggattccatccatgacttgcattgtagagatcaccggctacccttccatgattattagcaatcacacatcattgtttgcgccagaaccaaaaatagcaatgataaaactacaagtcatttttctcagatgcacgaaataaaaggcctagaattagcacagagcttcacctggctcctgaagggttcgtccacggtacctacaggagagcacacgcggacaagagaggccatcagacaccccaagtgacagcgaatgagataaaggggaatagggggcatgtcggattaggattcggagcctcaccggctacggtagcggagtcgacggggaagacgatggccgcgacggcgtggatcgcgcggacgacctcgccggcgctcgacgcggcggcgaccgcgtcggccgcctccgccaccttgtccagtgctaggtcttcgaggcgcgcgccaccatggtcgccgccgccgcccgccgcggagctgcttgggttgctcgccatgggaaggggggggggcgggggaagggaaacacaggacgaacctacgagagagcgcttgagaagggtggaggttttggagcaagagtaattaggggggttttgtttggaggtgaaattacagttttgcccgccttggctgccgttggttaagataaaaatttgggggtatgtttgagaatatcaaattttcaaatgaacttttattagagaagatgtgttagagaatataaaaaaaaattgaaggaattaaaatgtcgaatttcaattgtactttttagagaacatgctaccggtagtatactattgaccctcactcccgtttagcaatttaaaaaacgtgcgcgtggaaaacaagagatgtgagttaggaaagtagtgcgcgtggaaaacgagatatgtgagttaggaaagtggagatgagaactcagcctaagctttttttttttgtaaggttagaattgatgtcattaaattttgcatatttcttttcttcgatacagcaattaactaacttttctcagttttgacttttgacaaatcccaaagataggacataaagtagtcgaattatgcatcaaaagcggatgaagcgagtatagccaactgccaagtactcctacggagcatgatatgattcgaaaataagctcaaactttcgaacgctttcattacaaccaagaaacatttcaatttcatattattcccatcatgcttcccgaagaaaccatgatgaatttatcatggttacaacagaaacatccacttctacagcgtaacaaagaatggtactagtattgttctattctgcacgtattacattctgtgtgcggaactcaacacgtactgctcgagtacaatttcagagcagagggcagggaaatgaaaagaatgccatatgtaccaggtatagttaagttaagaagaaagaaaataaaactgtgaatatatctgctagtattgtacaattatgctacgagggcaatggtcacaagatgctgcctatcaaccataggtgcaagaagagccaatacaccatgagccctagccttgcacgaggccggttcatcagaatttggctccctgagaccctacagaaaaaaatacagggcagttagactacagaaaaatacagcgtggttagactaaaggcaaataaaatattaaaacgtgtagaaaagtacgagctacgaactcgtaggaagcactactctactcccagaagacgatcataattgtcaacacgacgaaaaaatcaacataatcccatcagtgtttgacagcattgtctgttgaagtgtaagctgcttaccagatgccatcaaccctatcagcaatctgttttccttgtgctggaatcatgccggatgtatgcagtgatttaaatacacgcccttcaatacagcaaatacagcactgtcaatgacacattaaaaatgattatttaaacaacacaaaaggatgctgttacctttgtcgtcagaatcttgtgcagtaattagtcgttccgactctcggccaatattcagaacaagatggtcagatgagccttttcgcattagtctagaatgcgcagccgtagggacagatgaaattgatgccttccccgctggtccctgcagagaagtggactctattgttacaaccaaagcatagatggaatattcatacatcttcacgagatgtgctggcatgtgtagtatcagaaacaaaaaaaaaatgcatgtataagatttgtggccagggaaatcacacgaaagaacagtaatactactatctaataatattaggagtgtaaatggcatatgctaaaaaggtaatggagcaaaagaaaagaattgacaagataatagacagacaaggtttaccaaatcttcagcatcagatatctctgaaccaactgctgaggaagatgcttcaaatgctctatccatattagcctctggttgcacaagccgagcatgatgcaagtcatcaaacatcttaacttttgttgacaactcatcaattgccttttccctgacctgcagctttgctcccagttcctgtattacagacttggcattcccagattccacatttgaggcaattattagtttttccagctttgataagagtgcttgtgtgcttgtaggcttgttatcttctagtgcttcttttcctccaagatatcctaatcgctgaatcattcgttccatactaactgttatctcaagtagttcactactctttgattccagctccctgcggtttgagtcactatttctggatgcctcctttagctgctccatttcacgagtatgggattcaagatttaaatgtaaatcttcattttcatatctcaaggtatctacttcgtgccgaagtgcataaacttcatcaatgagactgaagagcttttcaataggactagaggacatagccaattctctctgcaaatgtgactcagcagatgatgttaacttatttattttctcaacaagcgcttccaattgatcctttgaaataacctcagtcatacctgaatattttacagaggacgagagttaggacaagaataaaacaagtaaataggttctaagtaggaaattgtcaataaagaatgtcccgttggcagttgcataagagaaattacctctctctgttgtattttgtgcgtgctctaatgacagcaactctatctcttttgccttcaacatattccccctttcctggtactcttggatctttatttccattcctttgcgctcatcctttaatgtttcaagatctttctccagcacacatactctttttacatacagctcatgctcctgcaaagaagtttcagcagctgattcagtttgtttcagcctcatttttaactcatctaacatggtgaacactgcctctttcatattagataacttttctgactccaacttcagtctgtttacagtagatactaaagcatctgaaaccttagtgtaatcactagcatccacatccttcaaaacagatgaagatccttcaacttttgatacaatgctggagtttcctgttgccaattctattgcatagcctagttcaagaagatcatcagaaatggtttcaatctgttggtagcaataaatacaatttgatgacattgccctcaactctttctgtagagaaagcaattcggattcttgagctctattatgagtgtccttgttttgcaattcattcctcaaggtgtcatgctcttctagagtatgagcaactttgctacttgccaactgcaaagagtgatgaaccagcgtgatattttcatccatgtaacctgacaagtctttaaaaatctcagacaggtattcagcttggttgctcaactgttcaacaacagtagagaaggacaaagcaccatcaacattcctttttctgattttgctgcttgccattctttcagtaacaaagttatcgtagtctgggaaagagagaagcattcccgattctgaatcctgcttatgaacatatgaaatggtcagattatgtttgacatgattaagccaagtcaatcggcacaatttgagatatataaagtgtaagtcaggtaaaaacattttttggttccctcgctgaaatatctaaaagtttaaaaaacagaaagcctgcaagtctcaagtcattttaccgccgtatccattgttaggaattaggaaacagttacaaacacaataattgttctggagttacaagatcaacagatccataacacgagaactgcattgcgtacatgtataatggagtaactgttatgattagaagaagaatttagctagattgattggtggtaagatggagtcagtaccaaggtcctaactttatactaaaacttcagaaagctgtgtattacaatagaaaacataaacacactgaaaagcacaaacgctaaaatcataaatcatttaaacaaagagtcatacaattgagtgcgtgtgtgtgtgttggggggtggggggagggggcattgaggccaggagaggaggggcactttacctccattgttgggtcaatctgaaaaccctttgcagcaagctgttcacgcatactcctcacaataagggccatttctctcaaggtactgaccttctttccaaattcttcagtcattaatgataagaggctgttatccattacaagtgtactaagtttctcaaggtaaacatcatgttcagttgaatgactttgtaagtttccatgacttctgtccaactcttccaaacatttggcaagcttagcattaagagcactagtttctgtttcatgcttggcatcagcttccttcttttcagcatcaagaacagaaatattcactctagcctgtgacaatgcatcttgtagtgagttaatcgttacattggcatcttcgaatttgctggcataaatagccagttcctcatttgttttctccaactcctcttctacagcagcagtatgcaattgcatctgccgcttttcttcagaaatagaagagatatactcctttgaattactcaattcatcttccaatacctttaggctggaaagggcatcagcaagctggctagcttgtgaggtaacttgttcatttactttgtgtagctcattctccacagagctcttagtaacttgtgattccttgatatattgggcaatctgacctattttgtcgataggatcctcacatgggctatcgaaaggaagagaaatgcttgatatcaattcaactagagcacccgaagaaactttggcttctgccaacatgctttccacttttcccttttcgtcaataagggaaataatgtccaactgcaacttttgagagtgtgtgacctgagaagacagatgctcaacttgctctctgagatccgtaatggcagattctcttgatgctatctcatattttagattctccatttccatgtatgttgcatcaatgtcttgttttagcttatctgtttcagagttcttttcattcaatgtatgttttaaattctctatttcagagttattctcatcaagagcatgctttaacttatctacctcagagtttttcacatccaaagcttgttttatgttctctgattcagagttcagttcatcccaagcttgttttagcttctctaaaacagagttgtttccatcaagagtttgtttcaagttttctaattcagcattcttttcatccagagcatgttttagcttctctatgtcagatttcttctcatctaggacttgcttgagtccttcacgttcctgtaccaaacccttgccctttttaacagccattgacaatttctccctaagcaaagatgatttttcctccacccgttcaagctctttctgtaatgagtccttttcatttttcagtgcgtcagtttcctgtaccattctttgtaattcaccagatagcctcatcatctcagatctatcagccttgtcttcttcaagaattattttacataatgttaattcctgatctagggtataaacttgtgtttgaagcttctcgaaactttcacactcaacaggagaggactttgctcttccttggatgttggcgaggcactgttcaactaatttgccaccgtccaggatttcatggtcttccaattggacatcagaaacctctgcaaatgccttcacaagctcagtataccgcgacgagacaacagacaattgatcactagcagcatggtacagggacatcaattcagcatgttcatttgcaagtatgtccttttcctgcttctcttcaagtagagctattgtcaagcggtcaacttcctcatgcattgaattcaacttggattcatgtgaagccagtttgtgcagcatagcagaggactcatcctgcatccgtgctgcatcctctttagcctggtacagtgaattgagaagccaatggatttgtgaatcgagctcaccagttaagactgcatgtggaaggtcagttgaggctaggatatctttaactttccgatgctctgagaagatcatgtcagcaattttcttttgctcaaccagccattccaatctgtcagccatctccaaggaaagcagatcctctggaaatgatgcttctgacattaccccttcaatgcgttgaagaatcacatcctttactgaaagggaagtctgaacagaagtaagtgcagtgttttcttcagtcagttgctcaacagcagccttagcggcttcccatgcattatatgtttctcgaagctcatccaaacattgctcatgttcattcgacttttcatccagcaaaatcttgagttcctcaactctgctctcagctgcttgcatggcatctgacttctgctgcaactctgtcatgcacccatcaagctgagctgtcttttctgccaatgcctgcttcaaggaatcacgatgctgcaccaacgacttgccctttgtaacagccatgctgagcttttctttagttgtcgataatttatgctccacctgttcgaactctgcttttgccttttttgcttcagcattcactacatccagagcagctttcacactctgaagctcttcagcaagattcttgttttcttccccaaaagtgttcaccttctgcaggaaatctgctttattcctcttgctgttaaccagttcttccgaaacaatacctaagatggtagcatgatcgcattgccctgtagccccaaaatcaggctgtacctctgctagaacctgctcaagttgttcaatatccagtaagatttgtcgatgcctctctgccagcaatgaagtcttcctttcaacaagagatatcccctcttcatcagcaccctcactgctgacgtcatattgcccaaccacagcatcaacagaagcaacaattctcccaatagcttgttctgacccttccctcgacacctcaacctccgcagacctaccgcgtaagctctcgatctcctgctccctcgcacgcaccactgagttcagttcaagtacaagtctcgagcaatcgtcaagcatcgagtgcagcggcgtcagcgatcccgacgccctctcatcagagtcctccgccggcaacgatcccgaagcatcttcccccacaagctcacgcagcatccctcggagcgccacagcctcccgtgcaaacacctccctctcttcctgaaccaaattcattcattccacgtccgcattattacaaactattagctatatcgcatcaactattgactgggtagatgaggcaaaaagcgaagcgacaccttgtacttccggcactcggcggctaagctcgactcgtcggggaaatcgatgacagcgatagattcgtcgagggagcgggcggagcgggagccaccgaggtcgtccggcgcgtcctcgaaggtctctccgctggtggcgtcgtcggcgggcatgttgacgaggacgccgccgtcggggtcggcaccggggctccgcgcttcctacacgcagcagcagaagcttccataagccgtcctcctcacgcgaagccaggtaccatgacaaaaggacggccgagacggcggcggcggcggcgggggaatacctgggaggggagctcgacgaggacgccgtcgctgctgccgccctcgtcggactgtacccggacgcgcggcggggagcggcggagcgcggaggaagaggcggacgacgaggaggaggacttgggggaggagtcggagtcggagtggtcgcccatcgcggcggccacggcggcggcgggcggcgctggatctgggcccgggggggggggtgggatccgatcaggccatcgccgaggaggaagaaagaaaaatttggggggatgtttggtccggtggagacgatggcgtgtgggccccgatccccagggtgcatggaggtggaggtggagtagcagagcggcgaaggcttggaggagactgtgcttacgagtgggacccaggactcagtgggagatgggagggtgacatgtcaccttgccgcatttgtcagctggtcggaccccacgtggcggagtgtgttaaccgggctcccgggagatcgcgtgtacttcttcgtgtcgggcccccggtggtggattttcgccgacccgttgaccagtgtaaacgtttcggttgctagtattcaatctgtaaataaaataaattctaactgtatatttatcaatagaatttgagtgtttagactgagggagtaaatgataggagtatcgtaggaaagtaagcgtctgtttggagagcttctactatggccctctttgtttaggtttataagccaacttataagccgaaaagtctaagactaaacaaacaagcggctttttcgtttgtcttttttgaagccataagccactctaacactattaagccaaaagctaggttggagaagcttttttggcttatgtgaggtagatgtatgactccaccattaaacttaggatattaaatccaccggcttataaatcatataagctaataagctgacttaaaagtctaagccaataagcttaagcctaaacagagagggtctatatcttctcccagaatcaaaagcctccaatcagtttaggtcttttttggggagcttatcccagctgcagcttttcccaaaagatgcttctgctagaagctgcctcaaacaatccacagtttctgagaatctgtaattacatattctaaaaaatgaactaagaagccagaagctgggtttcaaagcttttccagattctcagaagttggctaccaaacagctgcttctcagaatctaaagctccccaaacaggccctagattttggttcagattctgagaagttgtagttgtaaaatactatataaaatgaactagaagtcagaagctgggaaaccccacttttctaaattcttagaagctagctaccaaccagatgcttctcataatgttaagctccccaaatatgccctaaatcttttttataaattttaatgagccatagcctaaatgataactttgaacaacaaaactagataggaaaaattgcaaaaaaaaaacatccataagttatttgaaagttttacattctatcccataaattattcttttcaagtgtcaaccaacctacttagttttatttaaaaaccatcatagtattcatatgtttaatcgaatcaacatgtgtttcataaagtgtgagctgtcaaggtggcttttactgaaactaaatcatttcagagtatagtcttgatattttttttaatattccacaaataaaattgttgaggagagtttaaacattatcgtactgagttttgttgtatgaaaaaaaaagctcaaacaaatatagaaaataaatataatgcaaacacttggacaaaattgattgttttgatttaccaccccaagatagccaatgcgcacgtgcttaattgaatcaatttaataatactatattagggataacgggttgtttcgattaaacacgtacgcatcgggggtggtatttacaacaaaactaagttgagggtattgcaaaaaaaatgatttatgaggtagaatgttaaattttatgtgacttatgggattgttttttaattttttccacctatatatgaaaatggaggtccctcgactattaaaactaatagattttatccctttgaacggtacgaacgatggttttatccattgtgacgttgagtgagccggctactgatcttgaacgaattcaaggaggggacaacttctataggatgaaacatcaatattaattgaactacaatttctcaaagaataagaaaaaaataaaacaaaagcttttgtcataaaagctataggaaaatttcaaaacaaaagaagaaaaaattatactccctccgtcccataatacaagggattttgagtttttgtttgcactgtttaaccactcgtcttatttaaaaattttttagaattattatttatttttttacttactttattatctaaattactttaaacacaacttttctttttttatatttgcataaattttttaataagacgaaggtatttttatagggggctaaccactcacaagaaaaagaaaatcataatttttggatggtcacttgccaagtttccatggttggtcaagcgccattataacactttatggcgcgtaacagtttccgaggcatgggtcccaccgcccacccccggaggctcgagcagtcgagcagcgttccctatctcgcaacatcgcatcacgttcgtccgatcccctagcgtggccaccgatccgcccgtccctgctctgggcttgccgcctttttccttctcccacgacgacccaccccaagaggcccagacgggagacggcttgccgcctcttctccttcccgctccgcgccatccacctccccctcctctccctcccctccgccgccgcctggcagcttccgcatcggggggaagcgcggtagcagcgctggtctgtccaactcgaggtggtgttatccccaagatcgagaaggtgcatttggggtggtgtttccgctcggagatggtcagagggacatcgacccggcaatactgtttctagaaccaaatgtaggtaaagttcaagctctgctcttgtgagttgtggctagaagatgattacaaggccctgtttagatctcaccctaaaatttttcaccctgtcacattgaaggtttaaacacatatatgaagtattaaatataggctaaaaaaataactaattgtatagactgcgactaatttgcgagatgaatcttttaagcctaattgctctatgatttgacaatgtggtactacagtaaacatttgctaatgacggattaattaggcttaataaattcgtctcgcggtttaccgatgaattctgtaattagttttttttattagtgtctgaacaccctatataatacccgatgtgacacgccaaaactttacacccctggatctaaacaccccctaagtttatttccttctatgctactccatctgttgcaaaatgtaaggagtgaaattaatgagagagatgaataaaatgagggatgactgagacgaggaagtaggttgagaggttattattacattttgggggtgaacttgagcagtatcgcacattgagttcgggtgacgcttttttctgttgcttcctgtcaataatgtagcctcatttttgtttttactgctgatttgatgctttctttggtccgctgtttgttccaggtgattggagagattcatcagtgattgctttagactagactgtactggggatttattggtgtttataaggatggatggtgctgttcgagggcagggatgcgtggggaggctcaggagcttcaacaaaacgaaaaagaagaaccggaactgcagtgatgacatgcgaaatggtgatgacgaagagaagaagtacagtcatcacgacatgaagaacaacttgcgaaatgatgccaacgaagagaagaggaagagcagcgatgacatgcgagatggtgatttcgaagagaagaagaagtgcagtcgtcacgacatgaagaagaacttgcgaaatgatgccaacgaagagaagaggaagagcagcgatgacatgcgagatggtgatgacgaagagaagaagtgcagtcgtcaagacatgaagaagaacctgcgaaatgatgccgacgaagagaagaggaagagcagtgatgacatgcgagatggtgatgacgaagagaagaagaagcgcagtcgtcatgacatgaagaagaactcgcgaaatgatgccgatgaagagaagaggaagaggaagaggaagtgcagtgatgacctgaagaagagtgtggtaaacgatgccagcaaagaggcgacgtcacacagtgactggagaaagaataggaaggctggaagcgatgctgagcaaagggggaagaagttgttgaatggcgacaagaaggctaagagtaggaaggtgaccactccattctttgaaaagatgcggaaaataaaaatgcagcgcacgagcaaccagaatggtgagaagaatatgaagagtgacggtgacagctataagaagacagtgccgctctcagtcaacaagggtaagatggagaaagatggaacgaacaagaggactttgtctaatacacttgttgcaaaggagaggaaaatgcgacctagtgacagtatggagatgaagatgaagaaaaagaagcgggatgcatcattcgttcaacctgatgagaggacagctcagacatttagcactaaaaacaaggaaaagaagaggaaggcgccatctacaccattgaagagggagcagaaggagcgagtggctagcagtgacaataaaaaggagacgaagaaggcttgtattgttgctataggaaatgagaaaaaaaattgtagggatggcaagaagaagaaaaggaaagcagccttcgcattcttcaaatttgtgcgcgacgagttcgaggaattactggtgtgtgcagatttctaattcctacacatacttgattatgtctgttgctcataagctcttctttaattagctatccatgaccttgagacttttatttgtgcttgaaacttggaaggtacttggaaattaatatcatctaatattatcggtcattggttaatttaaaggtgaccatatgctgtattcttctttctacaatcctgcctgccattgacaaccaggactaaatcaactacacagaggaatgatgaagaggccttgtacgaacagagtcagtttcaatttgaccttgtaaattattcagttacatcctttttaccattcttgaaaaggagccaagagcaagaggtgccagagtttataacatcgtgtggaggttttctctcatctttggagacttatgtacctctccagctctccttggagtggtacctcttgtaaccttcggagaatcagaaaaaaacccaatgaatgtatggcctgttctccgtagtgcatcgttatggtgctgtagtagccttttgctgccattgacatggccattaagcaactagtcatctttcttgttgcgaccataatgataaaaaaatattttggccgaaaggatcagataagcagttatgttttctttttctctctgtttacatggatgcatgaagtatccaactttctgtcttatttttaagttggcacctgcctcgctgcttaaatatctctccatagctctcaagcaccctaaaaagtctccgtaatttcagctctgttttttcttgttcattttagtgtcttttttgtcattgttttttcttcttgtactgtaccatgatgattatccttaaatattatatgcacataatgttgatttattcttgtgcagttcataccaccagcagttgcacccagccttaaggatttaattgatcgccatgtatatcttgaagactcagaggggaagtgttcaaagatcaggctatcggtggtggatggttccctagctttttatgagggatggaacagtttcgtttcagaacattgtattaagtggggtgaatttctattatttgagtacacaccagaatcaacattttctgtgcgggtgtttggtattgattcttgtgaaagactacatttcagtgtcaaaagcggaggaaaaggtgctgtgaagaaaaggaaagaaaggcatacattatctgatgatttgatatcacattataatggtcagtatcaggactctgaagacatacacgatggccccaatgtttctggtgaatctcctaggagcaaagagcccaaaataacagttgatgctgagattggtaccaggaatctagttgctaaatctataaatgcagcttccgaaacacaagactctgaaagagttgaaagtgggattggatatggatccttaggggcactaggtaataaggttagaaatttaagcaatggggagtgtgatacaaggagtgactctgtgttctgtatccaagaaaaaacaagaagatctgaggttattataataagtgatgaagcttattcaacacaagtagacgaggataccatgaagcaaacagcaccaagtgaagcttcagaaatacatcatgtgactatcaatacacaaaaagaccttgaaagagttgtagatggtgtttgttgtgaatcctcagtagcactaaacaataagatgggaaatttgatccttggagagcccaaaaacaagaatatttcaccagcatgtagcacagaaaaaacaaatggatctgaaataactccaaccaccggtgtaattcctttaacacaagaaaatattgatacggtgaagttaaatacactttcttgcttcgaggaagacagaagcacaacaagagaatctgaacttgctgctgctattccaacaacatcagaaactcatgattcagataaagatttaggacagaaacatcaaaggaattccgttcaagtaaattctatcatagctgttgataaatatcctaatgatagtgagatgaatattagtggaaatattttcagaatatatgaagctccagcgggtactcggtgcttggagaagtggaaaaggggtattgtgaacggtcgagcagctcttgatgacattggacaggttagacctgaaaaaacacaaaaagctggagagaagttagttggtaattgtggtgcaatgggagaaagtccagttgatctacggatagagtctgatgttactgatacctgcctcaaaccaattctcaacatacctattgaagaactctcgattcttgatagcgtatcaatatccaaatgcggacgtagcaggacagaggtcaaccatttgttcaatcaaaaaggtggaagggtgctacttctcataatacctatgatgtctgaaagcctgaaactatttttatttctcaaaagcctgaaactaacatttacaaagttagcttgtttagtttgaatataatttttatttacagcgtgtactgaattgtctatttggtaggagctactgttcaactgcaaacaaaaaaggagccattgaaaccaactggtagcagcggaaatagaaagggggacaaaattgcagtgtctgtcaaccgtgtatttgctcatcaatcaggtgaacttacctagtttatttcattgtaaaattaaggagaggctgaccaatttcattttgtgtttcttgttgggcactcaaattcacccatgcagaacttcagatcccccagcaggaaaatggaaattttaccagttgtgtaaccccagtggctctgctgcctgctaaggctgaactcctggatctggatgatcattcccttcaattctgcatcccttctaccattcagaaatggcttgtgagttgtttgtatcccatggacaatttcttttgcagctcgttagtattttattaaaacaagggcagaataatccatcatatctgctttcatggaatcaagggatagaaaaagaggacttttacggtactccctccattccaaaatataaggcataaccactcataactcaaagaccaagaaataattattatcatcttgtagtttggatcatcctaataaatacaatgcatgcatccaatagaattagaaaacatgagagtggatgatttaaaaaagtaataatttaatggagaagatgctatagttaattgcctacatgtatgcatgccttatattatagaacatttaacaaaagtggttgtgccttatattttggaatggagggagtacattgtactgcaagtatatactagcagtatatagaaaaaatgccacaccaagagtgaaaaataaggacttgcacttttggattgcgatggatctacccatctgcaacgtaaggtgtcgtggtccgagtccatgacgagcaaacaccgctggaggatagctgggtggtgttggctgctagccgctaggtatgaagggaggacttaggttgggatgaagaacattgagtcaatattaaagagtcgtataagttgtacagttgtattttcagaaataggtgcaagagttatataaggagtagagttctactttcaaatacaaacatgaattattaaaatattatctagcagtgcaaaaaaccatagaaatatagttttataaaatactgctaaacaattactccctccgtcccataatatagcaacctagtaccggatggga

SEQ ID NO: 13279 - DNA, 7470 bp, Oryza sativa
  unsure (1)..(7470): unsure at all n locations
gccaagatgcaatcttagtggccatgtcagcagaaacccaatcatatatctctagattgtaatgcgccaccttatgcaattcgtgaaggttttcagctacagtgttgtgcaatggatgcaatttgttgagttcatgctgattgcagtgagggcggtgtgtttggattggaaacatctgtttattatctaggccacataaaaaagcatcactccagaatagctcattgctggttatgattgtattgttgaggcttgaattcgtgtgttttctatttgtcttaattcgttttaggccgctgtaaaagatacccctctactagtatcacagtaggtcagtagctacttgttcttgggcatactcatcaatctactaagatcacaataaggaattgatgcagcataaaactttagttttgacttacacttgcctataataacgctataaagctcctgacactgttgatgagtatggcaagcccattgacaactgctctttctttgctgtctttgttcaggagttgcccaaatcgcttccaatcacttgtcggcaaaaaggaaggtatgaccggaacgtcgtaatcctcaaggatcccatgaggaggctatggccggtcttctaccatgacaaaccggtcttcgtaggcttcaccgcgggctggaaaccttttgctgcagcaaacaacctccaggctggggatgtctgcaagtttgtgaaagagatggacgaagatgagcttgcgttccaggtttatatcacaagaaagtgatggcaagtgctctagctgggtgcaccatcttcagtagaacatggctgctctgctccctctgtaaatataatcttaggttggtttgcttttatgcaatgttcttgctgccatatttttcgttttatccatcagggaaattcttgcagctcacatgttcacatgactctgtgcaggcatcaggaactatggcttttcttttggttgcaacgacaacaatgtgctggctggccaccaggttgtgtgaaagccgcggttctaggcgccctccactactgacgagatgatggttctttttgggttggctgttgtgctgcatacttgtcctgaccaattggtgtaatgtatatatatagccttgccgtccaagacgacaagctgacaatattgtggacttcaacaatgcaaaggtcaaggcattgaacttgtgttgaatacttgaataagatgttggcactttggaaccagactcccttccctttttttacctgtagacaagacaccacggtctaataactggctggtctaactgagtccacggtctcgcaaccaaggttcaccaaaccattttgggtggggttatcatcacactacagtttagcagttatcgtggtaaccgcgttgttaccgtgaaaaccgtgtgattaacacgaggtattccgtagttttaaaaaccgagaaaattaccgcacaagataactacgagaactgcacgaaaaccgtacggtaaacccctcgcaacgttaggcgttggccgatgccgtattgccgtcggatcggtgttcgggtcgtcgaaccaccgatggcggcgacggacgcagcgatcgatcggcacaggcgagagcccgagagctcccgttctcccggcgccgcggcagctagtgacacccgtatctcatgggatgggattactggcgtgcttcgcgcacgcaggtggcaacccgggaaaagttggcttccccggtgggggttcgctcgctcgatcggtcggggcagtcaagtgctggcggaataaaggaggattggtttgttagatggatctccctccccttgagcccaacggctcaagggggccttgacccgcgccctgatcgggggcgcccagcccaatggctggtgggccccgtcacactgtgccatataaagaggggtggaggacngnacngcataacnacacaaggaacgaggntcgnnngccgcgccgccactccaccccanaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaataggaaacactaacaatggtatcagagccatcctagcgtttatttttggttcggggatagacatccacagagaagaaagaaatccaaagcaaagaaaagcaaacgatccaacgtatcgaaaagatcgaaaccctaaccctaatcttacctcgtcgccggccgtcgttgacgccggccacggagggggagaggggcaaagaggcaccgccgaggagccactcgacagccgcgcgcgcacccgcgggtgaacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatgggccgaccggcaaaggccggaaaagttcactttaggtccctccgaaggaagcattttcaatatgtttaatgattgtgcttatttctaagcaatttgaaccaacgtgaaaattgtttagagaatagataaatgtgagaaatgcttctgaacatgtattttgtatattttcatgcaaattacaaaagaattttgaattgtttttacatgttttacctctgtttaaatttgaaccaacgggagaatttttacagagagtaaacaacagagttttgttattgtttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatgacaaaagagagagagggacaatgcttccctcatcatgtcgtatgacattgagcatgcgaaatggtccttagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaatcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcgtcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattctgatatatttgaaatggcaaatgtgaactatggtataataatgaatgtattggtcttgtgttgcaagatcagctttatttgttatctctttctgagaatgtgaatgttgtgtcctcgttgacaaaagaaaagaaagcgaactcttgatgtctcatcgaaattatggcactgttgtttaggccatatttcgagggggagaattgagagactggttaagaatgtaattcttcctccattggagttctcagttttagaacaatgcatacaatgtatagattgcatcggtgcccaaaacaccatatgagctatggatcctccatgtgtgggggagtcctgcaaaggataaagtatttaacccaaaacagtaagctgccattttattggctattctgaaagatcaaaaggtcatcatttctactgtccaaacagttatacaaagtttgtagaaacgagacacgccgtcttcttggaagacgaaatgattagggggagctcggtagttcgagaaattgatcttgaggagaggcgggtgtctgtacccgctccgttgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaatcaaatatgactccagagggaatatagaaaagtttaaagtgcgacttgtggcaacagttttcacgcaaagaaaagagattacaatgagacattttctccagtctcttgtaaagattccttcatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatatagaaaatgtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcaactgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatgatgtcttacagaaaagcagaatcgctccacatagtggggtattcgaattctgactttgcaaaagataatacaaagttaacatcgggatacatgtttaccctgacagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggccccgtcacactgtgccatataaagagggg

SEQ ID NO: 13280 - DNA, 11501 bp, Oryza sativa
aaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaataggaaacactaacatggttgggattgatcgatctgtctgttccatattccgcctgccgtctgtgaccgcgatgagccgatgacgccttcctccttcagctcacttcagtttcagctcgccaaaccccaaccgctccaagcccaatccgtcttgtccccttcgcacttgccaatgcgctccccgtgcagtgcaccacgcacgccatggaccggtttgtaactttggttgcaaccgctgatcctgactcccaaccgtacggtttacaacaccgaacagttatcggacaattatcacttgcagtaaccttttcagttttcgaaatcacggtataaccgtatggttttttttaactactcgattaccgtggtaactgtcaaaccgtgagacgacggtaactcattacttttttcttttttaagatctagaaagaatatcttttaccccgttcaaatactctataaataggtttaaattttggatacttgtggcatgcttttcaaactgctaaacggtgcgtttcgtgtgaaaactttctatatgaaagttgctctaaaatatcagattaatccatttttcaagtttgtaataattaaaactcaattaatcacacattattacaacctcgttttacgtgaaacacttaattttcatcttcagcagattcaaagaccaaattcctgaattttcatggttccttatgtaatatgtggtgaatactaaatagtctgatgtgtcttttcttcttttaatttgtaaagtagtaactgtgctggataagagtttagtctagtttagttttagatgtaggtgcaccaaactggtaagtggtttagtgcatacgtagttcagtagacgcattttatcatgcttaaagagtgtggtcaaacaatataaagctcatggctctgcttttgtggttaactcgtggtggtgtcatgctatcccatgcttctatccaatgtaaagattgccgttatccattgacattagacaacatttctcttacaacatttctattttataggatgtattttacaatgtatccaatgtaaaatacattgttcatcctataacaattaacggaggatcgctagcagaatcctaataacgatggtatttgtaatacaaagttacttgtacgatgacattgcatgaaattcacacttgtcgatggcttagaattaggtgtctgtcaatgatactcccttttttcttaaattttctcttataaatattctcccgattaaactaaaagacacacacaatactcgcaatcgcatccacacccacggatgtgtctcttatcatatggagatccagaaatccctaactagaaaaatcatttcaaaaatcaggtgcgtttcagctcgcaaatatgcccaacattcgcaggaaatagaattcaagctgacggaggaggaacgagatcctctgacgtagaagcctctacgtcagagggacgttcaaggcgggatcaccgtgcgtagcgcatccgacggcaccaatcattcgtagtgccagtccgttctccatcttcaacccagaagaccattcagtcgtcgccgccgacgctgagggcataggtgacgcttccgcctgcttggtctcatcgccgagggcgccgcctgcgaggtccaacaacccgccatgctagtcactcttcaacatggtcggcaagaaagtgaagtttccacaaatgatgttgatgagttacacacctacacagggaatgaatcgacggctgcttcatgcctgatgcagaagccagacgcacacacaagtgttgatgaacctgcaatctgtagagcagtccggagtggccatggccaggcagatggcggactgcggtgcccaaacagcggcggcaagagagacgctgcagccgacagcgtgatgaatggcgacaagagaggagtagcagctggtgacgcggtggacggtggcgagcaagtagcggcacccggcatcgccgatatttccccctcacgagtgaacaagtgcagctgcaaatgaggaccacattgcgctattcatcaggagcgttggatgcttgggggatggtggatcgaagagctactgccctctgacgtagttttcccaacgtcagaggatccggttccgacgagggagtaatagatccatgactctaaccgccatatataccaccctgtgcttttctgtgtacttacctactatactttattataaaactttattctttcattgtatttaaatcgaataacttcacaatttatttactctatccgtttcatattataagtcgtataactttttttcataatcacattttattaagtttgaccaagtttacagaaaaatttagcaacatctaaaatatcaaattaattttattaagagggcagctaccctacgggattctgttgcaacgtggtagtcacgggataactaaatcccccgacatatttttttttgaccgaggaccacactgtccacgcgattccaccccagccaaaacccggctcggtatcacgcgcctccgcgtgcgaaacctcgccggcggcgctgccgccgtgactactccgagcaggagtgctccttcctccaaccagctagaaccctgctttgcacgcaatacctcgctggcgccgcctgcaactactcctaggaagacttccccccagccagagcaggagaggaggactttggttgcgacagcaaataggagacaaggatcgagtctaggtaaggcagaagacaagagaacacgtgtcgtgcttgatacttgatacctcgcaaccagccatgatacctgatgccttacaggtgctcggtactaggtctgatacttgataccttgcaggtaccaggtctgatacctatgggtactagccatgataccataggtactaagtatggtacctactggtaccatgtctgatacctggatatcaaacatgatacctacatgtaccaaagtatcatgataccactaaagtatcacggcaataaagaaccaaaaatcatatgtttatcaagagagagttgaataaaattaataaaggaaatcaataccatgaataagtcatcatagctgtagaatcacccatagaacatgtagaacccaaaatcaaacacagaacaagacaacacctgagcttggaggtcgcgagcctagatctgggtgtacagatcacaaagaggtctcttgtccttgatgacggtgacctcgtcgacgatggccacctcctgaaatgtggtgagcagctccgcctccatcatgtgcttgggcacctaccccacgaacagcttcacgatcttctcctctactccgcccatgcctccaccagcagcaatggcggcggcggtgatggcagcttcctccacgctcgacgcgccaccctgcaaggccagttgccgccgttgcctccgtgctccatgagggtgctagtcagaaggagagagagggagagaggagatggaagggaaagtgatgagaggataaggttgaatagatggtgtgaggagtgagagttagaaatttagtggcagtagttatcctgtgcctatggaatactgttaagtggtttttctatttaattaattaacattaaatttgataatatgtttattttgtgttaaaaatactactatatttttctataaacttgatcaaattttaaaaagtttgagaaaaaaataaacgatttaatatgaaatagatggagtagcctctttttgggtctttcaccaactcaaagccagcgtgcaacggtattccagcagatcaccctggatggtgcaccggttccaccaaccccacgttcccagctaatatagctctgaccgcttccgcaccgcgccggatcgaactcatcagcatcagcacatctctcttctccgctccccccgaaatcctcgcgcgagccgccgccagccacgccatggccggcacgtgcgcgcacgccgagttcttccgcgcgcagccggcgtgggcgctggcgctggcgggcgtcggcctgctcgccgccgcccgcgccgcgctccgcctcgcgctctggctctacgccgcgttcctccgcccggggaagcccctgcgccgccgctacggcgcctgggcggtcgtcacgggcgccaccgacggcatcggccgcgccatggcgttccgcctcgccgcctcggggctcggcctcgtcctcgtcggccggagccccgacaagctggcctcggtctccgaggagatcagggggaggtaccccagggtggaggtgcggacgttcgtgctcgacttcgccgccgacggcctcgccgccggggtggaggggctcagggaggccatccgtgggctcgaggtgggcgtgctcgtcaacaacgccggtgtctcgtacccgtacgcccgctacctccacgaggtggacgaggagctcatgcgcaccctgatccgggtcaacgtcgagggcctcacgcgggtcacgcacgccgtgctcccggccatggtggagaggaagcgcggcgccatcgtcaacatcggctccggctcctcctccgtcatgccgtccgatccgctctactccgtctacgccgccaccaaagcgtgagctctccctcgtgttcttgtatcccctaattgcaagttcacaaccactttgctagtttgctctgtgttctgaagtatagttaagtttagatgcggtgctttaatttatctgaatgttcctgatgatagatggcggtagtgcaaatacttgttacttcactacttgattttccaacctattaggaagattttggggtttgaatagggaaaccgagcgcttttggtgtgagctgttagttttgaaattctgatgtcacacccgtatcagattctggtgccaatccagaagtagctggagactggaatagtacatcatttagtgcctttttagcttgtgatatgccgaagttgtggtcagatctgttgtgaaatcagtcagcggtctgttagtgaattagaagaatgtgaattgcttatttttaacatgccatagtatattaataaaatcacttgcagttgtttctgacgggtttgttacagtaactagatgctttgaaaactggagtacctggtgggtctattctcatgggatatggctcatcttgagtccaagaccaagaaatattgcagcacactagcacaatcatgtaggagtaaaaaatatgctagcaaaccacgcgcacgtatgaacagttggatcatttctcccttttttctgtgcgtaaatcttggcattatgcagaggtacatagcggggaaagatgaataaagtcaccatttctcctcatgtatatttttttagttgaagctgtttctgtataaacttgtgtactctctacaacttaatgcaagtttgcccatttccatgcaaattgaacacattaacatgtattactagcatatatattcctacaatttcataggaattgttaattctgctggagagaacagtgatgctctctctctctctctctctctctctctcttcatttcaatctacctatgttagctaacataggactgagactaataaatttttgtttctcagttacgttgaccaattctcaagatgcctttatgttgagtacaagagcaagggtattgatgtgcaatgccaggtaattactagtttctgtttctcaaagtatctctccattatgcggttcttgcaagctcaacatctgattttccttgtattagaacgtttggttatctaagactataaccttttatggccataatcacctaagtgcttgtttggtttttcctacatatctcttgtcagcaactgaaatttcaaacaaaaaacagaatacaccacttgtcttaatcggtctcctgtatatattatggtagaagctttatacaatatgttctctaaattaactagagtgtttctgaagttggtaagactgctaaggataaatcattgcataatgcacatagatgcaaccaaatgccgacaaaggctttctcaaataaaaccattattttctcatcatctactttattttttaagatcgtttctttttttttttactgattactgagctgtccctacttttaaccttatctgtcatgtgaaaatttagttatctaaaatgccccttcctgattcaaaaagaaaatagattattagataaattgcatatgtaaatgagaaacaaagagcacctcagtagtgtgaagtctcctgagtgtacttggtggtccaacaaaaaaaagaaagaaagaaacatctgaataatttccctgcctgttgttactatagatactgttctttcttctatatgaactgttgcacacttaaatgacttgtgatctgttcaggtgcccttgtatgtggcaacaaagatggcctctatcaggaaatcctcgttctttgtcccatccgcggacacctacgcccgtgctgccattcgtcacataggctatgagccgaggtgcacaccgtactggccacactctgtaatgtggttcctgatctccattctccccgagtcactcattgacagcattcgcctgggaatgtgcatcaagatccgcaagaaggggcaagccaaagatgctaagaagaaagcgcagtgatgcttcagattagtcattcttgtttgagattttactgtttcctgagcatgttggacaagtacgtggctccgctgtacaacttcatagatacattacattcccagtgtttagatcgtgagttatattccttccactgattatgaaacatgaacctgtagtccttgatttcctactgtaacgccagatttcaaagaactgaaattaactcgaaaaatttgagtatgcctttcagaattattctctctctttttcccgtattgttggggatacagcttcttcttgagatggcgttcctttcaagcagacagggtctatccagaattccagattctactcattccaggaacaagtccaaagtagagattaagcacaatgaatatgcaaaggcatactactactaatctacttgccaggtggcatcgtatttgggggcaccgattattctaagatgtgtgggcttgattccaaaaacacagaatcttgcaacatccatttcattcaagagtggttagaattagttcatacaccggtctaaacagttctgtacaaatcaagacagctaaagtagctctagaaagacgacgaagaaattctgtctgaactttctggagatgttagggatcaattgtcaactgcgcctcccgatcatcaccacggttgctcgtcctcttccccatggatctctggctgagcattcggctgatgccgcttctcagtttctgcatctgggacacactgccagattggctgccacccattgtcctctcgagctcttccgagagtgatctgacaaggtcgtcgaaacgacgcttggccgttgggtaccttgatatcgaccttgtgattccttgcaatcttgcataggattaaaaacagattagaaaaaaaagaactttagttggtaaaaaacaggaagggtgatgaacagaagtacctccgggaaagtgcgtcgatttcagcttgttttcgctcattcagtgatgatggcagatgaggaacaacctctttgaggcgcttcggatcactggtcagcagcactcgcttcttgaggtatgcttcttcctcttctgtaaaattctgggcttttatttgctctttgatgaccatcagaggatcaaagaaccaatcaaagattgtgttcttaggcctgttatcagatgttatttcagaaccatcacctgcataatatttcaaaaggtgagtcaagcaaagtcatagcacctgttttcgaatatgaaaaactattttattacttacttaaaattaggccatcagaattagcttttgcagatctaatgagtgcgtgaagaataacatatgccggcaaaccaacattaagtactccaatcccgatttttcctgactttgtttcttcaatgtcttttggtgttatcactccttcagcaaccagaacctctccacggtgcttacactcctcaaacaggtgatctagcaactaaatcataatatcaatcagatattttttttttcattcaaaaaatcaatcagacagatttgcacgagtctaaagcagactttcatgggatgtgcaaatgagaagtgaaaatgggacgatcgagcaggatagtgtaatctctagaagtctgaacaggtgttgcccctcctaatatagtagaatgattcaacaaaatctgccaattttagcctagaagagatcaccttaaatggattgaactcatcaaagctgcccttaaacgatgtaacacgtgatggagctttcttcccgtcttgcttgtccttaaatgaggcaggccttgataatgaaccaccctctgtcgaagcttcatttttccggtatttaaacctagtaatagaatgttagagttagcttgtatcattcagacaaggaggattcaaaacataaagagcatcgtgcatacctgggaaagcaggatcctggtgccatgtcaagcacatcatttgtatattcatcaaagatggccactgatgatattacataatttagtcccatgataagcgaggattcctggcacagagacatggttaggcttcatgaattcacctcagacagatcaatttatactagaagtgaaaaaaaaatattcacggtcagcaagtggctacctgataaaccacaacagcagcaaaagcacctaaaggaatactggagatgatggaggctagaaaagctccaaaaacagcaaatggccacagaagaatagcaagaccagcaaatggcacacaagctgtctccaggaaaggtccttccctgccgactaagtcttcgatcagccgcttccatcctttgaaaagcatcacagggaacttgtagaaggcaattagtgtgaacattattccatccactagaaatccacacgcagcagcgaataatgcaccaggaatgtcaagcactctgggagatgtagaagtattatttgactttgttatatggaattcttcaagaaaataagatcaaggcgggcattcagaaataaatataaacagcaccaattttgaaattgtagcgtggtgaagttaaatttatgagggaaaactcccacatatcattgtaaattaaggtttcagttcaaaatctattgcaaaccttaattattcatgcatgtaagaacaaaggtcccagatagcaaaaacaataactgaattcatgagaaggttgcactgttagaatcttagatgaagattccatgtcctgacaataaaatgcaaccttgaaaggagaaaacaaaccttatttcatatggctctcctccaggaggtgcatgaaaacgaaggtcatccattattgaaaaatatgaatgcaataataaatctttcaggtccctaactactgtacagcttcctgttatagtactccatgttccatcctgcatttcaagttgcatataccgatgtagaacttgagaagttattttttcgaaggaataaatctttagaagtaagaacaaggaaaatgccagagtaaatcaacgaaaaggaaaatgtaccacaaaacagtggtatagtggtctttcttttccttctccaactgcatcaaatgtggccattactggagcgagaaaaccatacaccacaccaattaggacacttcccacgatcccgacaatgagccataagactaaaatcacagatgcggcgacaagaagaagcagctttacaacaggcccgacaagcttggatctgctttccgaaaaaaagatgacaagcatatataagtacagttttcataattatgtggtaattctctttggaacggatctgtactgagttgtgaatcctaaacctgatgatgcagtagtatgtccagatcacatgcataggccataagccaagaacgagtgcagagattccgatcatcatgataagccatgcccatgggaagagcaaagcacctgcataggcaaaattaacacgtagggaggaattgcaagtcagaatctgaggttcaaaaatgggaacatgggacggcaaaaattactaagtagtatttgatcatatgctgaaaaggcatttaagttcgtacaacgattttgcattctggaatttacagatacctagtaccgtacttcaattccccttttgcaatggacagttgcaatcagtctaaatgaagtgcaagtgacgaactccagctgaaccagaacaaaaaaaaaaagagaggctaaaatccaaaaaactttaactaatcagccaaaaaagaaggaaaaaggaaaacaatgacatcctctgagcgattccaattccaacccactcaaccaaactaccctaatgcaaggaaaatgcaaatgggtcacccagagagatcttcggcttgccattctgatcaaaaactaacaaatgcgccacaattccacagtacataattacagagacactgctatgtgaagttctcctctaatactctcatgacaatactttcttagcacaaacaaacagaagcaaccaaacaagatgaaccaatacaaccagtgttttctcttcacctttgatgatccccaggaggagaaggccaaggaagaaaggcaggaacttgaagaagctccaggcagatgcccgaatcccagacggcggctccatcgacaaccttccgcccaatctcttcctcaacgccgatcaaccctgcccaacccaatcacggcaaaatcaacaatgagtaaaccgaaaatctctccaggaaacggatagaaaaaaaaaagcagtcaagcagcaagaattttccaagaaactcaccgctcaccagagcgtcgtcaagtctcaaagtccaaaccagagagagacgcgaaaccctggagccccaagaaaacgaaaggctcacgaactgccaagataattgaaaattaaaaccggacgaagtgggggctagtggtggttgcggtttggcaagaacagccgcgccctggagatcggcgtcgcgtggctaggatgggccgctaactaatcaaaattaccaacacgcacgcacacacccatcgaaagcaaagaaaagcctcctaattgatattatactaatcaagaaacagaaaaggcaggggcggagagagctgtctgcttcgctgcccgccgaatctggtgcccgcgagcagagcaggcttagggagga

SEQ ID NO: 13281 - DNA, 15828 bp, Oryza sativa
  unsure (1)..(15828): unsure at all n locations
ccccccccccccccccgaaattttttatttttgttttatttgtttgatattttttttcatgcttaggaacacacaagaaccaaccatagaaaaattgaactcaaatggacgtaatatgtgacatgtagaatttttcctctcctctcttctctccgaactagtgcagaggagagagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaaacggaatttgggggatttaatatcgccgaacccggcaaagcggggagaattggatgtaactttttctgtagatgtctgtgcatatattattttcctgatttcgagtccgtataagaaagttacgcctatttaaatagatgacatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaattgcatgtctatgtactgtttaacttatatatgtcatttcatatgattatattttgaattagattaagtaatttcatatagtggtagagtgcattatgtttaacatgctaatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacagaaatggaggcggcggcgccagccatgctggcgccctcctccctggggcggcgccagctgctcctcctaccacgtcggttcgcgtgcgccacggtggcaggaggacggcgccagagaggctggcgccgtcccgttggatgacggcgccagccactccggcgccccaaaaaggaccatttctaggataagtttttttaggggtctatttgcgaaataaattttttaaaaggaccaaaatatgaaaaatccagtcgcgtggtgaccggagcacatgccatccgaattctggactgcgagaagagaggccacagtggacaggggaaagaagacaaagatgtcaatagcctcgtttgcaaaaaccgttgtgcagggaagcaccggaagctttcgcgatttggatcccgaccaggtttaccaaattatctggagccagatcacctagagttaagtataactctaccgggtggagttggtcaaatctgtgccattcggcatacttcaagggctaggattaagccacattaatttatacttaaaaaccagtaactgaccatgcaacaaataatcttgcatcaacagcttgtcacgagatcatttttaccgtataattagcacaaaaaattcaagattcatctattatttaaaaaatcatacacattaatattgatatggtttgctatttgcatatatgtgaaagcactatgttgatatacactgactgccgctttagagttgatcgactatatctgttgtttggggaataacaaaacgttgttctgttacatttttttttgggggtgagaacttaatcaaatcgctattattgagcaaacacatgaaaaaactaagtcataaccattaattaatttaaggagttatttattaggtgaaatttccttcaaaaaaaatttattaggttaaattgatgaggaatgatctcagccgtaggaaacaatggatagcacagatttggccaactccacccggtagagttatacttaactccaggggatccagacccttgccagtaccacccacgatttagcagttaccctggtaaccacatggttatcataaaaactatgtaattattatgaggtataccgtggctttgaaaactgaaaaggataccgcacgtgataaccgtgataatcgcacggtttgataaaccctagacatttcatgagattcgggtattgctatttgtgtactcacacttgatgggaggattcctaatcatcagtttcaatgaactatacatctatttccttattagagtgtccatatagcacctgacatgtttcttaatcgaaattagttggctttttttaattatgttatcaacccttaagagctctcgtataatatgatatcaaatacatatattgtgtagtttatttgctacatcctaattcaaaataataatattagcaactcgtatatactaaaattacaaataactatagtgtactaacattgtcattgcaacgtgaattttattttagctatacaaccaacacctgctgcttgcttagttagtaaagagttgacagtggtacacaagatcaatttcccacaccacgagcacagtcaaccggttagataactttaattttatgtaaagcggtccgcactagcatgaggccatgtttggttggagggactaaagtttcagtcccttttagtccctaaagtctcaaacaggagggactaaaaatgacttaaagtacattagtccattagttcctatggtaggagcttattgggactaaaatagctcctttccacccactgcccccacacataggcatggtgcatctctctttacatgcttttagggtagcatggccattatacagtgtaattaatgaccttcccttttagtccctatatccaaacagccgtggactagcgtctgtgattcatggatctccgatcgggaagtgtttagtcctaggacttattttagtcctaggaataaaggatctaaacaccccctgaatcttgatgaaatccttatcaaccggtagggctatggtacctagattattcctctcacacgagaagagaacacgagaagagaacaaaagtgtatacgatatattatacaaatatatgcctatttaatgtgatagcgtaccaatatgtattttggataacaaccatacatcagtggaggacaatagcagagagcaacaaactaatggtgggagtacggtggcagagggccagagcatggggcaacgaactagtggtgggaggatgacgcaacaaaatggtggtgggaggatgagagcaacaaattatcaacgaagaacaacattggtggtgtagtagcatcgacagagtatggattggagcaatgaattggtggtgggaggacaacattgatgtcggtggtgtaaggattaaagtacggagggatgtattacggggcaatgaactggtggtaggaggacaatgttggtgtcagtggcataaggatcgaaatgtgtaggggtggagcttggggcagtagattggggtagaaagacaagatcaacaaactggcacgatgggagatcacgcaatgattgaagtgcaaaggttcaaaagcaaggggcgatgatttggcgtccgacgactccctagggttgtagatttttgggagaaaaggattgaagtggagaggggtggatctggggggggggatgaaatagcgatgacaagacgggggataatgaaatagtgatgggaggatgggggacaatgaaatggcagtggaacgtataaggattgaagtgtatagggtgcagaataataggcaacaaatcaacaatgggaggacgacatgacgttggtggcgtagggattgaagttaccaacatgaaaatggcaccactgccaacaacgtcccgagggttggagagtgagagagatgacagtgaattttcaatagcatataagaaaaccaatgaattttcaatttcatataactaatttttcttactattaaagttgaaaaaaaagtgtttaaggtgtaatgtaaggtgacttcaatacaaatcagctcaatattttcatgtaatttttgctggatggtacattatgataactgataggcgtaaggtgatacggtgatacaaacacgtcaatacggcacagttggtacgtaccacagtgctatcagtttagtattagtcaatgagagtgaaaaattctaacctgactgacgggccgtaactgggcctctcaggtccgacccgaattaatgcaacgagagagaaaccagcctcgcgcggacgcacacaacagccgcagattttgacggcggctgcggcggggagcccgccaccgaccgcccgtgatcgccggccaccgcaacgctgcagacctgcagtaccacctctccctccacgcgcgctcgtacgctgattcgacgggacacacaggacgcgaggacccgcgaatcgcacgcgcgcgcgcgcgactattccacgttgataccagcacgcgagatcggcgagcaatcaatccgcagatgtggcagatgtggtgtggatagaagcatggcttcccatggagtcatggaccatgagtgagtggtagtggacttgcttcctcttgctgatgatgatggggattggagaaaggaaagaggcatgagcttttttcccccctttgatgagagaatcagagaatattactaggtcaacttttgcatcaacaagactagattgggaatctgggggtaggcatcgatgcatgcagttaagatagagcgaaaaattctcacctttttggcgccaaaacgcagcctaattcatcgtcctttcgtagctttatttatgtactactccactatacaacacaagtactgcccagtgcaggaatggccggggaatgcttatcctcttggctgtttgacaaaactgaagtgctgaacagttctctgaactgtcaagtgtacatccagaagcaattggcctttgcatgaggtagttctatgaatgctgcattccttgtctccaagaatacttatgtaaatttcgcatcttactagtaattgtggctgtttttcactgcccttttattcagaagctttcaggcaggtttaccattttgcgaaattttatgaacttgtcatttcacccacttttcaggaaatcttatgaacttggtatttgagaatgttggctgtttttgacattccctttgttcctacatttggatctgcgaggatcaatttaattagcaattgccctggtcttagcgtgagaagtgaaatacttgagaattaaaacagcttataaatgaagtaggccatgccctggtctttgcacttgctttcttctgaagcctagtgacctttcttttttagtgtttcagtgtcaatgctgtcaattcaaacatgaaagagataagcgaaagctttattccagtgcagatgttggttgttgatgtctgtaaatggggaacatctcggtgactattttgtactcactgacagcccaatctgaaatctttaagggctcattcctttcaaaagatttccaaaggattattgtagtaattgaaacctcatggtttttttctttgtgcattatttgtttcatagtaacagatcctacggaatatgtaaggattgtatccttataatcttgttccataaaaaaaacttctaaggattagagtgcatgtgtcatcctaataatttacttcttttaatcctatgttttggaaatcctatgaaccaaataagccctaagcacaaggcgagtactgctatacgtacgacccagttatacaactcacatacaactagagatatgcaaccatgtatcaatcaaaggagagtatattcatatgtattgcagccgtttgcaatcgttgatgtagttcattcatacgtgagttggacagttaggtcgtatacgtagcaatttccgcacaagacaacttagcacattgtctcaaaactctcaatggcacaaccgcacaatattttccattatcacctaaagattttccatatcaccaatgttccgtttcttcaacctgaagcatcattcatggctctttctccatacaaacaacatcgcaatcaaaatcatgaggaatccgacagaaggcaggaacaacgaaacgaacacacacattcagtttccattcaagaaaacacaaaatacatcgtctttagcccccatttcctgtccataacctatgtaggaatgggaaaaagaccagagcacagtaccagggaccataggagcccagcaccaaagcttagcatcacatcacatcacaaccaccatggctggacacttgcaactaactaacccatcattaaacaactcacacactctcatacactctcatgttgagggaccctttgccctaccatggagtggcaccactgacagtaaactaaagagaggagggggtgaacagcaccaaccccccacctattccggatataataaaaccttccagaaattgagatgtcgatcgactaaaattgtagtacaacttattaatagtactctaatagttagcgtggtaacagaacaggggtcacggccaactaacccttagacttggataaaaggctggcacgggctctgcatgacccgggctgctgcgagggcagcccggaccttcatgtccttaagggcagggtcctcgaggaggaggaccttgtccttgtccctcaccccaaccatgtggaggtgatcggtatcctccctttccttgcccctaaacagcagcctctgctccctgggctctagccctgtcaccatggacaacctcaccttcagctcacctgcaatataagatgcagaatattgttgttacatatacagaacattaaattcaggcttgggcttcatttataatagtagattgtttgcttgcttggaaataaaaaggaaattgtagcaggaagttttgcaattttgtctgcctccaagccatgttattattgtcaggcaccggcagatgcatacaatacatatatgagcatgtgctggcagtgccggtagcagccataaatttctttagcgtgtatgactttttacaagtaaaagtccattctgtacagttatggagcagtagtggtacactgctattctttttttcaattaaagcaagcaaccctcctagttgtcaagttaacaaaaatgttggcattgcccaagtgcaaaaggaagaaggtcacattttggcttgtctaggatatgcaggtgaaatgatggaacagtcaagaccaaaggtagtttaaccttgctaattgtgtctttatgaacacctggtgagccattatctgactagaacaatcttgaaaagcattttagttttgcaaggaaaatgtgaagcaaaagagtgctactactaactgaaccgatatttacttcacaccaaactggcaaagtgtgtgggggaggtgtgatgggttcttaactgcaaccaatgacccacctactaccaaacaaaaaatagtggaatttccctaaaaaattgatgaaattttcttcctctctttcttttacacttctttgccccccagcttttagctgtaaactaatagaccttactctaggattcaaatgcatggcaaagcatctgagctgatgaaaaggagtgcagtgattcagtcctgaactttatcgttcttgcaaaaagattgtgcattggtgatgaggttcccaaagaaaaccatgaccaaaacaagttccaagaacattctctaaagttcaaaaaaaaaagagagatagaaaccaacatgaacatttcctcacatcagcccaaacaataccaaagtaagcaaacaaaaatattcagtttccctcaagagagaaacaaagactgagaactctgaactcaccgaatgtggaggtcgcagcaatggacacgtcgtgccaggcgaagccagtggacaccctcaccaagatcacctcctcgccgcctctcccctccctcttctgcaccagcatccctcccggcctcacctcccaccctatctcccccgcgccgccgccgccgccgccggcggccaccgcattgccatggccgccgccgccgccaccgacacaagcagtcgccttcgacgaggagcagctcctcttgaacagcctcttggagtacctcagcttgatcatggcttctcacttgtacacaactctgaagtctgaaaatggtgaaggctggctaagtggtgacagtgccaaggaggcttgtgcgctgtatatataggcaggtttcagaatgggactttggaagcgtgcgtctgcttaaagagtccaacgacgcatgctgcaatctctgcaaagtccaaagtccaaaatgggacccaattaaaaaatataagggcccgtgttacagaactattccttccgtttttttaatagatgacatcgttaacttttgatcatttgtttgatcattcgtcttatataggaatttataaatatgcaaatatctttaaccataaagcaagttataacaaaataagtgaacgtaattttctgaataagacaaatagttaaatgtatgtgcaaaagttaatgacaacatctattaaacattatgaggagtaccactcctacagtactgtagtactaaccaatcaatcaataaaattaattaatgttgagatgtttttcgagctgcatggaaagagcaagtttgggggttgcacatgggaggttggcgccaaaaaatgatgagcttttgatgataggacttggagggaaagaagaagaacatgataattggggtggtcggttagcgagcccataagcgtctcaattagattattgccatgatgatagtagaatggttgggcaacatgcacaggtagcttaattagttagttcatggcctatggttgcttgccgtcttgctgaacacaaaggggggagatgatgatttgtgagaccggcttcgtacgtgtgcacggtgtgcatgttttcttgagtagctctaaaggtatgtgtttatgatctccattgtttgtggctttagaggggtggttaaggtggccttgtggggcttaatttaagatctttgtgttggtatttttcagtcccatatatggattattatggagcttgccatctcctacgaaagcttaggcttgattattttcagattattaatcgaattattcaaaagaattatttatctcgaatttattaaaaaaaactttattatactacattacgtagatcacttgttttaatttactttaagtttatttataaaaatgtttagttaatctctataatttaaatagataatctgtagcaataatcactcaataatctgagctttaagttgataagagagaatggacgataacaagggcaaactaacaattcaagaaatcactctgtaccgtcttaatcgccaatatccgacaacgacaaacaagatcgatcgatggaatggatgacgatctcgatgtatgattgatcatgcatccatgattccatctgcagctagttgttactataattatattagtgtctagtatttcttaatcgtgagaaccttcctgcgctgcagccatcggcgtcgcgccatgttgcactgcagaacgtgctccgacgcgagcattttgggggttggaatctccattatttttgagctaatcgatcggctaatctcggccacatgcaggctcgaatcggatttggattctccccgggccggccgcgcatggctagctccgacgatccagctgaaattaatttaatcaacccattgatcgcgtgttggattcatgctctccaaactatcctagcactgttttgtgtcagatcacgccagccatgagccatacatactgttaccgctgcatgggcatgcacgcacggctgcaggcgataaatgccaatcgtgccaaactggcggtattaggccattcacagtgtatataggtggcattcagttccaacctatcacgtccaaagattttatgcctcgtatgtttctcccgtgaccaaataaagaatgggaaactaaaatggatcaccgttcctcgtcaggtttttgtcaggagtggagagaaaatcttcgggaggggagagacgatgaccggaatagggaggggcataccgggatttttgtcaccgcccaatctgtgtcgccgacctacgccgctgccgctaagacccccgccaaccatcgccactggcagatccgttggggagagggaggggagaggcgtccgcttccatcgacctaccaccgcctccgcatcttctcctaagaggtgccggccggcagtgggaggggagaggggaggggaggggaggggagggagggcggtgccaacgttgatttccccttgtagccaccggccaaccaccaaatccgcaccaccggagaggaggtcgaggttgcccaccactagatccacattggcgagctccactccacgctggccggaggatgaggaggggcgcggtggccggaggaggaggggagggggaggcttgatccgcagccagatctgtcgccgcttgggccgcccggcgccgtcgcttatcaggaaggcgcgatagcaggaggaggaagggggaggcgcgatggccggaggagggggaggggaggcgtggcactgggaggacaagggagagagaaaaaaaatacttttttatttgtgtggaccccacttgagactaggtaccactgtgaaacttgtgttaaacattattcttaggtgttcttgagcctatgtgacgcatgaggttcagcaaaatgtgttgtcgcactgctaatgcccttagtgatacaagtgtttgggaggtctcagtttccgcagatggattggcaagcaaaacatgatctagaatgatattttgatgaaagcatgtatacagagctagattttctagacagtagtagagctagaaaatttttaaaccccaagcaaatctaactaagacaagtactccctccgattcgaaatgtttgacaccgttgactttttagcacatgtttaaccgttcgtcttattcaaaaacttttgtgaaatatttaaaattatatgcctacataaaaatatatttaacaatgaatcaaatgataggaaaagaatcaataattacttaaattttttgaataagacgaacggtcaaacatgtgctaaaaagtcaatggtgtcaaacatttcgaaacggagggagtacagttctatattatatcatattttacttcatgttcactgccacgagtgcccggggtcgcccggcggtgggcggtggctccgccactgcttctagagcatctcatccggccgctatccgaagaaggaaaaacaggcaaaaaaaagtttttttttaaaaaatgtatcggcaaggagattaccggcttacaccaacttccgcgccggccgtggccggctgtagtactgcacaccgtggccacgcgggcgggcggcgcgcgcagcaccagcaggttggatgccggccggactaggccggtcgccactcactgcgccagcgaagcggcacgttgtcctctcctctcaggctttcgctgcgtcggcgccgcgccgtccgtctcccgtctcccccgcgcgcgcgagactgccccgtcaacgcagccaccacccacccgtccgtgtgatccatgacccgcgcgcggggcgcggtacaccgatccgtcgtgggccggcatggattgcagcgggattccgcgggaataagatcactttgactctctcaactgactatcgaatctaaatcatatctctcaaccgcaataccagaaatcttgactactcaaacttacaaaaccggtgcaatttgactccctgggcggttttaggaggcggttttgctgacgtggcgccacgtggtgcctacgtggcaatattgaccgagtcttcgttccacgtgatgatgacgtggcatctacgtagcggtagaattaaaaaatatgagtgggacccattagtcattcacacaagaaaaaaagttggcctacatgtcagtcctccttcttcctcctccctctctcccttctctctctctccccttcttcccttcggccagtggcgcctctctctttctctccccctcttccctttggccggcggtggaagcgagcggcggcctagcttcggccggcggtgagagcaagcggcagcggcgcgcaagtgaggcccggagtagcgacggcaggataggcgagtgagcggcggcggcgcgcaagtgaggggagcgacgggaggactcggcggaggaggccgagcgggagctccggccgcgttctcaccctgcttcacgacggcatcgaaggcgacgctgcccttggcgtcgacagtgagcgcgaggatcttcgagccgcccttctacgtcccgtcggcccatgccgagcgggtactgcgcgacgtggatctccgggaaggccccgccgtcgctgaagtcctccagccgccgcggcacgaacccgccacggcggcacgggcttggtggggcccgaagactttgctgccgccgccgcgtctgactgcgccgactccccgccataccactctgggccttgcgtgccgcctctgctcgctctcgccacccgccgccggccgaagggaagagggggagagaaagagagaggtgccaccggccgaagggaagaatgggacagaaagagagagaagggagagagaggaggaaggactgatatgtgggccccacatgtcagtgggcccactttttttcttgtgtgaatgactaatgggtcccatgcatattttttaattctaccgccacgtaggtgccacgtcatcgccacgtggaacgaagactcggtcaatattgccacgtaggcaccacgtggtgccacgtcagcaaaaccgcctcctaaaaccgcccagggagtcaaattgcaccggttttgtaagtttggggagtcaagatttctggtattgcggttgagggatacgatttagattcggtggtcaattgagggagtcaaagtgatcttattccgattccgcgcgctgcccaaccacgtcgcttctgggcctcgcgcgcgtgagatttcgggcaaaacacgcgatgtgggctgcgcgtgagattttcggggtccaacaacatcagcttatcgtggcctcgtgggacggcacggagcgcggcagcggaggccgcacgatccacgccgtttcggcctcccacgcgcacgcgctgcggcctcggactcggactaggcctctcgcgcgtggccgcgtgggatttgggccacacactatgcggctgccagtggatttttgggccatcagccatcgacccatcgttgcgtttgctgctgctcttgtgtcagcccatttcaccccctctctatattacgaggtttaaaatgaagttgtgaagctgcttaagcctatgttatatttagggtttgtttgttaaagctctaactcctatatttagctacaagagttgtgtttagagtggagttgtggagtagtataaatccagcttcacctttctagttcatttgtgagagcacttcacccatctcctctcctattttaggtagagctgaaattgtttagctgccgctccaccacccccgcctctctcctctctccgcccaagtgggccatcggaaatcaggtggcggacgatgcccatgactccaaccagatctgaggtgatgcgatgacggcgaggtggcgtcgccggccagatccgacaccctcccgtctggatccgacggtggcagtggcgaggcggcagggcacagctgcgtagaggcggcgcgggaacacccagatccggccccctctgcccggatctggcctccccaacgcgggtagccaacccttgagctggtgatggcgtggaggcgacggacgtttggaggtggaagggcatgatggtgaggcgccgtcgcagggaggacggtgtaaacgacggctgagatgggaggaaccaggctggtggcggtggtaggcgggcacggtggcactaggaggcgtgccccacggcgacggggttgtgggtgtccggtgctgcaagcagacagtggtgcgtgagtggcggcagtggaaggtcgacaggggccgcgaaaggccggcgcggacaatgttgtggtgcgagcatggcatggctggtgcacaacggtggtgagcctgcccgttgcggagaacacgggtagcctggtcaaggcagtaacgacagtagcgcatgaaggggggttgaagcgtgcggcaagtttctttctaggcgttagtcctttcgcgccggcggcttgccgccgtaagatggccacgctggacgggctagtgcgggggagaggggatcaattcttctctctcacccttcccctctccaatccaaccacgtggaagaagttgaagcgtgtcgtaggtttagactctactttggctgtgtcttttggagggttgggaacctccccccttcgcacgtaaaacggagcgatgaattaaagcatgattaattaaatattagcttaaaaattgaaaaatagattaatatgattttttacaacaaattttgtatagaaactattttttttataaaaaataccgtttagcagcttgagaagcgtgcctgtgaaaaaggaaagaggtgagtttgggaaccttgagggaagaacacacatttgatgaccggctggcggcaaggtgttggtgtggtggctgtgcgtgaggggaatagctagtggttctgctgaatctgacatgcactctttggcgcgggagagtaggaactatgggcaaagatcttagccttcggacgggcaacaatgacgcctgcaggcgctgattttcccttgggacgttgttacgttttctctcctctcccaatgtgttattaaggtgaaaaatcaagtcctagttctctaggacgagcggcggtagagctttttgtgttgtttcctctttggaggtgttgtttacaggtgttgtgtgtctatttcgtttttagcactagaataaaacatagacgtgtggtgcggttgtttttttttccttttcctaactatagtatgccaagactataaacttttttcttgccatatcattaaaaatatcgcattacctcataccggttgttaaaaaaaaagaaattcgaacgcttcagaaccagtcctaatccacccgatttatcaataaaaatcgactgattgggaggttgggatagtcgagtcgatcgcatctgtagttctgttgcatctggattctctggaaatagatgcatggaacgaacgaatgatgctgacgtgcatctacataacggcgaggaccttcctcttcctcctctcttttctccaaggcgatcaccggacccggacacctcccaccccaatccggttccccgaggtggggattgctaatccgcgcagacggccggattagcaagtcgcgcgcatttccgagtccgtagcttctcacgctcctttttttttttggttttccgcttcttttttctcgtcgcacgtgcaggttaagcgcgtgggctattacgatcacacgtcattaacgctaataacaccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13282 - DNA, 716 bp, Oryza sativa
tgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgcgggccatgggatggacggccacgatcgggcgagggccgatcgggcggttggggacgggcggcaccgaggccag

SEQ ID NO: 13283 - DNA, 632 bp, Oryza sativa
ggtccaaacttacgtatgccagcaatattgatcaaagtaagttcctccagatgcattagttgcccgaaaggtgggaaagttccccaagataagccttctagatggagagatttcaagcctttgacacaaacatcaccacacaaccaagtaggtccagtggaaccaccatggtttcgtatgtcaagtgctctaagattaggatgtggttgcagaccatcaagaacgccagatcctatggagagttgctttgcactccaaactagtgtcaatgctttcagattccttttcgatatcaatttagcatcatttgcttcttctcttgttgccacattttcaaggttaaatatctttagctctcctccaagctctgtcaaattccccaactcactcagttcaaatccaatgtcctctttcttaacatggtactcttccagccactgtaaatacttcatctttccaatcccaggaatattggaacatagctccattttagaaattaaatggcgcaaattgactaggcaagaaatgtcttgtggcaaaatacacttactataccctaggtccaagaattttaagtgataaaatttgcacattgcacttggtaaagaaaattccgagtcatatggtaattc

SEQ ID NO: 13284 - DNA, 1405 bp, Oryza sativa
cttacacacaagatactctcgtttcaaggaaatcgtgtgcaatggatgcaagtattatggggcaaagagcctgatcctacacttaaggtaaagtaatgaaacactgcattttttttccagaaccagcacataagttatagccacataaattaggttgggtaacaaattaaaatagcatcttggttctgcaaagaactcagcatggtcttcctgagaacttacatatcactgtgaagtaactactatggaagctaaaagtaacttaatgcaactgtgcaagtaagtttcaacaatcttgtcacaacattataagttacatctcgtagctctaattcacttctcagtactagctaggcctttcctaactgatgtctttgacgcctttgcatggaccccaggcttgcgtctcgttgaaactggtctcccttgcttttgtatgatggggggggggtcatttatctgtagtgttgggttagttgatgctgaggggatatctgaaattcctcttgcaggatcagatggggctggctgtgcttttttctgtttctttctactctgcttcatagctgctaagtcatcagtcattgagctcatacactgtagagccatacggtaggctttctcgttgcttgatgcatcttttgcaatctgtgtaaattttgtgcacagattggtatacctgattagcttcagagatttagggggcaattgcatttgttcaccaatgcttgtaactggaggcaattcaggctctttaaccatcgtccatctaggcaatatgtagtgttctggaatgtcactcacttggcccacaaaatcaaatgtcatcacctgcatggaaaaaaacatatgttttattacctgccaaaagtgcgtaatgcataagaagtaatttaatgcacattaagaagtaacttaatgtgcagtgagaagtagcttaatgcacagtgagaagtagcttactgcaataacagactgttaccttcagaacatgacagcaaagaatgccatccctttcgaacttacagcattcacagttgtatatcctgtccaacacatttgcagctacaatgaatgcccttgatccataattcctaacaggacctccattcggttctactagatacatgttttcagaagttcaggtcaatttatatgatgttgaagcaataagctctttttgaaatctgttgaatataggccttgtgtagacctccaatgcttttgtttccatgggatagttagcccacatagaagggattgtttcttctgcttcaaactcattctgatctgttgcaacagtgattttttcttgaatcttcttgtactgcaaaaataagttgtatatgctgttttgaggatttacatagcgcttcagcactgcgttaaatccctcactccgtgc

SEQ ID NO: 13285 - DNA, 748 bp, Oryza sativa
tatataaatcctccccgagctccccaccaccgtttccgccactcaccgccctctctccccgccggaatagagctcgcgctgtcgctctctctctccgccgtcgccgccgagctccggtccgccgccgtcgtcgccccggactacctcccacctcggcgccgcctccttcggtttcgccgcagcctcgccgacctcgtccacccctccgttttgctcgccgaccgccggagcgccgtcgaccccgtccacccgagccgcgccgccgccttcctccgctccggtcgcccgttccgtcgtcgccgtcgacccggggtgagccgtggaccgccgcttcgtttccccctttccctcccctctctcggccgccgctccgccgtgcctatggccgccgccagcgaccataggggcgcgggcgcgccgcctcccgccggccgtgccgatgtggccgcctccgggcgcgcctagcggctgccgcgtggggcccgaccgtcagccgcccgcgccctcgggtgcggctgacgcgtggggcccacggcgccggccggtgtgagccgggtgcacccggtacaccgtcgacagtgagactgccgcgtgggtcccactcccgtggacccggtccgcgcgccctctctcccggctgacgcaataaatctatttttaaattaaaatttaaatgaagaaattcgtaaatattcatttaaagagcatataaacttcaaatggccataacttggccatttgaactcgg

SEQ ID NO: 13286 - DNA, 904 bp, Oryza sativa
cagaatttgtgctgaatttgcttggaatcaatgatggtatctcaccatcactgacttctcttgggattcaattggagaagttgaagttagcagatgacaagtacctgcgcatgtggatcatctacgccatttcttctgttttagcaccaacgacggcaacaacagtcagcccaagatgctatccttctgttgttgatgctggaaatgtcaagaatcttaattggtgcaagtttatcatatctattttgcaaaaagctgctaaagctgggaagaataccaactcagcatgtctcctgtatatgatggtaacaatgctcgcctttttttatttgatcactgtcccaatgtaacttttatgttttttagaagtaagttaagctgtccaggaagtaactaacatgttcctaggaagtaacttctttctgttaaattgttataaataattttctgtcaagtaaattctctctgtgcattaagttacttctcactgtgcattaagctacttcttattgtgcattaagccacttctcactgtgcattaagttacttcttcatatatgccctgccacatctttttttccaatttgtttttaaatttaaattacatctggaagttaacatattttgtaggttttaaatcaaacaagttatgtactttttttaattaatctaaatgctctaatttcttttgtagattctttatttggactcgctttcgtttaaaaatctcaatgttccagtggagggttatcgagctactgtttggacgaatgaaatgataaatcaagcaatattagctgacacatcagcagacggctcctttggagctttaccagtgagttttttttatagttggcatacttgcatcatttttagttttttgtttgttcgtaacttacggatt

SEQ ID NO: 13287 - DNA, 7065 bp, Oryza sativa
ataatccattttagcatttttttaataaaaaataagatgcccatgcatctgtgagaaattccttaccgatttatattctggaaatgttttccaatttatattacgtcgttatagtgtttgaacacaacctatcatacatgcccgcgcgaatgtgcgggctaccttcctagtttaaattaaattctcatccagtcacatctcttctctctccttttatcagcatattctcttatttttattcttagttcttgtgtagagatggtttcttcatctttttacctctcttctcgttaactttcttgccacatactccctccgtttctaaatatttgacgccgttgaattttttacatatgtttgaccgtctgtcttatttaaaaaatttaagtaattattaatttttctcctatcatttgattcattgttaaatatacttatatgtatatatataatttcacatatttcacaaaagtttttgaataagacgaacggttaaacatatgctaaaaagtcaacggtgtcaaatatttagaaatagagggagtatgatttttgcttatgtgatgtatttaatgctatggaaactagatggcatggagggttggggatggccttagttgtccgctgctactctctcctccatatcataaaaaaaatcttacatggaccttatatcgcccattattgtacccgctcttatggagaggaatcactagacatgatactttttgacacgcgactgttgatcaaattagtgcataactaaaaaacaatcttttccgtacttatgaattgctgcacgacaacaaaaccaatgttttctataattacgaacaaaattagttactactattccttttgcaggatgattatgatttctcgatttgtcatgtaattttttaaaaaaaaaacaaatcagcacaagattgtgtccactctattactagctacctccgcaaaagaaatatatttctacgaatttcagaaagataattataccacctataatcgtatccggttttgtcagaaatacaacataactagcttcagaaaaactaaccgacgatatcccgtatgggggaagtggggacgggatacataatgaacggtcatcgtccttatccgtctgcatccttttccgcccgactcgatccccaatctcctttgtcgctcttctcttgcacctacgcctcgcatccgccgccactcttctccttcctctcctcttcttccttgcctagctagaagcttgaaaatggctagagctcctttctcctgctacacctaccctcctgttccgtccccctcaccatcaacgagccaaggagagggctgccagcaccagatctggagatatctagggcctccccgtcattggatccgcctgagccatgtcagtgatgaggtgatgatcgcaccggcccctgtggcctccacctcgatgtcatgccatcgaggaggatgccgatcgatgtgaatcctcctcccacgcaactgttagtggtgatggagaggagacaaatgaaggtgctagatttggagtttcaattgacaatcgacgtggtgttgcagacatcgtgttgctcgtcgacgttgtgcgcaggtatgtcgtgcatgtggcgtatcaccatggcttagctggtacctacaggtattaggcatggtacgaatggtatcatgttgatacctacaggtttcagggctggtacctatggtatcatggttgatacctacgggtaccagacctagtattagtggtatcatggttgatacctacaagtttcagacatggtacctttggtatcatggttgatacctacaggtttcaaggctgatacctgtggtatcatggttgatactcacaagtttcagacctggtacctttggtagcatggttaatacctacaggttttagacttggtataggtaccaaccaatatcacataggtaccaagtacaaggtataacgtgcgtcactgccgcttgggcaggtggtgagctgtcgaccaccagcgttttgtctcgtcttctcccttctattcctttccaaatctccatgccttttcttctcaatctggtgttggtacaagggtcaccaggctgctacagcctgcagggaccaactttgccacctaagccactactggtactgtggccttctcctagcgcctcgcgcgtgctcctccgccagctagggcgtgagcgcgtagggcggcgctgagtggtggactcgtgagcggataaagtggtggcggagctaacgtcatcaatataaagtatctcgtttagacgggatgccgtaccctagctagcagccctctatagctttatatggaacgaaaataccatatacctagatttatatggaagggtatatatatattcgagtatgaaatttctattggcttaaaaaaataatatgggaattctacgaataacatgtaaatgccattcaatatgtcagaatccaatcgattcgtgtaatataaggtcttatatgctcctatcccacttgtagttttcaagttctaattgaacggtcatacccgtataaatacaaagacttccattgagacatagcatcaaattataaaccatagccataagccagatcgaacaccaactagccatgaggaaacctaaagctagccgccgaggcgccgactacaagtcatcggattagtcctcattgaagactacttaggcttagattagttagcttgcttctaattttataatcggtgtgaaacatcatcgaacgatacatataaattggattagggctatttacctatcaagaggtttgaacaagctagtataaacaatatatatttccgaaaactgaaccagtatatttcttgtctccgtgtcgacgggggatactagcacactggaagaatagggtatagggtatgttggtacgaggatctacacaatacgacatcaagcaaacccggagacaaggattatactgattcagacccctcgtaaggtaatagccataatccaatctatatgagattgatatgaaagaaccacggattacaatagagaaccaacgattccgagattaccagcgagatccttgtcgagatggtttcgacgagatcttctagcgagtaggcttcacgtcctccggattgtaggctatggtggtggtgttggtgctatgattcgatgatctggaccccttaaggggtgtgtcttttataacatgaatcaccttagtctccaagtaaaactcggtgactatggaccccacacgatatagtataacctaaccctttttgagtaggactctgttgttcacttgctcgtgaggataatttccataatctcttgttaatttcctcatcgtatacggaaatatatcgtacaaacgaaggtatgtcgtatccatatattccataaatcgtaggataggagatataccttatccgtaaccatgataggctagtagcattgttttgccacgccagccacggtggcgtggcaagaggctagcatgacaggacagcactgccatgccagctgcgcgtggcatgccaaagttatttggccaagccaggcgggctggagtggccaaaaggttcagattcggacatattttttcgaaaggtctatttataaaattaaaaaaaataaaaagtctaaaaaataaaaaaatttcgcaggtaactggagcctcttatttcttaacagaaaaactctcgaacctctattctagtgtgataggtatagcagttctttcactagatgctaccttgagacaatctcaccagaataagttgattgaacaggtttctgggtactgcaacagtgttttaggaaaacaaattcagccacactccatatattcattgaaatatctcaatacaaattccacccccgggaacttgggccagccagcaggttctaggttccatagattacatagaaccagtgttcacctagtcgctaaacgctagtcggacggtcacctactgactagcgactaggctgattaggcggcgactagatggattaggcgaattaggcgttttttatatttctttcacagaaaaatactgattcttgacattcggtactcagtaaatataggcatttagacaaatagcattgggtttagtacaaattcataggaatagcgaacatacattagtatatatatatagcatagcaggctaggggagtagcagtacagcatcaacaccaacaaatcacatacatacagatctaaggagctggagctaggagagaggaagaaaaatttatctggaactggaagaacagaagagatgaggtggtggaggggagcctgatcccctgatggcctgatctagggttggcgcaggctgcttgagtggttccgtgcttgactgcttcaattggtgtgtttgccaccttccattgacggtaaggatgaaggatgagagggagagcagtagtagcagaggaggagggggaagaacgtggagcagcagaggaggagatcgggaagaacgcagcggcacggtggaagatcgatgggcacggtggcggagccgtcgctcgtggcggcgtgaaaaaggggagtaggtaggggttgcgctctctctctaggctctcaaataaggtaacctaaatccccttctataccgagctggtcccgcgcggcgtttctaaatttaattgtgcccaaattttgatttctatcacctagtcgccgcctagacacactgtcccattgtccaattgcgcccaggcaccgtcctgtccaagctgtccaggccgcctaggaccgactaggaccgtctaggcggtaaaacgactaattcactgcctagggtataaactggacaaattgtcgccgactagcgattaatcaccgtctagacgggctaggcggctgtttaggcgaacactgcatagaacagaacttatcacacagcagagatcaaaaactcaggttgtcccatcaacatagcaacatgtttgagaattcaagcatggtaattcagagcattgttccagatccaacgcccagcagcaaagcaacacttcgtacatcttcttggtcctttattctcacaaaaaaatgtttcccatttcatcacccatattaccatataaaatgcctataaaatatgtcagacagccaaaaaaaatcgatactcatgtgagaagctccacaacaaccacctctgatgcagaacaaacatcggagcggaggtactcatgtgagaagctcccatccagcaggtaccatcgatactgtccggtatgaaatctgagccatccaatcagctcaatcggatggtggaaaatctgtggtacctccaggtacaaatttgcccatgaggtggtaccggaatatttggagtggtggaagggtaattttgtcttttcgcgtagaagtgtccaggggagggaaatagggtcttctaccaaatcggcggcgagcaaatatccccttcccatccgatccgatccgatccgtgagagtaggcggcgtcggcgacttgcttcgtcggcctggagttgctccgcgggaggcggcgggatccgtgggaggcggcggcgacttgcttcgtgggagatggcggcggcgtcggcgagttgcttccgtcggcgcctacttgctttgtgggaggaggcggcgtcggctgatccgtagccgccggcggcggctgatccgtttgaggcggcggcgaggtgctccgtgggaggcgaggcggcggcgggggaggcgaggcgacggcggcggctgatgtgtaggaggcggccggcggcgaagtgctccgtgggaggcggaggcggcggcggcagcgggttgttcgtggcagcgaggttgtggcgggcgcagtggtgcctggcgcggcgaagccctggtgctgcggtgctgctggtggcgggcgcggcggtggcctggtggcggccgcgttcacgaggtggcggcggcggctggtgcgtgggcagccttggctgcgaggtcgtggcgtgcgcgatggtgccggccgcggtgacgaggtggtcgtcgcaaccggtgttgtggcggcagcgggtttgggctttgcgcggctgcagtggcgaggtggtcgtgtagtcttcttagccggcgacgaggcagtgtatgcatcgattttttttcatccaatctaaatcattagcttctgttggttgcagcggtagatactttcattttctgggctgcatatgctcttcttcttcattgcttataggatttgtattgtacgatttattggatgttttaatgagctcagtcgttgcttgttctatgtgaattttcaaatgttcaataacctcccctatcaatgagtgactgcaaaatgataataggatagaagaaagaaattgttgatagcataacgagtggtacactgatgagttgcttgttttaacaaattgttttcccagcatacttctatggtttattcagggaacagaaactaacctatcaggctatcacaggtggtagccagcctaataaattcttctctgaatctagtttttcaaatccaaaagatataacacaagacatgtagaatctggaggtcgacatatcatttctgacaatgaaaataaaagatgaaaccaccttatccacatcctatacacacactttagatagaaattctgtcatgggtatttcatcgaacaccttttatgcgaaataaatacctaatgcttatcagagacatcctctgttacctctgtaaattgcaacatcacataatcacgcacagaagattcaaattttgtgaaaatcttactgacttttgctagataagaaatgccatcgaattcccttaacttggataaacaggagaatagcatatgcataaaaattctgtgatgttctctaaacaggagaaacattgcaagtagttacaatgatgtctatctgaatcttagcctagagctagttgccttcatttgcctcggtcactaggcgtttaatatcttgctgcacttcaatcacttcgttcatagtagaattaatgaggttggctgcaaccttatgtttgaaagtggtggttgtatcctgaaaagcaagttatgaaa

SEQ ID NO: 13288 - DNA, 1832 bp, Oryza sativa
aatataccatatcatgttgcaaatattttgctgtaacttttgctctcttgtcttgatattgcttgttgcgggttccaatttgttcaccatttgttttccaggcctggcaatgtgctgtactttctagaaatgcagtaccattctctcttggactttcacattgcatgtctttaatcaacataatgtatgcatctatgacctgtgaaagaataaagaacaaaatttagatactgataatattatgttgtatggaaatggctgaccggctttcagacatggaattttcattcaagaagaagttgtccaagcagaaaaaagagactgatgacattagaaattggttcgtaggaacagtagttgtagctgtgttccttctcatgaagttatttgataatatgtactatgcttgccgttgttgattttctacatgtcagttagctatgttaaggtaacagactttttagtttgtcatctcatttgtaataaacgaatatcaggcccttgattgccctctaaattgattagctgtgcattgttcattttggttgataagtattggatggatggttgctgcaaaactggaaaactggaatgagatactgtgtaataaacgaatatcaggccctttattgccgtccaaaattttcagatgtgcattgttcattttggttgatgagtaatggaaggatggttgttgcaaaactggaatgagatactgaaagaagtgtactacaaaactgtaaaacttaggtgtactgaatcattttgtacatttttaaggtgtacttagccttgttgtgctactgaaatgacatgtattactggaataagtattactggaaaactggaatgagtgctctcttttgatcactccacagaatggcatgtatttcacaggagttcgagtaaaaacagcacaatggtgctagtagacaaacaataaacaatgtatgctctgttcacagctgacagtaattaagacaaaagctccattcaatgatatacatgctttgttctccagcaaaagcttgtgcttttcacacaaattcattacaagaaccatgacagattgaattgttcattaaaaaaaactagaccacacaatataatcctctgtccaacaatacaacttcccaaacaaggcagattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacaggttcgaacagtgtgcccatggccacgacaataaccacaacgcctaacacgcttctccatgaatcctcgtagtcttttttgttggagctcctttaggcacaatttccataggatcatggaccttatcatgactctcaatgtctgtacgtgaactttgagctagcacatgaccacataaagtcaaatctgagttgtttgtctcacattcatcagtttctaagtctaatttttctagcatctccatcaccattaaagtagtttccttagacaccgaacacttgaaaaacacttctgtgcccatgctacgcagcctgcgatatctctccatctggtctgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcat

SEQ ID NO: 13289 - DNA, 2681 bp, Oryza sativa
gatggtgggcctataaaaacaaaaagaatatttgtgttacagtaagtatatgatatatctattgtatcacttagctataatgctttctccagggattcagctcatctgacttcacccctcatgacggcggagagcagtcgaggtcatccaactgtccacgttcgattgaaccgtccgcccagaaatacaggtcagccgcgtcgtgagtctgggccaaggctggcccaacaagcctcgtcccagcgccatcgctcctatcttttttaccgcgaacaaacgcgttttggcggtcgcgctcgcctttttggcgccaaacgaggccatggccccaggcgatcatctgacaacatgctgggacagcgaaccacggattcaaccattgatcaagcacaggtgaagttctggcctcttctcttccttttttttagcaaattatttgattgtcttccacctcctccattagactgttggaattcatcaaagaagcctccagcaaaatctacatatttgagatggaagaaaacaggtctgtaagctatggttgttacttttttcaccatgatcgggtagattttacttgttcgatgaccaccaaatcattttttttgttcctgtagagtgggtgtgctacctagtttgttacctgaagttggcatggaattcaatactgttgatgaggcttggatgttttgggttagctatggtggtcagaaaggtttcgaggttagagaaaggtactcaaacaaaaggaaatcagatggaaaggttgggtcatgcatatatgtttgtgcattttggaaaaaaaaaaccgttggttctcttgaacaagccatatgcccagaattggaacataatttcattgcagtgataagttacaaatggccatttcatcattctgttggacaagtcattctcattgcaaacaatttatagagtttttctgctttctatacaaattacagaacacatgcaaccccatttttcagaacaagtggtctgcttctgctgcccgtgtaaagaacaatctatcattcttataactgaacattcagtatcttcagaatgccattcggtttggtcagacaagcaacaaagcaacactcctagacgcagcatcaaggagctgaagaggaggccgctgtgttcctccactcgctcactgctgagagatggcgatgaggagttcctcctctccctgcctgccgaggcccgacgcaggtaattcagatcaacgagcagctcaggcaccacagcttcggtcttcctctgatcggcgaaatggagccacgcggcgcgcgcactcccctcctccattcgccgcgcgctgcctgtcgcggcgcatggcctgctcgagctccgcgcgcgcacatcgagctcgtggcaccgatgcgccgtggccgtgaccgggcgctgcatcttgcgcgccttccggtccccatcttctcagccgagtaccgcagcctgacggcgagagcgagggcggtgaggaggacgagcacgacggtgagagcgagggcggcgaggaggacaagaatgacggcgatggcggtggccagacgaggagtacgagcacggctgggggacgaggcttgttgggccggccttggcccagactcacgatgcggctgacctgtatttgatgcgcttcctgggcagacggttcgatcgaacatggacagctggatgacctctactgctctttgccatcgtgagggttgaagtcagataagctgaatccaactccagatgatgtgcccatctattgcagccgatagttggctatgttattgacctcattctaagctcgtaaaatctaaacggagaggcctctccatttagcgctatcgtgcgacgcgcgtggcagccgtggtgacgtggcgtccatcacggcgcgcgccgcgcgtcccgaccggccgaccgagcgagctcacgcgtcgccttttccgaccgaacgagcgaagggtactgttcaaattttttgggtggcgctcgacgagagagagagagagagaggcggagagtgagagaggcggaggtggcgtgaatctctggcgaaatccgtggcggaggcggcgtgaatctccgacgaaatccgtggcggaggcggcgtgaatctccggcgaaatctgtggcggaggcggcgtgaatctccggcgaaatccgtggcgaaggggggggtgcggggagttgctgttgtttcctcccatcgcgccggcgtcggcagagtcggcggagccgacggtttcctctcatcgcgccggcagttgcggtgggaagcgtaggctgcggcggaggtagttttctctcctccaaatccggcggccatttttttcggtaagttgtggcggtttcattgcggtttttttgagccaaagaggtggagtgatggggctgtttttccctgcgttttttgtgccggggaggtggagaggtttgggcagtttttcactgcgcaaattgcttctcaaacctcccggtttgttctcccctattccctcatttcccctctctctctccctcattcatcaggtgctagttcatcctctcggcgagcgcaaggttgcggtggaattcgccccctcaagcgtcggcttgtggatctcgggttccatttgaaggtatttaaatttctctctctctggcttatgttgatttttccggttgcaagttgattactagtg

SEQ ID NO: 13290 - DNA, 1005 bp, Oryza sativa
ttagttgcaagttgattattagttgatcgatggttagttgcaagttgattactaacatccaaaatgaatttccaaaatgattactaacattgttagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaagggggggttcgcaacgtgctaagaaaagaagtattggagatgatcatgcagatgacatagaggaacctcctccaaaaaggagcagatcaaaggtattaagcatccacctttttttatgcattttttgccctcaagcagtgtttcgctttttccaatgcactatattttcttatgatgcattaagttacttctcactgtgaattaagttacttctcactatgcattaagttacttattttaaaattcctatgagatttccaacaccagtactcatggctatgtaactagggaatgcaaattcaagtttatttttggaagtaacttgcatgtttctaggaagtaactttttgagttttataacgagtaactttctgttcaaattgctctgagaggcaactagatggaatgtatcatgctgtgtaactagggaatgtaaattcaagtttatctggaagtaagttgcatgttcctaggaagtaacttactgttttgttagaagtaacttcctgtcaaaattactttgagattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgttttttaaaaaataaacaaatgctgatgtt

SEQ ID NO: 13291 - DNA, 1762 bp, Oryza sativa
ttatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttggtaagccgttgttttagatcgatgtggtaagttggcttgttttaagttggttggggggtgtgggtctggcatgtgatttacatcag

SEQ ID NO: 13292 - DNA, 4600 bp, Oryza sativa
acgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaataccttataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactcctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaggcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattata

SEQ ID NO: 13293 - DNA, 5309 bp, Oryza sativa
aatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaacaccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttagaggatatgtcctttaaaactactccctcagtcccgaaataagttaatataatatggcatgtaatattttcaagtaaagtatgctaaaaaaaacaagtatgctaaaaatgactctaaagtatgtatagggtaaaagtattctaggcaatttttaaaatgcctctaaaaggtgtctacacttttgaactcccgaatttagagacaatttgaaattctcttctacaaaagtgtctcaacataaggtttttgttgtagtgtgagcttggcattgagtgtgtattctttctgtggaaacctatcaatccaaaagcttgtccagaactcatcagtttgacatggtacagtaaagttcagacctgcctgccagttcatgtaatcatttgctctttagcttattagccttagcgaaaatttgaatttcagaacttaattttagggttgattttattaattgttttccatcatagtttgttttctggcattgtgtcacgcccacgcctaccatctttcattggcagcttacaacggacaaatgaagaacaatagaacatcattgcttaaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaagaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaa

SEQ ID NO: 13294 - DNA, 5865 bp, Oryza sativa
tggatatagatgcagaactgataaagggataagaggagaagaaaacgcattaagccattaatggatttacttgatgacagccgtgaagtgttttcctcggtggttgtcgacggttttcattaatcatggcaacctaaaggggcgaacaacctttagacatgggagaggaagggggaagcagcgcacgagccgccatgggggcgacgggaggggaagcgccacaccctcatcctgcctccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggttgatgcgcgtggggccggtgaagcagcgagatgtgggagaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaacctgcatatatatgtttcaatacatatatatgcatacatatatatatgtatatatatatatatatctatctatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaattgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatacatgtatatatatatatatatatattgcatttcacgttaacgttcgtccttgttagttcgctcgttcacgttccctagctcgttcacgttcgttcgatcgttctcgctctcgttcgttcgatcgttctcgttctcgttcgttaacggcggtgtggcggcatcggggcggcggttggcgcggcggcgtggcgac

SEQ ID NO: 13295 - DNA, 19190 bp, Oryza sativa
agtaaattaaatgttaaaaactctaattaacatacatatgaaattgccacctgtgtgatttaaaacttttaaaaattgtaagtatcacatataactaacatatacatgatttaaacttgttgacgctcttcagcgtgccatcgcaacattctagcattccccttgttcctgaacaaacgccttagccgtggtattatagggaaataccacatcaccttagcaggaattctcttctttgttagctgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtatttttcacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtctcttatccgaatcaaactcgttttcgagtttatctccaaaaccgagtttttgatttcccggcgccggatttttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcgagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagttactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataaaggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacattagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatagacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggggctaaagttaagatctttagtctcggttggtgctaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagagtacaaactgcatatgcagataatactgatgtacgatggattgatggctcagtactagcctacgaaggaacttatgatctagcagatgtttttcgtcctaactcaatgcaaatgttatatctggagtttaccatgcattagcctcgtacttttttttttctttccaggtgacttccaggacaaaattggtgttccatccaacgacagcgtgtaacgcaacctgcactatctgtctccatatcttgaaagaggcaaagagctgcttcttcgttccgggcattccccctgctgttcctactgaagatcacaaaagagatagccggcggtggcgatggtggtggcggaaattgagagccgcggcctgaatgcggggccggcggtggcagacaagcggaggcggcggaaaatgctcgtcaacctggtccgctgggagacgagcagtttccgcgcgtggggttcggctggcgggcgacggcgctctgctctgggtggtggcacactggagagatgaaacatctagagggaaaatggaaagagggggagaaatttgttttgttgccaaaagaaaacaaatttcttcgagtacatattatatatacagtatatcaaatggctctgatttcttcttgtcttggaaattacagcctaacttattagcttagaaggacgcgactataccgagaccggtatcacgatagggctatcgcgcgacgcgcgcatctggcgattccgcaccgcgcgcgcgccccatgccaaaaacggtaaccacctttttcccgggcccccgcgcgtgccatcgctaaaaaaggaaagcacgcgcttgcgcgcgcaagcgccgtgcgatgcacgcctcgctagctggcgtgggccccacctaaaacagcgcgatgcgcctctctccctcactccaacccatccggagacatcaatccacacacagccgccacggtggtaaaaatcagaaaaaaatcgccatcttggaagaggagaaggaggagaagcaaatccaagaaaaaatatccaagtaaagtacacatgaagttcaaattctgtcttctgtgagatccatccacaaaaaaaaactaacctagaaacttttagatcttctctgtattcttcgacaaacaaattgatatgaatctgtgctgtaattttgtgagtaattttgtgagtaatgagctgtagtcttgttttctgtcttccttcttgatttctgtcttcctttataccccaaattcacattctagtgctactcttgatttctgtcttcctttataccccaaattcactttctagtgctgctgagaaaaaaagttgtagagaaggcatgagtactggtgtttcaaaaaactcagagcaatttctaggaacatgcaacttacttccagataaacttgaattcacaatccctagtttacagtttagacagcatgaaaacatcccatctagttacctctcagtgcaatatgaacagaaaagttactttacttcccaaaataaatttgaatttgcattccctagttacataggcatgagtgctggtgttggaaatctcatagcaattttaacagaagtctcagtgcatttttaacagaaaagttacttctaacacttcaatgagttacttccaagaaacattaagttacttctcaccgtgcattaagttacttctcactgtgcattaggttctcatagcaattttaacagtctcagtgcagttttaacagaaagttacttgtaacaattcaattagttacttcctagaaacatggaagttacttccctataaacttgaatttacatttcctagttacacattttgtaccttgtgtctatatacagcatgatgcatcacctagttgcgtctcaatttcatcttgtactgcatcaaaacaaattgtgaaaaaaaaattcattaatatagccactggtcttaatttgagaaaattgcttcctagaaagcatctaaaaaagacatgctgcaaaaactaaaagttacttcttcccccctcccccccaaattactgaattacctcaatgaatgctctgtataaactaactttgttactaatagcctgaaacacatgcagcaaaaatggactttgacctcaacagtatcccggaattagtttctggtgaaaatgaacctccagtacaccatttactagttgatgatgaagacagaaatgaaacatacttccctataaatctgactgacactagcatggagattcctgctataaatttggacgacacttttgactttgaaactatgtatactactggtgatgctggaagtttacaagcacacaatgtagccaatgatgagatgcaagtatttgaagccaatgatgagatgcaaatatttgaaggcgatgatgagatgcaagtatttgaagaaatgtcagatcgtgcagacacaatgcatactagtgttgcaactggcgcaacaactgctactgccaacacaatttcaagtgaagacactggaacagatgattcagaagcacagtcagcgccatcacaggatattccgtgcagcacacaagtgccgtacctcaccttgactttcaactcagaggaggaagcaagggctcactacaacaggtacgcaaagcgcgttggattttcaatcaaaatcaacacttcaaggaagtcagccaaagatggagaacgtgacaaagtaatgtttgtttgcaacaaatgtggtccagaagaaaaaacgggtgaagcgtgccccccaaagaaaatgaaaagaagtagaacaagacaggctgcctgcaaagcaaggatgacagtgaagaggaaaggagctaggtgggaagtaattcagtttgttgaagaacacacacatcctctggttagaaagttttcactcaagaaattcctaaggtcacatagagcaataccgaaagaggaaaaagatttcatcacaatgctgcacggagttaatctctcagctggtacaattattgtcacgaccggaaataacccaacgggcgttccttacgtgcgtgtattattccttgtccaaggaggcaaggtacaccaaaagttgatacaattcagagtttaacaagcggaagcgtaaatagttaattattacatgggcagcgacggcccaacacactcaaagacaatgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtctcagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccaggcctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaacaatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccattaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttcccttgctcgctttcccaaacgtcggcttcaacctccacgaagagcggatcttccgaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggccggcgggaggcggcgggattcgcggcggcggcggcgctaggcgcgggcgaggcggcgggggcggcgggaggaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctcctcctggctcctttctctcttcccttctcttctctcggaactctctctctccctacccgtggcggcggtgacgacagcacgcacggaggaggggggggggggggcggcggcttaccgacggcggcgggggcgacggcggcgcaaggcggcaacgcacggcgcggtggctccggggcggcggcgcggcggcacgatggcggcggcgcggcggcacgatggcggcggtgcgtggagaaggaggaaagggagggggaaatggaggggatgggtgtgggatggagaagggaagggccgggttttataagggcacggggaaggggcggccggcctaatggcgacgcgacgggcggcacggttggcggtgatggcgacgagcgggcggcgcggcgcggggctcggcgcgactcggcacggggctcggcgcggcgacgagacgggcgagcggcgcggcagcggaacggcgatggggacggcgcggcagcggcggcgcgcggctcggagcgacgatgggacgcgcgcggcgacgggatgggcggtgacggggcggcagcggtggcgcgcggcacgaggagggatgcgatggtgacggcgacagcgcggcagcggcggcacggggcgcaaggcgacgcgacgggcggcagcggcgacgcgacagcgggcggcacggcgcggggtgcgatgacgcgataacaacggcgacggcgacgcggcagcgacggcgatggcgcgcggcgggacgaggcgcgaggcgcgacggggacggccgagcggcgcgcggcgcggcaggcgacagcggcacggcggcaggcggcgacggcgacggctcggggcgcgaggcgcgcatggcagggaaggggaaggggctaggggacacggtcgagcacgtggcggccgatgaacagtgcactttcctatttttctcattttagtctattacttttataaatttgattccacaattcctaatttttgcataaatgaagtttactccatatttgtgttatcctaactaaaaaaattcaccctaatttaatatcactcatattttgtttatataatttatttaaatttttaattagggttaattctcatttcatcatactaaaatttaattattgctaatatggttgcgataatattttatttattttccaatcccacctaatctttattttaatttatattttaattatttatttagccaacttgatttttagggtttattcctagttagttattcattattcgcgattaataaattccgagatcaaaatccaatgaaacaggcgaataaaatcatgatgcaatttattacttaaaatgttttgaaactccgtatttttggtgttttgattttgttggtcgaattttcagggtgttacagaacgcatacccgattcccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgctttctcacactgcggactccacacaaatttttcttctttcttcaacaactgtgtcatgggtcgagcgattttggagaagttctcgatgaacctccgatagtacccggccaaacccaaaaagctgcggacttgagtgatcgtcttgggttgcttccaatcggtgacggcggtcaccgtttcggggtccacagcaactcctttagcagatatcacgtgccctaagaacttgacttcggacaaccagaactcacacttgctaagcttggcatacagttgatgttcccgcagctttcccaacaccagacggagatgctgctaatggtcttcctctgattgtgagtacaccaggatgtcgtcgatgaagaccacaacaaacttatccaagtattccatgaacactttgttcattaagttcatgaagaaggcaggagcattggtcagaccgaacgacatcaccgtgaattcatacagcccatatcgcgtggtgaatgcggtcttcgggatatcttcttcacgaatacgcaattggtgatatccggagcgaagatcgattttagaaaagatggtggcacctttgagctggtcgaacagatcatcgatccgaggaagagggtacttgttttcgatagtgacttcattgagagctctgtagtcaacacacatcctcttcgtcttatccttcttctccacaaaaatcacgggagcaccctagggggaagtgctcggccgtatataccccttttccttcagctcttccaattgcttcttgacttcggcaagttcatttgctgccatacggtagggccgtttgtacagaggagttgttcttggagcaagatctatccggaactcgatctcccgcttgggcggcataccgggtagttcttccggaaacacgtcaccgaactcactgacgatggggatttctgacaatcctatctgatgaagttctgaactgccaacagaggttgggggtgcaaagaacacaactggttgttccggccctcggtacagagtgacagtgcgccttgcgcaatccactaccccttggaattgagccaaccaattcatcccaaggatcacatccaagttcttggtgtccagaagaatcaaatccgaggggaaagggattccctggatttctataggaacggccgggctgtaatactttgctgtcatatcccctccaggggtggtgatgagcagagggttcctaagccgttctacccccagttgatttcttcccacgaaaggcacagatataaacgagtgggaagctccagagtcgaacaaaatggtagcaggaatggaatgaatgaggaacgtaccaacgatgacgtccggagttgtcagcacatcctcggcagtcacgtggttcacacgaccccgagcgacgtccttaccaccgttgttggggcggggaggcgcttggccttgctggcaccgcggcttcgggcatttgtccgcaaagtgtccgggctcgaagcagttgcagcacagacgctgctgtccttgagcgtctctgcggccttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctccctttggaatctttgggtaaatcgttttggaaagagtt

SEQ ID NO: 13296 - DNA, 7545 bp, Oryza sativa
tggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgctgtgagccttcgccgccgcctccgagcccctttgaaaggacccccggtgtctcctctacccgtcgccaccttcactttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggctgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggaggaggtagaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtctaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcagcgacggcccaacacactcaaagacaacgaaaaacagcggaagactaaggcgacgaccacaggcgcttgacggcaggcacgagctagacaccaaag

SEQ ID NO: 13297 - DNA, 1808 bp, Oryza sativa
ccccggtttctcttcttgtgccctgcccatgccaaatggtgaacactcacagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggatgggctgcag

SEQ ID NO: 13298 - DNA, 734 bp, Oryza sativa
actgaaatccaaaagatttttactcgtcttggatgatgtttggaaatgcacagtgaagatgagtggaaatgcctactatcaccattcacaaagggggaggccagaggcagcgtggttcttgtcacaacccggtttccatatatagcacaaatggtgaagacaactaatctgatagaactgcaaggtctagaacacaatgagttcttcgcattctttgaagcatgtatatttgctgattgcaaacctgagatttatgttgacgacttaattgatattgcaaaagaaatttctatgaaattgaagggtttcccactagcagcgaaaacagttggccggctattgaaaaagaacctttcccaggaatgttggatagaagttcttgaaaggaatgagtagaaaaatatgcaaaatggcgatgggatgatgcctgcactaaaaattagctatgattaccttcctttctatctaaaaaagtgtttttcatactgttccctttaccctgagaactaccagtttaataatttagaaattacttttttctgggaagcaataggcatcataaattctagtgatcataataaagctgaggatataggattaagttatctggacgaactagtaggtaatggctttttagtgaaggttagtgatgataagaggcaatattatatcatgcacgatttattacatgagttagcacaaaatgtttcctcacatgagtgtgtcagtatacg

SEQ ID NO: 13299 - DNA, 1460 bp, Oryza sativa
tcccaatttctcggtgctactgttgccatctctaagtgctctgtcatttgcacacaagacataaacacagtatggttcccaaacctgtgttctcttgagattcgaaattgctccaagttgtcattgccacccatgcctcacaataccatgctaacacgtgttactgtgaaagaagataatcaagcaaagctgcattttgaagaagagacactgagaatagatggttatgggggtgctttggctttccataacctggacaaagtaaaagatatgacaattgaaaacatgttccacatttcattgactgatctccaaaagctgaattcattaacaagccttgatgtcacaggatgcaaaagcatgttatccagtgaagtagacaatggttttatcttttgttcagttcagcaactcaatctcagagattgtcatcttaccgaaaaatcattgggtaagttattaaattgtttcccagctcttacccatttcttcttgagcatgtttcctgaatctgaagaggaagaggaagtagtactgcgattcctatcgcccagctcattgcacgttgcctcaatctcaaatcacaggaatctggttcttccagtggaggatgtggatggaggctgtctccaacatctctcctcactcgaaacactcgagatcgatggatgtggcaacatgttttctcagtggtccatggtagaggcaggagctcagaccaggaagcccttccctacttccctcaaggaactcagtattgtgggagagtcaagcatgcaatcgatggctccactctcaaacctcacatccctcaccagtttaacactaaagcactgtgttaacttaaccgtggatgggttcaatcctttcatcacatacagccaatactcttataaatagagaatttttacggcaataataatcatcgctgctccatagcaacggatatgttctcagaggtggcaaggaccaaagttatgcctgcaggtggctccttccaacagctggtacgacttgatgtggacagtatctcagcagtgtttgttgaaaccatttgtagcctcctcgctgcgaccctcatcgagttgagattcacgtctgacttgattacagaaagcttcacagaaaagcaggagcaggtacttcagctccttgcctccctccaatacctagaattctatgggtgttctcgcctaaagtccctccctaaagggttgcatcgcttttcttctctctatggactagacatctctcgatgtcctcaaaaagaatgttgccaaaggagggcttccccgcttcactgcaagatctaagtatggaggcatgcagcatcaatctaatggatcaagtcaaaaaattagaagcatcaaacccacatttaaaagtacatgatacatcagtgacttatatcgtgaggttagttcatcgaaaaccaacttattaccctcaatttttgtggg

SEQ ID NO: 13300 - DNA, 2800 bp, Oryza sativa
ggacttgattgattgccccccccccccctcccaactgcccaagtggcaccgcacacccacccaaagtatataatagtgtcaatatagttggtatatgtcagggaatacaaggcagcgaattgaaagattaaatgtactccctcattttcatattataagtcgttttgactttttcttagtcaaacttcttttagtttgatcaaatttatagaaaaacatagtatcattttcaacacaaaacaaacatatcatcaacatatattcaaagtaagatttagcgaccccgcaaaaaaaagtaagatttagcgaaaccgatttgatgttttagacattgcttttttttaataagttttatcaaatttaaaaagtttaactatgaaaaaagtcaaaataatttatcatataaaagggatgtctactttttcttagatggttaatgaaataaccctcgtggttagatattgtgttttgatgctgatggtgctcattttatatgtgttttatttttcgggaatacatttttatgtgtgtttcgtactcctactttcaataatgcacttgcgatagcgatacaattatcttgttttgttgagcattaatgtaacatttacaaatgaatggttccttttgtactagattcaccctggcgagcctttttcagccatgtagtacggcaaatgtctgacgacataatataactcctcaaaataacgttaaattaatttgggacttgcttttgcatttgcttcctcaaatcaaattgtttccgtgagttcaacctggagattctgcagaacagttattacagtccaatgcattgttttttccaggtggtttccaagacaaattggtgttccatcggacgagtaatgcagccgccatctgtcgttatatcttgacagagccgagaaggaaaatcctccagagattaggcaccatttgcatggtcagttgattctccattagtccattaccctacccttgctgctcctatagaagctcagaagcgcttgttttgcgatgaaccacttacactgtatctgttcatcattgcaggcttgcagcaaccggatggcgagcaaggttacagagacggcgccgggggccctctccaatgggctgtggcttgcctgggccgaatgcgctcaaacaaatcagcccatgtgtgtgtttggggtggcccaggggccagccagactcttgggcttctcctctctctactccaccacgcattgcaagcagagaggcgcgaggtctcttcttcctccacgcatgacgcctccggatgagtagcgaactaacgatcgcatcctgcacgcatctcacaagggacgccgcgtcgacgccgatgccatccgccgtcacgatccgcagaagcatgcatctgctcaggcgcctcgcgctccctctggcgcgggatgatacgcttttagatcattggatggcagcgggtttgttcgatcgagggataggtttttgcttctctcgaggctcgagctatctccctctgcaacccttctcgctttgttcgacggataagttttagctgtgattggtggtgttggcgtgggtcgttcagtggtgggttcatgtctaggcttagcgctctctgatcttgcttagcggtggttggtgcagcgttaattttcttttattgttatatctatctatctatctatctatctatctatctatctattatatactaaaagtctattaaatttcctataaacgctcctaaaacgccacatagcacccctaaaaacactcctaagtcgccacgtggcgctctaataaattttagaatccgatggacccgttagttctaaccattaaatctattataaaaatacaattaaatttatctaaaaactcttattgtacgtgcacatataggtattccaaaaaaaacaaaaagtacgtccatattttgatacgtacgtacgacgttgggcccacatcattcttttttttctatctcacttattatggaaaaccaaactgtctatatttactatgcaaaatatatgttatttagagtttctaattaggcgcatttcatggaaacatccatgaaaaatataaataaaataaaaaatagattatatgatagctaaattaggctttcatttctaaaataaaaacaactctaattgtgactaacaattctaaaaaattttccactccctaggtaaaatataataatatgtcaaaatgatattactaaattatcatgaacgtattttcaggtattatatgttttctctattctataatatttgaaaaattaaagatcttatatattcttttgacaccatgtcgatgtcttctatctccaacttaattagactttgatctagctcaatagctgagcttatcttggacacacgaaacgacacatgtcattagtgcaagattaattaaatattaaatattatgaagccaaaaatagatttagcttttatatagaatatatttctaataatacacacgtttcacttaaatatatacaatgtagtccatgattatcaatttatttataaggaatataatggtttagatggacttagatattgttatcaaaaggtattaatttcttttataaaaattcctagaacaatcgaggaaacgtgctcataataaataagagagtagccaatccgataagtactttacaacttattgcatacatattaaaacccttaatatgtagtatataatatactttataaatacaaaatagtctaatacaatcgtatattcccactaatcataagtatataagttctgtattagtggg

SEQ ID NO: 13301 - DNA, 2661 bp, Oryza sativa
agtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaagatgttatcgtattattctgtagatatgttatatttatactatttatacatagatgtgaaaataagtgatgaatttttataatgtaacaataatgtatcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatatcaaaatctatcgtctattttatggtaaatatatttatttttttattgtaggataatctaaattcccttacactatatatagtgatataatccattttagcatttttttaataaaaaataagatgcccatgcatctgtgcgaaattccttaccgatttatattctggaaatgttctccaatttatattacgtcgttatagtgtttgaacacaacctatgatacatgcccgcgcgaatgcgcaggttaccttcctagttaatatgaaacatcgtactaactttgtagttttgtttattttaaaagatgtccaaacatgagtagggatggaggcatggagctactattgagagggggtgtctgattaagaaattttttaagctatattagttaatctattttgactatatatgtatctttctcaatgtaaatttaagaacctgtatcaatttaaatttggataaaaaaagagtaagggaagcatgtgacacccccttttcattttgctataactctgccctgaacatgaaagaaacggtgcggaaagagagataatttgcgtcctagagtatccgaaagctttagacactagattagtatgcatgcataggttcgtacctacagttcctaatctcttatcaatgttgacaacctttattggtgatcgctatgtaattcatatcatcatatgtggtggactacttcctcagtcccattttaagtgtagccaactcacatgccattaaggacccttgatgctgtactcttaatgtaacaatgattatcatgctaggctagtgtaccaataattgcagagcaatgcaaatcatttacacttaccacttgtgcaattgccatcgtatgagcaggattgcaagagacgactgacttgcagcctttcttgactactttactttgtttgcattttattagtttatttaaaaggcctgatcacggattagtggttagtatgtgaaaactcatctgtatcgagcgagcagccatcaccgatggggtcatctttgttggacctaaataaaaacttgttactgataaggttttacctagtgcgcgaggcatcctataatccatcacgatgactcattcgtgacgggctccaactcttactcataaaaggtgactttgtcatccgactgagtcttgctctccattcttggtccaacatgtgttgttgtccttcatgaatcctcgacatattagatgagggtgtatatctactcttccgacaaacatcttctcatttttttcaatctacacatgaacaagtcatagatcgtattatgtacacgtcaaaaatatcaatgacatagatggccccgttgactgttacaatggtactgacaaaccatgccttactagtctagactctagagcccacatgttgttatagatctaatttccgaccaaagatgataccaaaatatgaagcaactaaaccctacaatgacatagatggcccgttgagaatttgcttttcaatggagtagccatgtcattgtccagcaaaatcaagacaattatagagaaggtagtaggtgcgcgtgttgtctctgtctccaactttgccccaaatagacattggcaatagtattagtagtaagctttacttgactccaaatgacatgacttattttgttcttcccatagttggatgatatacggaaattcaatagcgacagtggctcgaagtagatcagcttcattcatacaaaggggtaaacgatgggcaactcaatctcccatctatatcacgtactagtacacatcctggcagaataactgctaggtttttcgatcataattttgatcatcgtggtttaatggtttaaatcttttttctgttcttttattaatgtgagaatttctagtcttcatagtataaatatggtggcttctttttaagatattttaataatataatgatccctataataaatagatagattggtagaaccaccgatttttttacatctaaacacatgcagtccaataattacatatgtgagcacgcattgtttggaatctatctattatatactaaaagtccatgaaactttctaaaaacactctcaaatcgccatgtggcttccttaaaacgctcctaaatcgccacgtgacattataataaatagagaaaattcgaaccattgattttcacttaaaataggtggacccattattttgagccattagatttaagctaatccgtatcctctcatctc

SEQ ID NO: 13302 - DNA, 6780 bp, Oryza sativa
ttcaactaatagcaatagttttggtctcatagctcacattgtattgtagagcatatgtaaataatgtaagaaatacatatgctacaatgagttgtgaaatgaaaacaacacaattaaaccatgcatgctcccgtaatgatgcatttaaccaattggtgatgtgggttattgcgctaacgttcttaattcagcggcccattagtctgttggtcaagtggttcaatggaagcaccgtgcttcatgtgagcatcttgcctatgcatctaaatgtggttgttgcgtgcttatttttgtaattactggattgcatgtgcttacatctaaaaaattcgggtgataccaccacttaactatactaatgctccaagtggatacttctatttttcgagtagttgtgtcaatcaacaaattccttttattttacgctgacgaactaatatcattagaccacattcacaaatcaaggggctcctcatcttcgtcaccaccaggctcagggctatttaaaacaaatcgatgcatcttcttccatataaactaaataatccttttaaaagagaaaaaaacagaacaatccatgtccttatcaaacacaaaaattggtggtggcaatggacagtattgaacaacaagattttggacagaatcaacacatagccatgtgacgaatgccatattgatgcttgggacgtcatgaggcagacatcaaacatgagtagtttgtttcatcaagcaatcaagcctggtacaaatagaatcatcagggactcagagccaatctgaagtctgaaacttatacgtccagcaccaaacactcaataaacaagggttgtttatttgcatgcgtcccagatcccgcatcaagcaataaaggtgtatgatctgacaattctctattcagagctctgaccgttgctaacaggaatttcacttcccaatccatgctcataagcaccctatccaacttctcaaaagtttgattttgtagagcattcgcccacgtaaatttacgtccagtgagctccagctctctcaagtctaagctatctatgacagcgttaaacaagaaaggccacttatcactatacttgtcattgtttttctcgctagggtttcgaattatattgaaatcccctccaattagaatcggcaaagactcttttctacaagatctgacgagttcagtaaggaaagcctccttatactcctcttgcgcagccctgtaaactgctacaaggatccattggaaggcattttccttattccgcacatgaaactttacataaaagtctccttcatcaatactagaaacgtcaaaaaattccaaatttactcccaaaagaatacccccagatctcccttttgtctaatccaatgccacaaaaagtctttacctccacaaatgttcttaaggcatgcatttaaaaaatcacttttgcatgtctccaagagagcaataaagtctaacttttgctccttggttatgtccgaaagaaatctgaatttagccaagtcactaagacctccaaaagatccctaattttgatcgtcgcggtttaatagtttaaatcttttcttttccttgattaatgtgagaatttctagtctctgtagcaaatatggtggcttctttttaagatattttaataatataataatccctataataaatagatagattgataccaccacttaactatactaatgctccacgtggatacttctatttttgagtagttgtgtcaatcaacaaatcccttttattttacgctgacgaactaatatcattagaccacattcacaaatcaaggggctcctcatcttcgtcgctaccagactcaggactatttaaaacaaatcgatgcatcttcttccatataaactaaataatctttttaaaagaaataaaaaactgaacaatccatgtccttaccaaccacaaaagattggtggtggcaatggacagtattgaacaagaagattttggacagaatcaacatatagccatgtgacgaatgccatgacgtcatgaggcagacatcaaacatgagtagtttgtttcatcaagcaatcaagcctggttactggtacaaatagaatcatcagggactcagagccaatctgaagtctgaaacttatacgtccagcaccaaacactcaaacccaattaaccccagctgcagctggcaccatctttctcgatctgcaggcggaggagatccatccatggatgtggccgtcggtgcggcgagctggctcctcggaaaggtggtgacacagctgtccgatggcatggtggcggcgtacgtgtccagtacagagcttggcctcaacatggagcaaatcaagaccgatcttgcatacactcaaggactgcttgacgcggccgaagagagagatgtcagaaacaaccatggcctacgggtgctcctagaaatcctgaccaagcaggctgacgaggctgaggatgttttggacgagctccagtacttcatcatccaggaccagatcgacggcacccatgaggccactcccatggtagacgatggccttcgtggtcaagtgctcatccatggccgccatgctcttcatcataccaccggtaactggctttcatgtttttgttgttcctctgcacgagatgacgccgatgatccacatgatatacccaagtcccatagtgatgttcctgaccatgttagcaagttgacattcaatcgagtagacatgtccaataaaatcaagttggttatagagggcatacatgcctcatgtacacctgtatccaatttgctcaaaattatccatcctgcagtaggaagggcattaccaccgaagcgacctcctaccagctcaacaattacacaggataaattgtatgggcgggaaaacatctttaatcagactcttgatgccatgactaactttactattcatagtagaacactatcagttattcctatagttggtcctggtggaattgggaagacaactttcgcccaatacctatacaatgacaaaacaatagaggcacatttctctataaaggtctgggtttgcgtgtctactcattttgatgtggttaaactcactcaggagatcttgaagtgcatatatcatgctgaaaatgagggaagccgcagagtggatgaattatccaacttggatcagctccaaataaccattgcacaaagactgaaatccaaaagatttttacttgtcttggatgatatgtggaaatgcggtagtgaagctgagtggggaagcctattagctccattcagcaaaggggatgccaaaggtagcatggttcttgtcacaactcgatttccatccatagcacagatggtaaaaacaactaagccaatagaactgcaaggtcttggggatagtgaattcttcacattttttgaagaatgtatatttggtcatgataagcccgagtattatgaagacaacataattgatattgcaagaaaaatttctaagaaattgaagggtttcccgctagcagccaaaagtgttggtcgattattgaagtatcgcatttcacaggaacgttggatagaaattcttgaaagaaatgagtggcaacatcagacaaataatgatgacataatgccagcactacaaattagctatgactaccttcccttttatctaaaaaggtgtttttcttattgtgccctttaccctgaggactaccattttaataatatagagattagtcatttttgggaagcattaggcatcatagattctggaagtcataaaaatagagctgaggatattggattaaagtatttggacgaactagaaggtaatggttttcttgtgaagaaagttgatgataggaccgggaggcaatattatgtaatgcacgacttattacatgagctagcacaaaatatttcatcacaagagtgcatcaatataagttcatacagtttcaggtctgataacattccatggtccattcgtcatgtatccatcaccttacaagataactatgaggatagttttgagagagaaatggaaaatttgaagagaaaaatagacataggaaatttacggacattgatgctttttggagaaggcaatgcaagcatgcttatccttttcaaagatttattaaaagaaacaaaacgtctccgtgttctattcatgcatgcaaactcgctccaatctttcccgcacaacttttccaaactgatccaccttcggtatctaaagttggaaataccttatgacgtagaactgtctctaccaaatgcagtaagtagattttatcacttgaaatttttggacctagggtacagtaaatgtattttgccaaaagacatcaatcatctagtcaatttatgcctcttaaatgctagaaaagaactctgttccaatattcctgggattggcaagatgaagtatttacaaaggttggaagagtaccatgttaaaaaacgggacattgggtttgaactaagtgagctaggggatttgacagatcttgaaggtgaactgaaaatatttaatcttgagaaagtggcaacaagggaagaagctaataaagcaaaattgatgtccaaacggaatatgaaaaagttggagctagcttggggtatggtgcaacggaccacaagatctgatgttcttgaaggtcttcaaccaccttctaatcttaaagcacttgtcataaagaacccaggtggttccattggtcctagttggttgtgtggtaatatttgtgtaaactacttgaaatctctgcatatagaaggtgtatcttggggcattctcgcaccttttggtcaactgatgcagctagaggaactaactttgaacaatattccaagcacgcgtcggtttgaacctaattttggtggtgttacacaacaaagtttctcacacttgaagaaagttgaatttgttgatatgccagaacttgtggagtgggttgggggagctcattgccatttgttttcaaagattacaagcatcaggtgtgaaaattgtcccaatctctctatgctgcttgtgccatcctctaggttctctgtctcctatgcacaagacataaacaccagatggttccccaacctgtgttctcttgagattgaaaattgccccaagttgtcactgccccctatacctcacacttccatgttgacatgtgttattgtctcagagcgtaagacagatttgttgcgtcttcaagaaaacaagctgatctcacatggatacagaggtgctttggtctttgataacctggacaaagtagaagatatgagtatcgaagaaatgccacacgtttcattgactgatctccaaaagctcagctccctaacaagacttgccgtcaaaggatgtgaaagcatgttatttagtgaagttgaagagggtgttatcttcccttcagttcagcagctcgaaatcagtgattgtcgtcttaccagaaattcattgacaaagctactaaaccgtttcccagctcttactgagttccacttgatcttctcttcatttgaggttggagaggaagcagtattgcaactcccatcctccaacttattgagctatgtcagaatctggtgctgcaagaacctggttcttcctgtggcggatggagggggtctccatgatctatcctcactccaagaagtcgaaattaggggatgtggcaagatgttcgatcggtgttccatggtagaggccggagctcggagcaacaagttcttccctgcttccctcagggaactcaatatcagcgacgagttgagcattcagtccatggctctgctcacaaatctcacgtccctcactcatctaacactgataaactgtgataacctgacagtgcatggtttcgatcctctcatcacgtgcagcctcaaggaattggtggtctacaagaaagccgatgacgagattcatctctactctttagcagatgatttgttcttagaggtggcaacaaggatgacgaaagtaatacctgcgggaggttcctacttccaacagctggaaaaacttgaggtggacagcatctcggcagtgcttgttagccccatttgcagtctcctcgctgccaacctccgcgagttgcgattcaggtatgatttgtggatggaaagcttcacagaagaacaggaagaggcacttcagctcctcacctccctccaatgcctgaaattccggaagtgccttcgtctgcagtccctccccgaagggttgcattgcctttattctctctataaactaaatatcgctggatgtccggaaatcatgtcgctgcccaaggacggcttcccggtctcattggaacgtctaagaatacgagactgcagcatcgatttaatggttcaagtcaaggaattagaagcatcaaacccagatttacatatacggctccactagcaaacttaccacccaaggtaaaacaaggtgctctcccaactcctacatcttttttccccatttcgtctctaacctttcgaactaactaaaactcgttttttattgtttgttgttaatgatgtagctatccagcaccattgcctcatctggaacctttcagagttcttccatcatcgtatagctgacaatgtaaatgcgaattacacgacaacacatgaagataaagagctctggatggcagagcagccactttggctttcagacataatggatgtcctttgtctattatccaatcaatgttatattgatcattacaattttggtaacttacgttctctgtcattacacttctttccatctcaaactgca

SEQ ID NO: 13303 - DNA, 1227 bp, Oryza sativa
aggaacaaggtgttgcatcacctataatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccatgtctctgttgttgtcaggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctccttgccgagtcccactcgcccctttggccgagtccgaccccctccctcaattccacggttccgagttgtgtcaaacaccttggcgaatttttgtttggtgtcggtttcgagatctgtttggaaaaacggaaccggcataa

SEQ ID NO: 13304 - DNA, 6265 bp, Oryza sativa
aagaaagaaaagagaaaatactattatgtttgagctaaacttcatatatcagagttgtgcatgagttgttcctagtgctatcttgtggtattgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaataaaatagaggagcgtgaattgagatcttctttaaatactttgggttatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaacccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatatggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaaattctgcatggggaagacaatatacacaacatgatagctttacacaatccatcaatacaagaaacaatagaatgaaggaagagtgacctccatggttgcacggctacgcattctccatattgtgtgctaatcagccgttcggaagagacgtccgtaagaacgggtggatagttcggaaagaacgtggaaatggtggcaaagaatgtggaaatggtggctagggctggcaacaagagcttcggttgctgctggcgcaacttatatgatgattgtaactaatcacgattagcgtgatcttgccatgccgtcaaaagcgaaaaaagaacaaaaaattcgttgcctggttgtttctggcgttggaccgtaacagtcagatgttatgtttctggcattggaccgtaacagtcagatgttatatgggccgattaggcccatagcttgtttccttggctatttctggcgttggaccgtaacagtcagatattatatttctggggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcggcgcttacgtggcaattcgaccctgaaaaataataaaacccgtgggacccacatgtcagtctcacatagaaaataataaaaaaatcgtgggccccacatgtcagtcaaactcacccttcctcttcttcctcctctctccccatctccctctcttcatctctctcccctctctgctcctcttccggcgagagcggcgagctggagggggcagcgagaccggcgcccaccggcgagagcagcgagctggaggaggaagccggggcgataaaaggggatcaacgacggcggtgggcggaacagatcgacccggggcagcggcagctccccccggagcagcgccggcaatcgagatccggcagtggcggccgggagaagggcggtggccgatggggagaaggggcgacgtgcagcgatggccgccggaggaggaggagatgcagacatgcggggaggcatggcggtggcagccagaggaggaggacgtccgccgtgcgctgctcccctcggtagcggcggcggcacgggggtcctgggagtcgccgaggtcgacgtcgacgtcgtccgcggccacggccatggcgttcctgtccgcatccggcgtgcaccacagaagcggcggcatggggagtggcgcctcagctgctgcaacggtggcgtcaatggggggaagggaagcgaaagctcctcgctccggtgggctgccgctgacgagctcggtggtggtgaaacgcgacggatcgagcgccatcttggcggctgggggccctcctctgacctctgctctagaccgctgccttcgtcctcttcacccgtcgccggctgtcgtcctcctcgctccggtgggcggtcgctgacgagctcggtggtggaggcgggttgcggcggagggcggtcgccgctccctctcccgctggccaccgccggctgcgcacctctccctccgtccgtcgccatcaagcccccgcccacggcgctcggccatcgccggcctccctgcgtcctccctccctgcccgcctcgccggtctttgcgcgttgctccctcctctcctgctgccggccgcctgccgccgcgcgccgttgtcttccgtggcggctggagagagcagagatagggagatgaagagagggagatggggagagaggaggaagaagaggggtgagttggattgacatgtgggacccacgtgggtcccatgatttttttattattttctatgtgagactgacatgtgggtcccacaggttgaattgccacgtaagcgtcacgtcaatgccacgtcggacgaagaccgagtcaaattagccacgtaggcgccacgtcagccaaaaccgctctcaaaaccgccgagggacctaatctgcactggttttaatagttaagggatccgttgtgtctggttttccgatcgagggacgaaaatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatgatggagtataaagtaagtatagtgcactactagtatacaatagcaattaatatttagcagaaaaagagtgtgcatataggtaaagaaggtatttttattgaattgtttaacaaattggtcaggaagacgtgtgaagaacagatcaaaagcattgtttcttccagggaattgattaagtcagatatgctgtagtaggagactttccctgctcgtgcttgtggacaaccatttgtaatgttcctaaggtaatcaaatcagctatacaaaatataattttcaactccaactaattatgaaactttgccatttaaatttgcagacaaacaaaaacaagttacatgttacgtatactgtatacagctatggccaacttatatgtttagattaattatttttttggcaaattttgctacaagatatcacgactttgtggttttagctgtagggcaccgcacgaagtcacttttggggaaagacactctcaaaatgtggttatttgctaggggacacttcattcattaaattaatatttttgtgctgactaagcgagaaggggcctacttttttacatggcatgaccaaattgccctcatctctttctcttcctctctcttcctcctttaacagcgaggccgctactgaggc

SEQ ID NO: 13305 - DNA, 3903 bp, Oryza sativa
gtgggttagcgccgtccggcggtgatgacggcgagcaggatggggaagacgctccggtagaaggcggcggaggtgtcaccgccgcgcctcttccgcttcttcatcacaaccctgcaagtttgattcgtggcggagctccggcgaggccgccgccgtgggcgctgttggtgcgtgccgcctccccctgcgccaagttggccgcccatcccagcgccgagctcgttgctcgtggccgtgggtggggtgaggacgtcatcgccggtggaggtagaggaggcaaggagggaggtttggggtgggggaagaatatgacaagtgggcccgagggcatttttgaccttttacactgtttatctctcctattgaaccagaaattaatattttattggctgcggtgtcccctggcaaataaccacattttgagagtgtctttccccaaaagtgactttgtgcagtgtcctacagctaaaaccacgaagtcgcgatgtcctgtagcaaaatttgcctatttttttttgtccatgtgaatctaatagtggcctggtatagatggatggtcgacagcaggggagagcagcaaagctgctacacttggccactgcaccctcttttgctcttccttgctgaccaccctaggagatggattacaggcgaggcaagggctccagatcaatatcatccagaaaaaaagtagtatcacaatacccgtaatggtgcatatagtccgtgccaaaatcccaccgaaagtaatgtttactgctgtccaagaaaaaaacacacgaaatgttagacttggaatataaaaattacagaaagaatggaatttaagcaagcatattatggatggttaatagtcacataatataccttttctaatctgtgaggacctctctatacacaatattttttgtgtatgctgctgtctgtttagacaatttctttcctttcttctcattgtccttcacgccagtacgcttagactttttcttttgtttcttgtcttctaccggcatcgatagtatttttatgtttgttctagaggttgctctagacaacgtgacgtatagttgaccatgagagaagacagactctggtaaatagacgcctgcatttggaattgtttgtccctgcgccttattgatggtcaatgcaaagctcaatctaaccagaaattgcttcctcttgaagcgaaaggggaacatctcatcatccgaaggacattgaggtatccgaggaaggaaaactctcttaccagcatgctgccctaccacaatctctacgtcaatagcatttcttccgaactcacgaaccaccagccttgtcccattgcaaagtccgttggctgggtcaatgttcctcaatagcatgatggggcagttaatcttcagcttaagcacatgcggaggtagcccatttagagttagagagttcaagaattcaggcgggtaatagttataagggtcatcctctggtcgatcaaagctatgatatgtcaccacctctcctctaaaccgcccaatcattttcatgttaattcgatccacgaactcattccgggtggacattatggtcctacatgtgatgtagtttgggttcgtaagattatcgtttaggttggggaacacagtatcgatgagcctttcgaggtccgtttcattctctttgcacgacatgcaaatatccgtttcacctcctcggtgccattcccaactcgaaggaggtagtccgcaaaccacacgtcgctctgcaccctcatattgcgaacaagcttcaattgaaccatacaatcccaaagataggacctgcgcagagtggcatctgttatctgagacctagcgcccttcctaatgaccgggagcacctgcctgaagtcccctccaaacacaatcgtcttccctccaaacggagaacacggacaacccattatatctctcatgctcatatcgagggcctcaaccgcttgcctctttgacatggaggcttcatcccatattataagcgacgccatctagaatttggagctcactgcaacacggcgcagttggtgctccaacattccttcggatggccctctccagtcattcgaagtccaaagtccaacacggcccagtccgccacctcccctttctcacccctcgccgccgtccccggctcatgcctcgccgccgcctcatcacctgctgccctctgctcaagcctcgccaccgcccccggctgctcaccacctgccgccgccgccgccgtcccgttactcgccgcattctccacctcctccggtgcacaagtatccatcgccaccgcctcacggcaaagctgccgcacccccaccgcatggccacaggaagttcccaccgccgtctcctcattcagtgaatttggcaatggcgcccttgccatcttatttcagtgccgatccgccatataactaagcagagctgatcatcagcagctctgattgatcggcgacgcacggaatggagcatcgccacattgctatcttttggtatctttgatatgcaaggccatgataaacaccttagctaattaagtaaactcgaggtgaaactgttaggcaaataatcaaaagcccaggagcaactctctgagtgcgttcgtgctttttgtaacattttatctcttccaaaatttaacgagaaagttactgagtaaagtatgtggttgctttgaaatcatggagttgatgtaatgttgttgcttcgttgttttgttgcatgcatgttgccatgttctgtgctggtggatgtgaattgtgacacatgaatcacgctttatttatgctcataagtcatcactattacttgtatgtcatttactgtgtattttcactggtgtatgttgtaatatacttgtatgcaacagtttattggaaaaaacagcggcaggcaaacattgagataagttcaaacatcttaaaatgggtatgcatctgatgacagtaaatttctatatctacaagtaaattaattaggtcataattacatccttagaaatcttcatatatatgaagggctacagaaccatattggaccaaattgtgtagaataccttgctattaacagactcaccagtttaggtttgttaagtggcaaagaaaacatggtaaaacaaagttatcatcttgcaatactgcaacttggaaatagccaggaaaaggaatagcagatacaactcacctagtgtcagattgcagcaacactgcaacagaaaactgcataaggttcaccaggccaaatctgcaacagaaatttgctcggctcattaatctgaacagatatacaattcaagaaaattactttttagcaagattaaccctgctattgtgcatcacagccaggggcaagactggcacctaaatacatctgttcacaactgagcatgcaagctccaacctgtttggttctataatgactataagtggtactttcagattcagcatatgcagagacttttaacagtaggctagtatcggtctgaaatccatttcctattgatccccaacgagcagaaaagagcaggctggtactttcagattcagcatatgcagagacttaaaacagtaggctagtatcggtctgaaattcatttcctattgatccccagtgagcagaaaagagcaggcaagtataggtcataaaaaataaagtgcatcggtgttctcccgaccattttagttttgcagcaaaagaaccagcgaccgcggctggggagatctgttcgggggagttgacaatgagatggtggccagcggccctgagtcccggcggcagaggtggagtacagacggacggcgaggcggcactgaaggaatagtgatcgctggtgacgacgacgcacgctacgacggcggctgctcggcggcagaggtgtagtatggacggacgg

SEQ ID NO: 13306 - DNA, 2189 bp, Oryza sativa
tatggacggacggcgaggcgacacagagggaatggtgatcgctggtgtctggtgacgacgacgcacgctacgacggcggctgcgagcggagaagggtagtcggcgatgaggggctcgaccccgccgcaactcctcccgagcggcacgaagggcggcggcgtgagaggggcggcggagcagcggcagcaggcgtgagaggggcggcggagcggcagcggcaggcatgataggggcggcggtgtgggcgtggcggcaggggcgggccgtttttagggcacgggtgcgggcgtgagaggaggcgctggtggggtcgtgagagggggaggcgcggggtgcggtgtcagtacgtctagattggttcaccatccctcctgcgtattttttaagtagtataaatattcgtagaaatatccataatttcttgaagtgtcacatggcggcttaagaatgctccacggatatgaaatcatgtgactaaaaaaccatgtaattttttttacaaggttattaatgtttatgcggtggcttagtctactaattttaaattatgtagcaaattcttacagtataataatatcaattttaacttcgcccggccctccggcgttagcactagccgttggatgctgctggccaacggccaccgctgttgacgatcgttatcgaccagtttcgaccgtcaatattacccaatgtatgaagactagctatgcttgcaatgcataaattccaaataaaatatctacttccactatatactatgctagtaacatgtatgcaggagaagcacatataaatggaggagaatcgacagaaaatagatgaacgatcaatcagacgttgtcgagaagtagacttgtggatagataggctgataatacagaattaatatgagtaaacaagcccataattcacaccattgggctaaggaataaacgaggagtacacctgccaagttctgggccaaatggaccagaccagggttcggccgaaccaaaagcagcccagatggcccagaaattccacaggccagtagttatcgacatccaatggcggttatgaccgtttctacctgaagcaaccgtcatggacacttgtcacaaggagggagaaagatgctctttggatgcttcatcatgccacatgtcaagaggagagcaaagatgctcctaggatgcttggagcatctccacactcccaaggcacctctccacctataaatacccctcctctcattcattccctcacacactcaagcaaggatcaaagctctctacaaagtagtattagtgctagtggagtagtgttagaatagtttccaagtccgcggaggcttcggggagtttggtaaaggttctatagcttttcctttcttctctgtaagacttccatttatcaatattatattcttctttatacaagttcagtactttattccaatcatagagtatgagtaccagtcttagtttatcaataagtagtataatatgtgtagttaaaccttctgggatttgcattgattctggtatagtgtctgattaccgggtcataagtctgctctggctaggccgagagctatggtccggggactcaggtgctctacaccgattgcaaggctatagagtaataagtagtaatttaagcatggagcttaggttaccgcttatcattatttgggggtatattctctgggtgatttgtaggccgctgatggtgacagctcagtatgggcgtctcccccgcagtttatattcctacatacaatttcctggggttggatacacctccgtatcctacttcggttggagggttatgacaggttatcgtaagaaactcggcaacccggggtaactttgcgatgcatcgggagggcatagctatgcttaggcttagctatgctgcattgttaaaggggttatactacatagtgtatactagttataatatactaagatgttgtatactagaagtacaggaatggaacatatctaaactactgccacttagctataattaggagatgtaggagttagataaatccttagttgtgtgtcactctacccttaagcttaacttacccctgcatagaccttgatgtatataagtaatatataactattagcatagtactctcttatcatatcttcccttgggattaaacaaatacagtaccttagaatactcccgag

SEQ ID NO: 13307 - DNA, 1774 bp, Oryza sativa
cggtcgacttcgaccctgatgacgacgacctcatggacgaggacgtcgccgaaaacatgccggcgcccgcccctcgcctctgctacaccatcgcgggtggcggcgacgacgggggtgtagaggtcggccttcatcgagtcgacgacgttctcgcggagcttcatcaggcagagggcctcgtcgatgatcgatcccgttcccggcaccggcggcggcggcggcgttggtgcccctcatcatctcctcgtcggtcacccgctccgccgccgggcagagcatgcaaaggccgccgcggcggacgcacacgatgttgccgcgcatgatgcggagaggcggcgccggccggcagcagcggcgtcggcgccccttctctgtctcctctctcaccgtgttctctgagttgataaggggaaattttgtctcaacacctagtagaggagagaaaatcttttcgaaaatgaataaaatagcgaaaatggcaaagtggcggtagacgcacgcttcatattggcagtttatcgaatcacgtcttcgggatggcattctagcgaaaccgcgttttgaacatggcgaaatgtccattttctcgtggggaactgagaaagtgggaatacggtcgggacgccactctcgtcggcgcggggagacgaaagcgagaaagacgttggtgccgggtcaatatcccatcggcgagacgggagaggacgacggcgttgattggcggaggcgggaggcctaccgcgtacgggagggtggaggatcgatcgcctgcgagaggggatgaggcggggattccgggcgtggaggaagctaggatgtctcgcctagaaattcatgaaccagaatttctaagctgaatgtgcattaaacccctgtccaggaccagacagggtacacaatcgacaattgttgacatacagatccacgtcttacaaaaatataaaagattacaaatgcagcggaaaaaataaaacgagctagacttggaagcttgacttcagcagcggggcgactccactccacaggcaatccttgacggcagcgacgaaaccaacctcaacaagacagctccaactaggaagatcttcagctctggtgtgggggaaaagagagcaagactgagtactacccactgtactcagcaagtcataccggaagaggagtatgatgcaggatataaccaaaggaagctaggggttcatttgcaataaagcaggcatttaaaagcagtagttgaaaacagtaaagacaattgtagtaattaatcaatattaaccaatcagtgttcaacgctacaccacgttgcaacaggcccaaccagccacctgaactacactagttcattaagctaacctaggggtgagactaatcacggtgaatctggttgatcgcccataaccgcgggcttttcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctaacgggcagtgggcagtcccctcgtgcgccgcggtgaatccggcagctggacaaccggacaccccggccgacccaactccatcacgcccacccacgccaccggtgcctaggaaagggtcgagctatacttcagatcaagcagttacccactcccgcttgtggtaagcacggtaagtctcccagggttt

SEQ ID NO: 13308 - DNA, 2893 bp, Oryza sativa
cagcgcgactcaccggtgtgcgaggagataggcgctccggtgggattccagcaacgtgagtcggcggccgggaaagctcttgcggcggcgaagctaacggcggcggcggcttggcgcggcggcggccctagcggcgacggtatgtggccggagatgagcggcagcggcaaagctcggcgaacgcggcgcggcggtggtaggaggcacgggaaagggtggcgagagtgggaaacgagagagggggctcgggggagcgatttataggtgtgagagggagcggacgaggccgggaaaccaccctactgcgccggcgacgtgggaagatgggaagggagagagagaggggattcaaatttgaatcccagtcggtgtggggcgcgcgcgcgtgcgggggaggtggaggagtgggcggcgacgtgggcacgagcgcgggagaggcgcgggatgggcgtggaggagcggcgtgggcggcagcggcggttgctgccgaggcacgggcggcgagaggttagggacgacccgactggtgggccccacctgtcggcgccccaagggaggagaggaggcggcttgggccggcccagcaagagggaggggcgcaggagagagatgggccaacggcccatcaagagaaaaaggaggaagaaaaaaaagaaaaaggatttttcctgggatttatattgcaccttggtgattttaaattggttaaaattatttccaaggctctgaaaattccactaaaaatcttgttaatgcattagggcatggggaactcaagaaaaattccaccacgccatttctgattattaattgcatttattaattagggattagctctaggttcattaaacaatttcttcgggcaatttattaaacaatttttaaagcaaggaaaaggggaaacttcagggcgtgacataggataaggcgccgtggtgggccgagggggaagatgaggatggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatacaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttaaattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagacacaagatcaacatacaagccaacatgcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccaagtcgacaacagttatataggctaccccaaatattgtactggtgcgattttggtgaataagagcaacgaccggcttcggccaacaggagtagggttattacctgacaattcaggggcccgaacctatataaaaatcctcgtccccatctcttttacctaagtctcgcatatatcctggtaccaacgatccccatactatgcaaataccgtagtcgtgacatcaaacgtcgacaaatacaatttaaaattaacttaaatttggaattaaatataagcaatattgataagagtaaatataagaacccaatagtagattaattaaaaaatccgaaatttgacgggccgtagaggagtatagttgcatcgtttgacgggacttctaaaaattaataat

SEQ ID NO: 13309 - DNA, 3793 bp, Oryza sativa
aaaaattaagaataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatggcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtggtagcaacttatgtgacttttaagaactataaaattacaaacacgaggatgataagatttggtctttcaaaatctcaagatatcgagataaatttttaataaatcttaagtaaaatcatattaaaaaatatataattttatatgggtgctagccgcgcaattgcgcgggcagtttaaaaaactctgtcacgtataaccagccccagacgcaaccacggtggttgcatccaagcgaaggatttcataattaagtcattaatggccaatttggctctaatgggacttgttaattaattttctcctgattcttgccagctaaacccaccatcctacaccttacccatgagagggatgggatggcatctcaatctatgggcgccgggcggttgatgaggcagacaaaactgatcaattttcttttgttgcattgtgaatgagcccaagctagtagaaaaggagtcatccggacctcgtctgaagtccgggctcctgcaggcagcattatacccatcaatacacaaacccaatcaaccccagcaactttccgggccatcggacgagctggtccatggaggcggccgtcggcgtggcgagctggctcctcggtaaggtgttgacgcaattgtccagtgacttggtggcggcgtacgttgccagcaccgagctaggccttaacgtggaggagatcaaaagggacctcaagtacacacaagggctattgcacatggcccaggggaggaaggacatcagggacaacattggcttacagggccttctgcaggatctaagcaagaaagccgacgaggccgaggatgcattggacgagatccactacttcatcatccaggatcagattgatggcacccatgaggtcataccggaggcagatggtggcctccgaggtcatgccctccacggccgccatgctcttcgtcatactgccggtaactggttttcatgctttttttgttcttctgcacgagcacgacatgatgccgacgactcgcaagatacagccaactcccatggtgacgtcattgaccaggttggcaacttgccattcaatcgagtagacatgtccaataaaatcaagtcagtggtaaagggcatacatgacttgtgtacgtgtatatctagattgctccaaattaaccaaactgcaggagaatgggatacatccctggagcggcctcccactagctcaacgattacgcaggataaattgtttgggagggaaataatctttagacaaactcttcatgacttgactaactgcaatattccgagtggaacactatcggttttgcccatagttggccctggaggaattggaaaaacaactttcgcccaacacctctacaatgacaaaagaacagatgcctacttccctatcaaggtctgggtttgtgtgtctactaatttcgatgtgcttaggctcactcaggagatcctaaagtgcatacctcacgataaaagcgcgggaagcgaagcggtgcataactcttccaatttggatcagctccaaaaagctattgcagaaagattgaaatcacaaatgtttttacttgtcttggatgatatgtggaaatgcggtagtgaggcagagtggaaaaatctagtagctccattcacaaaaggggaagccaaaggcagcgttattcttgtcacaactcgatttccatctatagcacaaatgttgaaaacaaccgagacaatacaactgcagggtctcgaggatagtgaattcttcacattctttgaagagtgtatatttggtcaagacaaacctgagtgttacaaacgcgacttgattggtattgcgaaagaaatttcaaagaaattgagaggttccccactagcagcaaaaactgttgatcgtttattgaagaacaacctttcccatgaatgttggacagaagttctggaaatggatgagtggaaaaatctgcaaagtaacgttgacattatgccagcactaaaaattagctacgactaccttccttactatctaaaaaagtgtttttcgtattgcgccctttaccctgaggaccaccggtttaataatttagaaattacttgtttttgggaagcaataggcattatagattctggatatcaaaacgatagagctgaagcaataggattgaagtatttggatgagctaataggtaatggtttcctcatgaaggtaactgatcgcaatagtcagtattatgtaatgcatgatttgctacatgagctagcacaaaatgtttcgtcacaagagtgcataaatatagaggagttttacggtacaatatacttgcaatatatacttgcagtataaataatctaacggtgtggattcatccaatcttctttttacagtataaactagcatggtggcccgtacagattgtgcggctagtatcattatattttctctcatataatagcacatatgttttctcattatattattcaaatatattaaaatgacaacataattttaaattttgcaataactttacgaaatcactaatgtgtaatattcatattgtattttacatacgtgttagttattaattatttttaatattaaattttagttatctgtaaattatatatattcttcctatatggactttagactcgtcttttaatatttattgttttaatttctaaattttcattatttctaattgtatttctacgtggactctaaacttaattttaaatttcagttacttctaaattgtattcctatattgactttaaactcttcttcccatgtttttcttaatttcgaattttagttatttgtaaattatatttttatacggactctaagcactacttttaattttattatgtttattccgaattttagtatggactttatactctacttctaatattccttatttttttaattccgaatttctattttttttcttaattgtatttatatatggactctactctacttctaatattccttatttttaattccgaatttctattattttctaattgtatttctatatggactttatactctacttctaatattccttattttttaattccgaatttctttttttttcttaattgtatttctatatggacactatactctacttctaatattccttatttttaattacgaatttttattatttcctaattatatttttatatggactctatactcatcttctaatattccttatttttaattccgaatttcagctattttctaattatatttctatatgaactctagtctcctcttctaatattctttattttttaattccgaatttcagctatttctaaattgtatttttatatggactctgctttttctttttctccaattaatgtgagaatttctaggccatgagagcgaacgtagaggctcatttttctatttctttaataatataatagattgtgaagggtatatttgtctttctatattttt

SEQ ID NO: 13310 - DNA, 6737 bp, Oryza sativa
gtatggggagagaggaaggggaagcagcacagagcactggagcagcaacatcagctctgcagttgctgtgtgtctctgagatagttgaacgagtgttggtcattcttcagagttcaggctagcgtgcaagatggaggtagatgtgtgtcgttaatggcttacggcatttgaactacgatgtattaaatactgtttcaattggaaggaatcgctctgcctccacgcgtgctcgtccgtcgacaatcggttcgccgccacgcacaatgtattccgaagaagcgctgctgctctagcagaacgtactacgagatccagaactaataccaactaaacaacccgtccgagattaactccgggtgcaaataaatctcaaattcaaattactaaacagccctttctatatttttcacaaataccaaacttacctttctatatactgcaagtatatacttacagtagaatgtaccgtaaaagttctctaaatataagtccacaaagttttagatctgataacatcccacaatctattcgacatatatctatcactgtacatcataaatatggccaaagttttgagagagaaatggaaaatttgaagagaaaaatagacatagaaaatttacggactttgatgttttttggacgatacaatgacaatatggctatatttttcaaaaatatattcaaaaaaaacaaaatgccttcgtgttctatttatgtttgtaaactctatcaaatctttccctttcaacttttcaaaactgattcaccttcgatacctaaagcttgaagtacctcataacttagaaatgtctttgccagccacaatatgtagattttatcacatgaagtttttggacctaggccatggtaattatattttgcctgacgacattaatcgtctagccaatttacattatttccttgccaaaaaagaactttgttccaatattcgtgggattggaaagatgaagtatttacggaggctgcaagaattccatgttaagaaagagcgcactgggtttgaacttagagaattggggtatttgaaagagcttggaggagcactacaaataaataatcttgaaaatatagcaacaacggaagaagcaaatggtgctgaattgatgttgaaaaggaatctaaagacactagaactagtttggggtgcagagcagcagaatagtggatctgagattattgaaggtcttcagccaccttctaatcttagagcatttggaataagaaatcatggtggttccactggtcctagttggttatgtgatgatatttgtgtgaaaggattgagatctctccatctagagggcatctcttggggcactcttccacctttcgggcaattcatatatctagaggaacttactttgatcaatattgctggcattcgtcagttcggaccagattttggtggtgttacacagaggagtttcttacacctgaagaaagttagatttgttgccatgccagaacttgtggagtgggttgggggagctcattgccatttgttttcaaagcttgcaagcattgagtgtgaagagtgtcccaatctctctatgctactaccaccatcctctgagcgctgtatctctcatgcacaagatataaatatcacttgttttcccaacctatgttctcttaatatccgaaattgccccaagttatcactgccccccatgcctcatacttccactctaacgcatattattgtggaaggagattatcaagaagtgttgcatttggaagaaaagatactgagtgtaaatggttatggtggtagtttggccttccataacctacagaaagtagaaaacatgaaaattgaaaagatgtcacacatttcatggaccgatctccagaagctgaactccctatcaagccttaccatcataggatgcaaaagcttgttgtgcagtgaagtagacgaaggtgttatcttccattcagttgagcagctcaatctctataagtgtcatcttgccggaatatccttggcaaagctattaaactgtttcccagctcttacaaagttcgagttgaacaggtccggtgaagctcaagaggttgaggaagcagaactgcgtttcccgtcccccagactgttgcgctatgtcaagatctttggctacgagaacctggttctacctatggaggttggagggagtttccaggatttctcctcactccaagaactcgaattttggcgttgcggcaagattttcgcttcgtggttcatggtagaggcaggaactcatcacactagcaagcccttcctggctccccttaaggaactcactatttacagcgagtcaagcgtgcagtcgatggctgtgctctcaagcctcacatctctcactcgtctgcgactagtagactgtgataacttaacagtggttgggttcgatcctgtcatgacaggcagcctcagtgaattggtgatttataataagccagatatagacgataataatcatcgctgctccgtagcagcacatttgttcgcagcggtgtcaacgacgaaggcaatacctgttggttcattccaacagcttaagaagcttgaggtggacagcatctcagcggtgtttgttgcccccatttgcagcctcctcgcttccaccctctacaggttgaggttcacttatgatttgtggatgaaaaatttcacaaaagagcaggagcaggcacttcagctcctcacctccctccgaaatctagaattctatgagtgccaccgtctgcagtcccttcccgaagggttgcatctcctttcttctatctgcacattaggcatcgtcggatgtcctgaaatcagatcgttgcccgaggagggcatcccagcttcactgaaaaaactactagcaatgcgttgcagcgtcgacctgaaggatcaactcaagagattagaagaatcaaaccaagatttacaagtattctacatctgatcacccaaggtaagacgtgatgtcccaactcctttgttttttactctttcatctgcagttgttcatatttaaactcttttttacctgttcgttgttactgttgatcatctagcgagccaccactactctcttttgaacaatgaagtgcagatacacattctaaagtcatttgaacaatgataaaaaatcaaatccgatgggaaaaaacaagaaattgctagaacatgttggacaatcgccatcttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtacacacagccaacaagaaagaaacaaaagataaactcatcatccaaaatagcagaaacaaaaagaactttaggagcccgctaaccgtagcctagaacgtcacccatgtgctggggtagaaaactactatatggccactaactctaattgttgacaaaccgcaatgatagtaccctgcaaattgaccttctgaaggatagcctatgagcggagccaatgtgtaatcaaaaagataacctgcaaaggagaagatatgttttttcctttcaaaaaccacattatttctgaaaagccaaatagaccaaatagtggtagttgcacctaataagaccaaagatctcaaattgcgtgattgtcttcttatccaatgcccaaacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatttgtgcataaaatcctcgtccaggaatcagccgaggtacacaaactaacaatttaatatacagattcatcaaaatatctaaaacgataaatacttactaaagaggcacttagtcctcaccatgaagaaaactgcagcggaaaaaaaaaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcgcaaagataccaaaggttggcataatataggctcatttgcaaaagcagcatttagcaaaacatttaagagaagtaaaacagtggagtaattaatcagaaattttaatcaacactgaacaacacgcccatgctgctcaggcctaaccattctgaaacaaccatacccggctgtacagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataatccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaattttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcagctagggtttcgcggtggaccgggtgcacggcaacggttcatgggaacgaacggccgagatcaaccctatccaaaacggacggccgagatcgatcggtccacgaccggctcacggcggacggtcccgatgacgtcagcgacaacgtcagcgatgacgtcagcaccggcggcgactcgggcggctcgggcgcgtatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggtggcggagaagatcgggtcgacggcggcgacggtgctccgacggtcttcggcggcggtgaagcggtggacgaggacggcgacgcgacggcgaccacgatggcgatcttcccgagcgacggcgacgtctggaacggcggcggcgcacggctggagcgacggcggcgacggcggcgctagggcacacggagctagggcgctacggacgacgagaggcaaaggcgagggtggcggcgggtagaggagacaccggggatcctta

SEQ ID NO: 13311 - DNA, 4589 bp, Oryza sativa
ggaaagagaccgatccgattcgaactcgaatcaaacacattccaaaccgatttagccgatgtttccaaaggggaaaaggtggaggagatcccggagatcgtttcccctcaatcaatttcaccagaaacggaaaggaacggccggatttggaaggagacggcggcgcttgcgctagggtttcgggcggcggcggcggcgcgaggaggaagacaggcctgacagacgggccccacctgtcagcggctgagagagaagagtggcggctcggcggactgggccggactgggccgaggagggagagagatagagagagggagggttttgggccggctttcggcccaaagccaaaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgagcaagactgagtacaaccaccgtactcaacaagacacacccacaagtgcagcataattgcaaaggagtacaatggagttataatataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaggccaacccaggccaaccattccacattttagttgttaagcaggttttaagaattaaaacactaacttgggtacattgctcggcttgcccataaccgagggcgcggctattcgaatagattatactctgatcagaggtgtacatctttacccataagacacatcttcctcacgtgtaatcacgtgccacataccaccacggtatacaggcggaagacgtgacatagttcccaacccatcctagccatagacaagagtaccgacccaatcccacctacggccggaacccccgggacaggcaggcaggactgagccccctagcagcaggacaccggccctgtgtcatgacatctcgactaccgggccgcagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtatgaatccaattccacaacaatccaacaaatccaatgtgtccaagtgatatgaatattaccacaatctagagttttaaaaccacctaatgttacctaattaatcagcgaagcatctacctaaaatcatactagtgataccacgagtagagtgtccactagttgggggttttgtttatcctagggtgaacaaggtaataataacaataacaataataataaggtcataacaaaggtaaataggcatggctaaataaaacagtgataacgcgggaatttaaataaagcgatgatgcaataatttaaatcaaaataatttcataaattgggattcaatatgttcaaggatgatgtgtcttgccttgctcgctttcccaaatgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattccgagttcaaatggccaagttatagccatttgaagtttatatgctctttaaatgaatatttgcgaatttcttcatttaaattttaatttaaaattggatttattgcgtcagccgaggggaggggcacgcggaccgggtccacgggagtggggcccacgcggcagcctcacggtccacggtggaccgggtgcacgcggcttactccgaccggcgccgcgggccccacgcgtcagccgcacccgagggcgcgggcggctgacggccgggccccacgcggcagccgctcggtgcgcccgaaggcagccacggcggcgcggccggcgggaggcagcgccctcgccccgatggtcgccgccggcgaccaccggcacggcggagcagcggccgagagaggggagggaaagggggaaacgaaacggcggtccacggctcaccccgagtcgacggcgacgacgaaaacggcggccggagcggaggaaggcggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgacggcgcgggctcgattctgacggggaggaagggcggtgtcgcgaccgggaaaattgccttttcccgaacgctagtgtattaatccccgtcccaggaaaagccggggtacaccacacaaacatgatataagagacacttctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcataattaatgcaagggagtacaaggggataataagataggggttaagttttgcagtaaacagcatttaaaagtcacttagttgcccaaagccattttataaagacgatcctagagctacacagttttattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattagaacactgacttgggtacattgctcggcttgcccataaccgagggcgcggctattcgaatagattatactctgatcagaggtgttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagcgcaccaaccctctgccacgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaaatagcaaattaattaatggttctttaaaaaccaaaaaaccgggaaatttaaaaaaaattaaagggggccaattgggcgcttaaaaatttaaaaaaaaaaaacccaaggtgataacgcgggaatttaaataaagcggtaatgcaataatttaaat

SEQ ID NO: 13312 - DNA, 3819 bp, Oryza sativa
  unsure (1)..(3819): unsure at all n locations
cttcccacaactggcatgcgcccaaaccccaccgaaaacaggttttaggggttttgaaaggggaagagaggtgtatgtccaattccaccataaaccaacaattccatagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactggggttcaatatgctcaaggatgatgtgacttgccttgctcgctttcccaaacaccggcttcaacttccacgaagagcggatcttccgaagctgcagcgtctacacgactaacgaaaaagaaaaggcttttactctactaaactccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacttggcagccgcgagggcgcgcccgaaggcagcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaaacggaggaaggcggcggcgcggttcgggacgacgaggacgacggcgctccgacggtcggcgagcgaaacggaggagcggacggggtcgacgacgacgcggcgaagccgaaggaggcgacgccgagaggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccgccattgattgcgccggcgaggatcgcgggcacaaaatcggacgaatccgagggagagagagaggggaaagtgggggaatcgggagagggaatcgcggggaatgattcccccctcattatggtgcgcggggacggcgggatgcggcggaatccgcggcggcggcggcgctagggcacgggcgagcggcgggagcggcgggaggaaggcgatgacaggtgggccccacccgtcagcgagggtggcgggcgggcccgcctgtcagcggcgcgcgcgcggggaggagccgatgggccgcgggggagaggagagagagggagggagagaattgggccgagccggcccaagaagggaagggggggaaagaagacttcttttagggtttttctttttataaaacctttttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagaaaatgaattttaatttcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaacttgcctagcaaaacttctctactctggactgcttggctcaatctcctgttgcagatggaatcttctcttcacctgacttgtccctggttgaacctttagctgacttcgactgggttgcggcacttgaagatggtgcttcagttccagaacttcgcatagttcatatttttggcgtcaacctcatagaagttacccatttcacgttatgcgtcgagatcagctcgtcattactaggataccatgcttgtcatcatgagcatatcatgcttgtcatttacttctaacctgccaccaactgcctcatattagctttcctagtctccgggtgataactacttctgctatttgatgcaagggtcgataactttgcctttgaattatgtttcccaagagaaccaacttatcccacttgacatactttgacgtcttcccaaatggctttactgctggatttgttgatgtctagtcattatcctgccaaatctgaggcgtccgctagctagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggatcgattggtaggaaagtgcgttgagcgatactagtgcaagtgctttcattctagtagcatctgatacaaagcccaaggttgaaccgagctttagattccactgttcaggttttacttattgacttcttggtcatgtcacaaaagtttccatccttgtccccatagaagtacttctacctgtggtcatctctcttactcgtgaattcacctattttaatgacagggcaactgttgtagggttgtttgctatcgggagtcttccttgagtgacacaaatcatggttctcgttatcctttatcaatcacctttcgacctacttcttttcccagtaaccaaacatcttttccgatctcttccattaatcacctttcgacctttctcaaccaggtactcttcactccgggtgttgaggatgcttctggggcaatgaggtgcttgggcgtgctgtctttcagagaaaccttgaagtagttcgtcaaaagctagactgacgattgttgcctttgatccgaagagacacatctgaaactcttagtccaaacaaatgcctctttggttgatcacttgattttcttcgccatcaatcgctaggctatttgattcctaacagattatgggtttacggaaatgagaccctaggtctccctaatcaacaacaaaatgtgcacaactcacagcacttgcactcttaacatggatccttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13313 - DNA, 621 bp, Oryza sativa
ggttgcagttgcgtgatatcgaaatccacctgcacttgtatgatctgtacagatccaatagcgacattttgccaatcagccgtgctggttttttttagaaaatagattaaaccggcctctacatccaaaatagatacacagccaggccgtgctggttagtaaatatgcttatgtcgttttgctatttttttctttttggactgaaactagtatagtattgtagaatgtcccgctcttggtcttactttctgcttattactagtagagtgctcgtgcgttgctacgggaattttgttgatcacgggaaaacaaaatctggcaatccaaaagaaactacaagtcatagttgttctaagattaatttaaaagcaagatatatgttataattacagaagcgtagtataacctttttggcgcataaaacaatctcatggcgtttattaaattataaaaagcaacataaatagaagacagctaatctccaggtacgctttcttgatgaccctcgcacggacaatccaccattttcagtgtatgtgatccatttgtacctcgtggaaccgaacaattctgatgtgaccatggctaccacggatgccaccattgctcacatcatggatg

SEQ ID NO: 13314 - DNA, 335 bp, Oryza sativa
caattttgaactatagaacaaacactaaaaatgtaacttgtaaacttagttacttttttaccttttttttttaaaaaaatgtaacttcacattctactggaagtaacttttatcaggacttgatgtaactcaatgaatgcaacaagtaacttatgatgtactataatttccaaagttattacagattttttagaattacttttttgcaaaaaaaaggagtacctgtattgattgcccatgtctgtttatcccaatgaatggtgcacaaggcatgttatacatgtttgtcatatatgtgcagtcaaacgagatgcaatctttgaagtcattgtagg

SEQ ID NO: 13315 - DNA, 526 bp, Oryza sativa
agtcaacggtattatctattaaaaaacaaaggttatatatatatatatatatatacactctatatgcaagatgaagattcctggaaacgttctaattaaccaaggtagtagctaatcacgggttaattagagacatcgtcagttatagctaggttacaaacccatggatgacgcatatatagtcgtctttttgttttgactgtccatgtatccaactgtaaatgcaatgggatgtttacgttggaccattggaagtttggaacaaagccctgcatgcctatgtgactattgctgagttcgttaggcccgtagaacacgtgcgggaagcgtgctgtctcatctgaacgggtgcaaattaaaatggattattattcactggattgtctatttaattatagggacgaataaatattttgatggataagcttaaaaagatacgtactcgtgatctaaataattcatcagaaaaaaaaaattctatttcaagacagtgtgaaataaatatactccctccgtttcaaaatgt

SEQ ID NO: 13316 - DNA, 355 bp, Oryza sativa
accagatgacaccgcggcggcggttgccgcggccgccgccgcgggggcggccaccggggggaggtccgggaagaaaaccccttccggtttggccggcggggagaagaagaacaacttcgtcgccggcggtgggagctagggtttggtggtggaggaaaaagaggggatggggaatcggtcattaaaggcgaagtgggccgcgcggcgggccgtgggccggggaggtgaaatgacgggatgggggggggggggaggggaatgaaccgcggcggccgcgtccgcgtgggtggtggtggtgggcgtgcggcgcgcgcggtggctggctctctctgcctctgcctccgcggggtttgtc

SEQ ID NO: 13317 - DNA, 3243 bp, Oryza sativa
  unsure (1)..(3243): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccgcaccgatccagctcgcctgcagacaacgtcaagggcttcaacaactgttcctgagaaaccagctatggcttggaacattcctggcaggcctgtttggatgttgttcagtgtcattgatctagttacctccactgccttagcatgccttgtcatttcgtcctccaccttccgccgacattgggcaatctcggttttcttctctgcaagaggatcgcgggcatcgaacgaatggctttcaatgccatcgcgcccactgccaggaaggccaaggccaaccattgaataggattggtagtacttcttctcaatggctcgaagtgagttggtcttcttttccagctcctttgaatatgtctctgtccgcttttttattttcatctcctctgcctgcttagtgtagatgacatggacaacattcacgaagctcttgatagcctccgaagccgaagcatctggaagccggtccagtgcttgcttccactcatcacagaaggtggtgagttcacgagagatcagcgaggtgtaagcctcttgtgggatattactgtccacttggaagagtgtgagcttcagccagccatagagggcacgtatataatcacgttgatacttgatgagacggttgaagtttgagtgccatgctgagacagcagcctcaagatcacgggtggcaagccggtgaagatcagatgttgactcagccatggaattgtctaccagaccacggacttgctgaacaatttcattctggatctcatggaaatggttcattgatctccacatgctcaacagcctgcatatcaatattcagatacaatttaaatacttgcacacaatgtcgcaaaatctggtatcatagatgtcagaacagggaacaagtcttacgcgaagcaaagctcgacaagctgtggtgcaagctcattgtcacgcaccctgacaatggctgaggatgtggtagttgcggcctgtgaagtcacgatgatcaacgattgcagcttgtttatggaggccttggtcttatccagcttggtactatccctccctctgtactccaggctctgcagagtagaaagcttcttctcgtgctcaatcttaacgctctctctagcctgaagcagtaaaaagttaatacatatgggaatagtttcaataaagtttcataaactgcttagagaatagaagcatttagtagacaccggacagtaagaatccattatgttctagattgcagaaataaaaagaacattggttagtctcactcaattatcgaatagatatggtataagtctcatgcctaccaagggtaatgcccctaaaggcctaaacatctctggactctggtgctttagacatagatacgctaaatctacctttggcattatgaggtatatttatgtgcagtaaagacaatttcttgaggatctaaaccttcacccacaaagccacaaagaatctcaaaggacaggagtagtttagatataaaaagagcataaaggaagggtatatgaaggtgtggttgagagatcaatggccatgtattgtgcctgcttcctttactgaaagtagtgaaaaattatcaaccaaatgctacagctgtttcagaatccagggtaggcaagtgcaggacctctgtaaagacgctttatgcaatagaatcagattcttctaccacatttgctgaacaaaaggcgggctgctcaaaacaccaatttcaaatgaggtgaagcttcacctaatcgattagaagctacaccagaagtgttaaagttagcctcaattcatccttgattatttgactgctaggtaggcctatgctgcaatgccaagtgcaacagttcatgcattctattctagcatccaacaagggtggctactagaagattacacctcattaaacttgcattgctgctaaagttgtgcagtgacctaaattatcggttagtccactactatgctctagcaaatatatatagctggataattttcaagtggagccaagtgaatagtttgaagatgcttcaccgacaacgaatgattgaggcgtgcaacaaaaaatgtcacagcaaacaaacacctcaattttagtggtgtgctcatctattaagtataaccactaaccagcagtcaagaatggcattgtaatcaagcgtcgatgagcagaattaccttgacctcctgatagagctttttctcccaggccaaaagacgctccagtgtcgacccatggctcttcccttccattgactccatctctaacgcattggtgtccaacttgtagcgaacagccaatggtggctttgaagtccatgtcgacgacagcgacgatagcaagctgttcgagtggtacaccgtctctgcaaaagaagaagtcaaattaagtgaaattgttaagcaattgcttgcgttttttcactaaaaatgtacattgccacaccaattcaaaccacattatagtttttgttcaagcataatatgtctgctatgaatctctgattacttttgagctgccggaagttgcggtccagctgcgcgcggctagcctccaggagctccgagacgccattgccggcctcggccgccttgacaaagtactcctcgatggcggccacgatctccgccagcgtgcggtggcggatcaccatccgcatctcggcggccgccgtgaccgtggaggaggagtccccggcctccgacctctcgtccctcctcctcagcggcagtggcagcggcgcggcggcgtactccgacggcgccgtgccgccgtactccgatctggccgcgaagccgcactccgatctgttccccatttccccctcctccgatctggtctccgaggtggtcgtcgacgcgtagtggtcgtcgtcgtcctcccatccgccgcaatgcatctcctcctccctctcgtcgtcgtcgtcgtcgacctcgtcctcttccttgaggtggtgggggtggaggtagccccgggccttctcctcctcctcgagctcgcggaggcggttggcctcctcgaggt

SEQ ID NO: 13318 - DNA, 3387 bp, Oryza sativa
cagccttgcccatttcagcccaccctaaggaggagggagagagggagaacagatcagtgcgtcagatgatatctgtcatcctgaaaatcgaagttttccggtgtgcgtgtgtgttcataattcaaatgaacatgttcagggtagtatcgtacttgggatcttcttgaaataaaacggatgtctattcaatcgaaattgagaatagaataatcatctttattaagattccatgttcaacatctgaacggggatcttctcatcctgagccatgtctcagtcggctggcgtgcctatgagggaggcaaattcgtttcctttattttactgatttaattgtatatcaccgcaaggaaattcaccgtaactgttagaatcttgcatcatttataaatctacgggctgttcagcacaagtgttgtttgccaaactttggaagcttattaatatgctgaagcaaacgccagaatattttgccaatcattatgacaagttgtttgcagtgagattgtgagggtaaaagtcttccgaacaaaacaaaataaggaccatggatgatatgcccgacacgtacaagcaaagcatgcgtctaaaattggagtacacatatatagtcgaggtcctgacgtgctttgaatggcgcgactaggaggacccttgattctcgttgcgtacgtcttgaaaatattggaagcttcacagcatcgccaagcagtacacgacctttccatgaagcacctgtacagtctttgttctgcgttccaggataccttgtgataccagtacctcacgacaacaaatcattttcgatcgttagatctaacaatacacgttatgtttagatctaacgatccgcgaaacgatttggtaccatgagataccgttacctcgagttatttttgttagatcggagcaaatctcatcgtttacacattaacttattaaaacgctgctaaaatttaaaatgtaaattttaattttgaagttggttttgatgttttttaagccgttacggcttattacaaatcatgggtaaccgatggggtcctatgtagtagtgtcaaaacccttttaaatatagttcatttctatggagttgtgataaacagaaaaagaaaaacctgcttgtcagtatcacttcttgcatatccttgttcccaactacacgcacctatctagtactagatacctccacataaaaaagaaaaaaagtaactcttttctagtttgaaagaaatgcacacttactataccattttcataagagaaaaacatgcgagagctagcaaaattaacaagatgtagtaaaattctctggttaaacaagcaacaaactaattaatgttgcgttgttcgacagaaatttaggagtaaactctacttcaaataacattttattatcgatgtttcgtttatcaccttttaaccaatattttcattttaaattgtgtatttttacattggtgacacttcggaccatcgttaactattttatccatctacatacaacttgtcgtatgcaaaacacataatcttacatatggatgtgagatttcattgaagagtacgaatcaacgtactcgaaattgttcatatgattgagaagagagtcgaggtgatctaaatggaaataaggtaaaagtacttggtataaaatgttacatcgataataagatgtgacccaaagagaaatttactccaattttaatatccctgatgctattgcacttgattagcttgcgattttcgtaactgtggggttaagaattttttagcttgtctctgttaatcaaccaatcacctcatggtttcttccaaaaatctcagtcacatatttatccgttggatcaatccaatgccatatacctttgtttcttcaacctctcctgacggtgctttccaaccaagaactcaccacggccatgaacgttcaaatcatgctttgatttctgtcgccgacgacgagcttccaccgccatgcgtgctattcttccccggcgacggtagacggctagacgcagtcgaaccaattaaactacgatcggatttaacgactgacaacttttgtatttgacctatctcgtttaatttattgatgctctattcatatattaagcaaacctcttcatattcttagataggagtagatagatagacttaacgactgcacaaaatacaggggcaaaaacaaaagaatcgactcgatcagggtaatcttgctatgaaattttcaacaccactgtaagctagaatctaagattgcttatctagctagtcggtacttttacttactagtcagtttgacttcaaagatgcaagaatttattaagcacataaattgcttaacacaataaacgtaacgcaacaggacaagctatatagattaattagttaattaattaattgagctagcgtcaggcaggtgagcaaatgagaccagcagctttggttgattgattctttgaccaccctggcgtagcaatttgattcttgccatttccagccagccactctcacagtgtcatctccgacttgtccatagactgcaaaagaacacatactcctactacatatgcatgatgctagcctgtatgactttggaccggctagcctgactaatttgtatattgctgttgagcgttaactcgatactgtacatgtcgttagctgaccggtaaagaatcaccaagttaattaattaaatatagctagctagtagtgttactgatacaaatttaagtgactctttttaaagtaattgtttgttaatatttgaagactagttgcgtataactctagctggctggtatatatgtacttagggtgtgttcgctactccagtttcctaaagtgcacagtaaacacgaaaaacgaagcggtccattagcacgtgattaattaagtatttgctatttttttaaaaaaatggattaatttgatttttgtaagcaactttcgtatagaaacttttttaaaaaaacgcaccgtttagtagtttgaaaagagtgcgtgcggaaaacgagggagatgggttgggaaaaagggtttgcaaacacacccttaattactagtgaagaatgtttgcaagaacaaaatttaaagcaactttgaattgtaatccaaataatatttgaatttttaaagtttgacttttaagaacaagtttaggtagattcttcttcttctcttgttaggaaaaacacacatgcatgtacactaaaggagagttggaagttatgaagaaaaacataattttatcctaaaatcaaactaaaaaaattaaactaagctttgattatgcgtggaagttagggagtcaagtctacactctatatagactcggattgaacggcaccgtggactcctattgtctatactcaccgccgtgca

SEQ ID NO: 13319 - DNA, 2289 bp, Oryza sativa
aaaaggtaggctatagttggccaagtttatatgaaaggattgtcgatagttatacttttaatgttttacagatatactaataaaaaacagtagtcaagtttttgattgcaacatttgaccactcgtcttattcaattttttttacaaatataaaaaacgaaaagttatgcttaaaatactgtagataataaagtaagtcacaaataaaataaataataatttcaaaaaaaaattgaataagacgagtggtgaaacgttgcaagcaaaaactcaaatcccttatattatgggacgggggagtacttaaatatgtgcatcaagattgtatcaataaagacctaaacaagaagtaaaaaagggtggggatgaaaaacgtagtactaaaaaacaagtcaatttaccggcaaattaagagaaattagaaatttggttgtaattggaacgatatgatggaaaagttgaaagtttatgtgtataggaaagttttgatgtgatggaaaaagttgaaagtttatgtgtgtaggaaagttttgatgtaatggaaaagttggaagtttgaagaaatattctggaactaaacacggcgaaaagtaggccatatcattttgctgttataaaattaaattgcattcttctactggttacacatacctgatacgcgtactgcctatagacgtgtagtagcacgtgcactgcatgctttctggacacggccaacttaactgtcgtgtcgtcaataggaacagacgaacgatgcggtttcattttcattagccgatcgatcgatatctcctgcctccgctacttgccaagttgcactaacatgcgttctcatttttattttgggtactgctaccttcgttccatattttttttaagtcgaatttatttagctttatcaatttttttaaaaaaacataacaaaattttcaacataaatcaaaataattataataatatattcaatgttatatttaataaaactaattcggtgctacgaatatatattactatatttttttcataaatttagtcgagcttttttaaaaatttaagtttagaaaagtcaatccagtgggagtaacttctaatacacggagggagtacaaatcattctaggaccatgatacagcccgcacatatgcatcttggtcggcaacgtgtgacaagaggtactatgccatgcatgtatcaacattgattcatatacaagtgattacccaattaaaatctaaattcatgtctaaatatttgtgtataagggttaggctcagcttgaaacgtattatagagctttttagaaattatttacttgattatgaggatatcaaatgctttaataaacaaatttaacaaatagttttaaacaaatgatataaggaatgaagcataagattttttttttagaaaatgcatttttccaagcgtgaaataaacaatccatttcaacattttgataaacaaaatctgaatagaaacacgcggatgttgagttgtacttactttataattttaattttaataaaaatggattacagcttggatcaagttttgttatcagagcttttttttgaattatctttttaccttggaccaattaactttatatttatttttcaatttaagatcattatctatcagaatttaaatcgtagtgacaaggtttcaatataatttgagtaaatttcataaaactacaggtattttgaccaaattttcacaaaactacagatttaaggagttgtatcacaaaactacatatttagcactaaatttatcacaaaactacagattttagattaagtatcataaaaatgcatatttaatattgagcttatcacaaaaataccacttttggagtttaaatccctagcaccattgttatggtggagctataaacatcattactttgtgattaaattgattctaaacatgtagttttgtgataatttagttactaatatgtagttttgtggcacttcatcttaaatgtgtagttttgtgataaatttggtgttaaatgtgtagttttgtgatacaccgagttaaatctgtagttttatgataatttggtcatagtatctgtagttttgtgaaatttactcatataattttaatgggacacgctgatcccgttcgtcaccataagcttgtctcatagacgtatccacgcgtatacgggtgttcgcggatcatctccatctcatatactccatctgtcaaaaaaaaaaaaaaagccaacctagtagattcaaacaccactatagactaggatgtgccatatcttag

SEQ ID NO: 13320 - DNA, 6648 bp, Oryza sativa
gatgcggcctcctcctcccttcgtgcgcctcgaaccctccgcgaagccgccaacccccacccctctccccctttaaatcgctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaagctgatcgatcgctagctccggccatggacggcgccgtggcgagcttggagtgcagccatggcgcgcgcccggcgcggtacacgcatggctgccgcgtggtggtgtccgtgacgtcacgtgcgaaggatatggccttaatcctgaattagatagggtgttctttgattaattcgctaaacttcgtaatattaggtaatcgatttggctttcggccaaatattgaattctttcgttctattgctgctcaggtgatcgatgatcatagtagcttcattgcgatttgtcaatgaaatgatataaatatgtattaattacaagttgaagagtactaatgaagaacatcagaggctcagagcaattgagcgcacatctcgttaactccagtctccttttggaatgattggctagtagtacttgtaagacatcgaccgttgaagtcgtgatgtttgctttcttcttttcctttttagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaattaaaaaattagagagataatttgagtttctaagatggattatttcattcatattttaaatagtaaaaacggaacactaaatctctatgattttattcccttcgttcaagtgtaaatgtcagttttaactttagattggcatattttgatcaacaatatttttcaaataatctagcatcaaaattgtatcattatatttgtactaagagctttactaatactctcttgcattcgaatatgtttggtttgacacgcttagaaataatggtcaaatttcatctacctctaataaaaaacggatgactagtaggagtagcattcagactattcaacgggaatcccatcccgggccaactgatggagtgtgccaccttccggcccagggatggtcaccctgggccggctaacaaggatacggcccagatggatgcgtggacctctggtagactagcagcagtgcggcccatgtacatcgcaggaatcccgtgtgagccgaaaagattgaccaaataagcattatgcttttttttagatgggagtagctatacaactattgatagtttttgggatgaaaaaatttcaaatataactactatataattacattgtaactactatataactactatataactaatatgtaactcgagtgtaactcaaaatagcctgatgggagaactggttaggggaacaaacctccaagttggaggtgttgggtttgatccctacagcacgcgtttgaattttttaagccgttttccctcactagcacaaatctcaaagcatattagacagcttaaaatttgaaagttttcaccccctgttaactgtcgccagttggttccctcactagcacaaatctcaaagcatattagacagcttaaaatttgaaagttttcacctcctgttaactgtcgccagttgtatagcaaatccgttttagaaacataggcattcacaacgccgcgcgcagacacaccatatctatatgatatctatatgagttcctcctaccactaaaagaataattagctgtaaatgcgagcactcgtgttaaatctaggatttgaactcggatgagctagttccaccacaagaaatctaaacagttaagctacgttcaactacggctgaattgttgtccacttgagagagttctggtcacaacaagtcagcaatcaggatattggcgagaagcctactcttcttcttcttgatgaatgttgccaatgtggtatgtgggcacaatttgcacaaaatgatgcttgtgggcaacaactttagctgcattagcgtcatctaattcagaacaaaacttgaaacttttcattttcctttttttgaaaggatctgaaggctgaatgaagcttgtaagcaaagtggaacacaaagcttagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtgccgccctcgtcggcgtcctcctcctcgtcgtggcctccccggcgctcgtcccggtggcctccgccgtgcccttcatcgtcctgcacggttagggtttttttttttctctcgcttgtttgcccccctaggttttgtgctctgctggtgcttggatttcgtctgaggttttgctggtcgtgtgtacttgtctgtgtccgggcgcacgcagggatcggcgaccagtgcgagaacggtgggatggcgtccttcaccgaaatgcttggggaatggtccggctccaagggatactgcatgtaatggcgccttatctccccccatctctctctcccttgtgttctggaagtggagactgttcgagctgtgatatttgtgaattgtgatgttgccttttgttatgacgagaaattagttgctgtttcaagtgcaatactagtgctctggtttccattaatatatatgtacaggctattaattaattatttctttgtttttccatgtgaaattgttaatgcgaataaatatagatgcccaaattagatatggtagccttaattatatatccttggggttggggaggtttaaaaaggaatagattgaaatactccacacatatttagcaaatcacgaggataatgaagtatgatgagacgattactgtcaagttccatttgttaacttgtccctgcaattttgtgaggaggatctgggagtaacatatacagttttatacatttgcaaagtcaaccacagtttctgttatggtatgtacacccaatgtgtgatctcacaaccaaaccaattgatgtcccaacttcttttttgagagtttagcccatgctgcatttgtttcagtcaaccacaataactgtttctgttgttggatgcctggagattttatcgcgacattcacctctttcttacacgtttgggtattcacgtaatctgttgtttcagtatcttatttttcgtaccttaccatcctgctctctatttttagttaaatgtcaactgttgtatgaagccaagtttgggcaattcaatacatcttagaagtctcctgactttatgccatgttgaggaactaatatgttgtctgttccaattgcttttacattacttagtatggccttcctggctgttggaagtgaatttaacctgtcgcagtccatagtggggataatgaagattctgatatgcttcataattttgtatttgttcctgtggaatgggccttaacaaaatatgcagaaacaactattgttgaaaaattcatctagtattatggtatgtacaccctagtgggtgaccttacaaccaattgatgccacaactttgtttcttgagatgtgttacatcatatatcagtacaaattttaaaaagtttggcacatgctgcatttgtttgctagtttacttatggagattaaatgtattcctcctcagtgaaattggaagaggagcatgggactcttggctgatgccacttcaagagcaggttgatttcttgcccttgataatttcctttttttaaaaaaaaaatcaaatagactgttcttgtacaagtttctgagattatgtattcatctacaggcagacactgtttgcaagaaggtgattcagaacctccatcacttctatttatgtactgtatgctgaattctcaaggtactatatcattgctggaattgattttccaggtgaagaaaatgaaagaactccgtaaaggttacagcatagttggcctttctcaggtgtgttcatgctattatgctattttatgttcatgacaatagctttattgtaacatgcagatctgttctttgcttcttgtacctctatgcattgctgttcttttgttatgtcttcttttagtcctaagcctatttgatcagtcttggttaacccaaaaccaaaaaataataataaaataaaaataaaaataaatcaaacgaggcctgtgtggaaaaaaaaaaagtgattttcctctctttgtgctgctgccgaacgcaaccttaggcctgtgcggacatgtctcgcttttgttctatgtggacctcttgagtataaaacgtaggagtgtgctatgtgacccttcgatagatttttatttgggttattgacttagtgggagttttgttttcaatgccatgtatttcactagagaatcaccttattgtttcttgttgcatgtcaaaatttccctcatatgtaccctttttgttaccttttacaggggaacttaattggtcgggcagtaattgagtactgcgatggtggaccaccggtaggtgaatctagttcgcttcctgatgttacaataataatatattttatatggtttgttattaacataacaacaccaaggtgagaaatttgatgtacttgtggtttaccatatgcgtcccaacctttcttgatccaaatgatgccttggacctctcttatgtacagttatagtttatttgctgactgtaacaggtaaagaatttcatctcgattggtggtcctcatgctggtacggcatcagtaccactttgcggtgtaagctcactctatcctcccctggtctccttcttttgcatatgcgtatagaccagtatttaagagtagactgcttggtatgaatgactgaaggtttttcatgcatataaatttacacactcttaatgtttagtagccaatggttactaataagcaacaggtagctatttgtagaatgacctatagttaaaacattactccctctggtttaagatatatgttattttagctctatccaacactgaaaaaaaactaggaaaagctaatgtcatagatcttgacatagagcaaggaacgctaatgtgagggggaaaaagttatataaaaaagaagttttttcccaaagaaatctttgctagaatggcataaaaaaatggaccggagacacttattgatagaacatgaatatgtcatataacataaaattttcggggatgatctgtagcattggccaaaacatgttggatgcagtttatgcttgctaaccatccatttgcacagctatcttgactcactggagaaaaacagcaatgcattacaagtgaatagtgaaaacttttttcaatttgccaaatttcaaaggaaggaaaaagcaaggtt

SEQ ID NO: 13321 - DNA, 12319 bp, Oryza sativa
  unsure (1)..(12319): unsure at all n locations
ctgcaaatctgtctgtaacaagatacaacttacagctgtaaaaataccactgtaccagttaattaactactcaatatatgtaaccattaactgtgaagcccattttgacctttccaccttgtttcaggataaaactgagctattttgatttacatgcatgaacaaaccttttagttagtttaacccatcttcttaattctccaggatatgacagattatttgaagggttgcaagtttcttccaaagcttaacaatgagataccaagtgaaagaaatgctacgtataaacaaagattcagcagcctggaaaatctagtattgattatggtaagatgaacacgtaattgttgctatttgacatactctgggttgggtacttgtatgtggtgtagatggaatatgctgtgtgcagtccttgttaactttatatatatagcattatgcattcaaacgatcatatcgaacaagataatgaattaaaagttgttctacacaaaaacaaaagaaacaaatagaacatctatttattttttgaaggcacaatacatctatttatgatcgcgatgtgtaaaacaatatgcttttagtaagctacataaaccttttagttcattaagtcacacatgcattttgtctcgtgttttgtataaatgttgttgatttatataatcttactgaactcaaatgccatttatgcatgcccaaagcaaatggatttaagttgcaacacattcagcttagtttttgtatctcaaatagctgatttttaagataaaggattacaagaaacatgaaaccatactggaccaatccatctgctgatacccttttgaactgctaaacagtttgaggacgacgcagtgttaataccccgggaaacggcatggttcgggtactatcccgatggcgccttcagtccagtgcagccacctcaaaaggtatatgtatatcttgagttgttgtacagaagacatagcatgctttttgttttaaactactgttatttaggggtgtgtattaagtaaggccatttttgtgtgatagacaaagttgtacacggaggactggatcggcttgaaggctttggaggaggctgggcgtgttaagttcgtatcagtgccaggaggtcacctgagcatctccagaagtgacacgaagaagtacatagtgccatacttgaaaccggacggatcatccaggttcggcattcgtcgcatcttgtcggattgattcacgagaagaaggcgttccgagtgaccagttctaacgtcacatggacatggattgtatgtaagctctgaattgtggacttaattgttgatgccatgtaaataccttggtaaaggtaatggggtaatggaatacgtcgtgtactgtagggcaggtggttagcgtacctgaactgcagaactggcgatgctagaattgtgctgcctattagcaaaacgcaattgtgggcttttatgtagcagacctcactaggaaaaagtccaattcgacaatctcgtatatagttcggatttaattcaacaacagaaacagctataatgattcctccagttaggcttcctccaatggtgccttgtaagctatctcataacatgtccacatcatcatgtatcctatgtggaggaaagagaaggcaaaaaatcaatccatctatctcctattcccacgcctatctcgctcagttaccgatgccgtatgagcctgtgcaagagatagcagtcgactcttccacaccaaaatcagatctcgtgctcccttcccccaaatcgccccgccgcacctcccgcccacccccgcacgctgcaccccgttcccgcacgatcccgcgcgctgcaattcgctcccccaccccctggcgcgccaatttgctctcccccgcgcaaatcctccagccacccgcgcgccaatccttcccttgcaccctccctcctcttttcttctccagtgtgtgaaatcttcctcggcggcgtcgacgtatccgtttccacgagcacaacgacgaatccactcctcttgccaatgacgacgagctgtagagcaggatgagctgccggtccaaacgacaagtagctccgcggccgccgccaccgtcgtcgtcgccgccgccgccgccgccgtcgggatctacgactgcctctgggtgcttcgatgctgcctcgtctgccttctttcaggccagtactgcaatggctcctcctctaggaggccaaccaggtactgtaccgtacactcaaacctgatggggattgcagtggctctgccttgcttgcttcctggatgttagagtagaacaataagctgatgatgctctcaacgatgtgcagggttgtggaacggatctttgccacacaccaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgattttggctcctgatatttcagtggtatggatatacatccacctggtggtttcctaagcatgttacaaagtggtcaacagccattagtcccacctcatgttttgttcccagcaacatggccacctatgccacctatggcaccaacaactaattcaggcactatcatcaacttagatgatggtgacgatgttaggactgctaagcgtcttacatgggcatcagatgaggacttgcggttggtgagtaaaattttagacaacttgcagggatttgtaccatcattctgaaactttactaacacataatgctaaatgtaggtgagtgcatggctgtaccactctaatgatccgatcaatggaaatggcaagaagaatgagagctactagggagatgtagttgaattatacaacagcactacacctattaaccggaaaagggaagtaaagcatctcaaagatcgatggcaacaggattaagagatgggtgggatttttctgcgcctcctggaagaaggctgcattagtttatactagtggatattcagatgatcagttgagagactttgctaatcagttttatgtggatgactatcctaacgaaggtccattcacagttttgcactgttggaaggtcttcgtgatgaacccaagtggcatgctgttttggaggagcttgaaaagccacacaagcggagcttggatgatggaagtgacacactatcacaaaaagatatcggagaaaaggagcgcccaatggggaggaatgaagctaagaaacaacgcaatggcaaaggcaaaggcaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactgatgagataagctgagcacgtgatgggtctcaagatgttgagggagaaactgcttggtgatataatctaaggtattttctgtcaatcaccatgcactttattgttagtcaatgttcaacaaatgaccatgtattgtaatatgtattcttagtcaatgtaccacaaataaccatgcattgtaatctgtattattagtcaatgtaccacaaataaccataaattataatctgtattcttagtcaatgtaccacaaattaatctgtaccatgtgactatatattgctctgttatattcagtctagcaaaacaatccagcactgtcctcctctgttccttctatccagtactattcttcctattctattctgcctcatttgttccttccatccagtccaacacttcctcatctgttccttccatccagtaaaacatgtcggatgagtttgacaattccatagacccagccgagatttacactacagatatgttcatggcagagcatagtgtccttaactcttttgccgggcggatcgacagaaggattaaggccagactagaaggaggtacatctaggcgtacaagtggtccaaggaagtacatcaataggaaccatgaaggagcccatgatcaactatttgctgattattttgctgaagatcctctctactctgctgcaacattccgtagaaggttccggatgagaaggcatgtgttcctacacattgtggatgaactaggcaagtggtcttcctattttacacatagagtagattgtactggatgccttgggcactcaccattgcagaagtgcactgcagcgatccgtatgcttgcatatgggactgctgctgacactcttgatgagtacttgaaggttccccagagtactgctctagagtgcttagaaaattttgtggaaggtgtcgtcgaggtatttagtagtaggtacctgcgtcgtcccacggctgaggatctcgagcgtttgctccaagttggagagtctcgtggattccctgggatgttgggaagcattgactgcatgcactggcgatggaaaaattgcccaaccgcatggaagggacaatatacccgaggtgaccaaaagtatccaactattatccttgaggctgtagcttcatatgaccttcatatttggcatgcattctttggtattcctgggtccaacaatgacattaatgtgctcaatcagtcccctctgtttattgaagcaataaaaggtgaagctccccaaatccaatttattgtcaatgggacacaatacaacacgggatattatcttgctgatggaatttatccggaatgggcagcctttgtaaagtctataagatctcctcaactagagaagcacaagctgtttgcaagggaacaagaagggaaacggaaagatattgagcgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttctatccgagccaaaccaatccatagccagcttaaaaatgacttaattgagcatatttggcaacggtttcaaactaggcaaaataattcagtataatgtaagctctagtgtacaatttcattgtaattttatcttagactgactgtatttatcactttcacttactgtacatgtttttctctctaccaggggcgaacagattcgatgtcttttacttgtttttgtggctgcggtccagcttttggtgatcttgttcaaggaatgggataagcacttctggttgctgtccagcttttggtggttgtcgaactcttctatcacttctgtgacgtgatgcagtcttttttttcccttcagtttgctcttttccgcattgtactaaagtgccatgatatggctatgatgttatctagttactgttgtggaccgtgagttggaagaattgcacttcattgttatatactctaagtcgacgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagagttcattagagaaactatctcttgttctatctcttagatgtgtacgatttatgagctagcagttgtctcaacctttgaaggaggccttactaaaataagtgcagtgcagaatgactcagtagtcaggatggtatgtgacgccgacgtagcaactagtcataatttttttataaaataaagtaaggctcccatgtcatcctccccctctcttcctcatcccttgctgctcgtacagtgccaccgtccagccacgccctcctctcatgccggcactgctgtttctgcctcctccgttgtccttgttgccgtcaccgtccattgcgaagaacgccagctttggtgtgtgccccgttgatgtgcatgcatgtgtggttctcagagtacgacaaaccgagtacgcgtgctaggccgagatggcgacgatggagccgaagaggatcccgacgaacgatgcatggagaacccccccccccaccccttccggagggggggggtgggggttcctgtcaatcgtcgacgcatgtacgtactccatgccgaggccggggaatgcagaagagatcgtaggtgtcgagtgaagaaccccatgccgaagaagaagacgatgttgggtttgatggcaccacagactgtcgacgaagggaccgatcaaggtgatgtcaatggaaggtttgcacggcgggaaaaaaacacgccggcagcgatggtgcctgccatctccggcgacgcccaccaccgttgccctctcctcgcacagtatcttgtgtggcgccgctgacgtacggtagagagtagtacaactacctttgttggtaaaaagaactacgaggcatgcatgttcccgtgcgtccgcgcttctcaaactgttaaacggtatatcttttacagcaattttctgtagaaaaattgctttaaaaatcatactaactcatttttcttgctttaaaaatcacacttaattaatcgtgcagctccatttttcttgctggaggtgagggttcccatccctcacccaagtactccactaagcaccagttttcactgtacaccttgcaaattccagaaacataaactttatatagtaatcagtacatttacaaagttacagcgcaggtggagcagcctagtctggcaccaccacacctcattaatcaacaaataaacttactgtataccgcatgaaggtcctgaattcccatcgccggtgacatttcaaagttacttttacacaccaaatgaataaaagaaaattgcacacgccccccacgtcgcaaacaaaaaaggcaagaaaaactactctatgggttcccctcatggagaggcatgaagcgactccccaaccctcccgattgcctcgttcatgtttactcagctcacagctctctttaggtgattctacctacatcccgaaacaaacagcctgcacatgccgagtggtaatgtgacacaagctttgaaagccaaaacattaccttgggccgcaattttgcgatgttttgaacaggctgagaaggctgctgaagaaatgccttgttggaagattagcataagctccactgctgtgctttcatgttgaagtccctgtctgatggtgttccaaatttctgaggacaattcttgcaaagactttggcttcgatagaagcggtcgtggctgctgctgctgcgcgcaagactcgagctgcccctgctttctgcaggagacccgcatggtgcactgcgtgccgacctccagggattgtgaactgcattatgttgggagtattctcattagatctataagtatgttttgctggatggtaaaatcattttgcatcaaatagaagagcagatggaagtcctcttgtgtgaatgtctgagtattttgtgtgcgcacgtgtgtttgagagataaaaacccaaatacatgcaagcatgatattaatcatgaggtatggttcctcttcttagaacagatcaatggtgctcaactttcataatgtcttgtgcatgcggaatagccaaggaatacgttggttctcaatagataggggtcttcagaatattaagatggtacggaaggaaacaaacctgaagaagggcaaaggcagcacaagcgcgaagaattgatgcaggattccggagcatggcaacaaatctagcgatctcggcaccactgaagggaagtaaaggactatattagtactacattcctcttagctacattgctaccaagacaggtccaaaataagatgaacgggacaagcatgaatccggtttaaaatgttccacatgctctgcctaaagaatagccagctaaacttcaggaatagtaaaactttagtgaaagaataaagccaaacctgcatctcaggtgtccagcttcttgtataaacactgcatcagcaatctgagatagtgctgctgaggctgaggaggtggaagccgtagtgaaaacttgtgggtccgaaaatgtcagaacaaaagtctgtatatgcttcaaagccattctcctagctccctcaacattaacactcttggaactgccctctgatgacgtcccaaccaatgcaacctcatccattctgtcatttgagaaaattcagttttagactttgcaaatttcttattaagataatattgcacatcagcaatggcctatgcactacacgttttttgtcaagcaaaacacagtccgattatacaagtaatctgctagccatgctagtatgctgcgaaagataaagccaagtacatcacattgtgatactgtgttagcatctacagttaactgcttttcaagtaagtagtacaaggaaatgggaactatttaatataaaaatataactattaaatacagaaagaatataattcttaatagcaacaacaataaaaataatgctgtcaagtttcaatgcaaaagaaaccaattcaaatactgctgcaaaaaaataaatcttatttgccaaaaaaatgccatgtgcttgcacaatttaatacgacagtaggaaagttagcaggggatgcacaccaacaataggctgatctacaatggtaagttaactttttaattcctcagaagtggtttttaccaatcattgaatacagacgctctctctctctctctctcagagagaatatgtggagcccttaaagtatcaatgtatcactcatggatgttattcttcaataaggagagtaaggagttaaggtaactatagtcagacattactaagaaaacaattaacagaagcaatatatacaaaccaacttaaacggagcttgtaggctcatagctacaaacagaatgtcaaatgagccctaaacttgcaatctaagttgctgctgaaaaataagcaacttggtgattaattgaagtcaccaaactcttttataaaccaatgcatatttttctgtgtgtgtagaataactaatcgtcataataaggctcgaagcactgtgtatattgcattcaagacaaaggtatatcacaaagaacatgaatagatagaattatgaagataacactactggatcaatcggcattctagaataactgtgtgctgttagcctgctggtagagtttaaagtccttatacaaatcaaaattgaatgaaatacaccataattcaaaagcaaacagataaaataatcggtttgaaaaacaacataccttccatcgaacatataagcaagggctagcgcagacatgaaacgtgccatttttgaccctgatgatgagcaaagccgcactagaataggaaccccaccttcttcaacaatacagagagcattaccagaatagaaagcaagattccatagtgcccctgcagctgtctcgtgaacatcctgaataaacagaaagtcgtcatatctagagtaaggaatagcattcattcccaatgacagataaaacatttattcccaacgatagatataacaatctacagtaactgtcaatgccaacgttccttgttttatccataattttatttttttttcaaaaaaaacttacacccgttaccatattaaaaagagagagaaaaactaccctctttatcaaacaatgggctgggctgtgcactctaacaaacaaacagaataaattgacgtgagatcaaagtactatcaaaccattagagaacaaataaattgcatgcctgcagcaggcagcaggacaatattaatactcaaataaatgatgttttccccatcagaatatgttctctcaagcaattggaataatattatataaactggaataacattatataaacagtggcacagccaggattttcctaggcatggttagaaaacaatggcatgaagcaacaaattaagttgaaatggattaaggatgtttaaatctgataagataaatgaatgtttttagtcacttggacatataagttgcatacatgtgcgtatatgttagtaaaagcatatacttgatcttgtgcccaaaataaataaataaataaataaaatcagggtacaaatatatccccatgaatcatcgccactggatataaagttgactaaaaaagtttaatacatatactacattgaactcctgaaaggcatgtacaaaaagaataacacgacgagtggtagcttcataaaaccagaacattaggtaaaagcacaagctgaaggtggcgcactaaccatgaaattacttataatcaagtagctacttcaacaaactcgtctgtttgttcatggacaatactagtcaaacgtatctcaagatatgacagactacggcatggagcaactaatatttccaggtgccaggcagaaggtctatcataaagaaaaaaagtgatttggagtccctaagtaacagaatgtattcgcacatcaatatatgatgtatcagacataaagaatatacaattgtaaatgaaacttacttcaacatctgattgtgccagtgtgagcaaaggtgcgacaccaccctcctgtccaattgccatactgaaaaaggcaaataaaagttgtcaacaagaatgttggagaaaggaataacaagcgatagatggaggaaattatctggtacggaaagacgagagatgcagttctctttattgcagcaagtctgtaaaaaaggccaactagggagagagagagagagagagagagaattgattacaagttgcgacctaaaaggggcgctcctcattcatttacaggcagttatcagacactcgcctcacactgtgcctacacttaccctccagacaaaaatttcatccatcgcttgcacatatgatctggaattcatcagcactaattttccagtagctatattattaacccaaaacagaccacaccctgctactaccatctaacaccagggtcaccaaaaaagtctatggaaataggaggcaatctacaaaaaaaatggttaaagtggatcgtgtgctaagataatgcaattcaaaataagcatgcagtgcaaaccatccaccatctatatccatcaagccatcaagagctttgaagttgagtgcgagattgaagtgttcaagtgtggtcctgaatttagcgcaggcacagctgtcattaaggctgtgttctttccccttctttcccaactcacctcccccttttttcgcgcgcacgcttttcaaactgctaaaaggtgtgtttttcacaaaaagttttctataggaaagttgctttaaaaaatcatattaatccatttttcaagttttttaggctaatacttaattaatcatgcattaatgggcaacactgttnnacatgngngnaggngnagttcccaactccacctcctgaactcagcctaagtgtaagtgtgtaactaactttgatatcagcatattttcatcatgtgtgaagctatctgatatgaatgttaggaaatatagaaactcaggaccaatctaggcataccacaatgtgcaatttttaacaattgctgtgcatgacatctaaaagtgaactgtgaacggattcaaatttgacttaggagagtaagtgtttttttaaattattaatacacttttcttgattgacactaagctagctttcactaattccaaaaaaaaaagtgcattactaagtttaagtgtttatggacaatcaacttgtacacttcatcagctaggcatgtcacaaagaatatcttaaaaataggtcaatctggtagttggtgcaagttcagttcatgagcaagcatatgaagttacctgttagcttctgaaacagatagtccccataatgcgccagcagctctctcctgaaggccttccgaagcattcaaacattcttgtgcaagtgaaacctaaaatatgaaagccatctatgtgaaaaatataaacagcttatttaagtctatttatgaaaagatgggaggagcacacacaaatgatctttaaaacattgtgtcctagaaccagttccacgggtaaacatagaagatttattattatttagttgatagtcggtataacacagtactaataaaca

SEQ ID NO: 13322 - DNA, 3818 bp, Oryza sativa
cctgcagccccgaggatgcaaagctgtgttaaagcacaaatggggcacgtaccaaagcttcaacgccacccgcagcagcaatgccttcacggtttctatcatcaaatgacagattccacagagcaccagcagcttcttgtctaattaaatgcacaggaatcacaatattaaattaggataatataaagtataatttaatggcaaaatcaggcgttgcaacttaaaacagcacatcagctagaagtataccttacaccctcattttgagagcttgttagctgcactaatgcctcaagagcccctgcttcctgacccacagcggcattattattgttgttatctccatgtgcggctaagttagctaatgcccttgcagcctacatgaacaacagtgatagtattagaaagtaaatgcagtacatatacagtgattgtgagcatgtaaaagacaaagcactaggtagcaagttagatggagcatttatttgtagagcttaaaacgcagcaaactgctactataagaaaatagcaattttaagtggctccacgacaaatccaattgttttaaagcagatatagattgtgcaagttgagaataaactgtatcttggaattacatgtacatggtaagagtccagtcagcatcccgacaaatcatttgagataagtatggcaggtacagactttcctttcttataggaaattgggaatccacgtggctcatgccatgagattgagcgatctgataaatataaaaaatcatccaagtccatgcatgaaaagttgcacccagtgcttaatcaatgaagtaggcgtgaaccaagagatcctcatttggcaggataaagttcaatatgcaagcataaaataaagatagcatgtgcacaggtcatcccgttttgtctttatcgtgcttcctattttgtagatcttgtaccgttagttgtattatcagagctagcaaaaaaagctatggtataactagctgactagaacgaatgcgtacaagcatgacgacatgatgtacccgctcacctgttctaggacaccctcaagtttacatgatcgagcaagcatgaccaaagcatggacaccaccagcctttgcaacttccatgctacacttgtcatcagcagctaggtttgcaagtgccccagcagcacgttcctaaagaaaaagagcaaccgttataaaaaatttattatccagaaaaggatagcaagcagcattgaaattactgaaaattgagaagtatcaaagatacatacaagaactccatcagtcccagcaggccagcggagtatgagatcgaccaaagcctttataccaccagctgctgcaatggctgcctgaaaaagaataatcaatatattgttagtaccagcaacacatcagacattgcaatcagagtattcagcatccaaggagtgacaaccttgtgctcctcacccacggagagattccaaaggccaccagcagcttcttcagcaacaagccgattcattgacctggccaaattggttagtattgtgatacctccctcgtctgcaactgcctttgcaaccttggcattcaccgataagttggcaatagcctgaagtcacattaacaactgtaagaaaatggtaataccaaacatagtagatatcggcaattagatccagggattcagctaaaatggacatcattacctttgctgcttctgactgtgcactctcccttgaacaccttgcaaggtccagtagcattggaatgcccccaacacgcatcactgcctctgatcttgcagcatccacattcgcgctctcgtcatcaataaccacaaacgtagcaagtgtggtagctgcacgctcctgtacatcctcctgagagctcttcaccaaactcagcagcatatctgcgccctgctgcagccagaagtcatccattccttgcgggttggactccgctatccgtagaagtgtctgcgacaggatccactcgagccagctcatcatatcaccaagtgcattgtctttgcccttccagttacattcattgaacacctcattctccttcacaaccttatcaggaaaaagtgagacgaccgatttgaaaatgtggcttgtaatggtgagtacaagcttgcccttggagttgctaaatgctccaggattgtgtgcctgttcctcctcaacagatttgcagttaagcgtgcatataagcttgagggttttggagtgggagatgagcctagagatggcacttggtgagacatcggtgcgggacacatcaacggcaacaagggagggcagctgagcccaggaggtggatgctgtagcccatttcaggttgtgacatccagcgacggagaggaaccggagggataggatgccggcgatggcggcctcatctacggatccgcagtcgaggaaggcgacgtcttctaggagggggcagtagcgcgcgagcgctccgatggcgtccgcgtcggcatcgcggagacccgagaggcgcaggcggcggaggcgcgagcagcagaaggctacttggcggagggcgtcgctggagatgcgttcgagtgggtcgggcccgatctggaggctctcgagggcctcgtgccgcgccgcgaggacggcgagcgtggcgtccgtgaggccgcggcagccgtcggccaccacctcccggagcccccgcgcgcggaggcccgaggctgccgccgccgcctcgtgcccccgcagccgcagccgccgcaggctcccgcaccgcgacgagagcgacgacgccacctcggcgtcgcaccggtgcgcgcggaggtcgagcgcgctccacaggcacggcgacgcccccaggtccctccacgtcctgcacgcggccgccatgctcgcccggtcgcggtagttcagtcgcccgaacagctgcagcaccgtgtcatccggcagcgtcctccagtccaccacgcagctcccgctcccgccaccgccaccccccctcgccgccaccgccacccccaaacccccccgccgccgactcgacgacgagcagctcaccagctccctctcctcatccgccgccacatccttacccttcccaccgtccttgcacagccggcggcgcacccggcgcgtcatccccacccctcacgccgccgggatcgagtagggttcggtgccactcgagccccaattcggggagggggatccgattcgcgggcacgcggatgcaggaggaggagggcggtggtggtagctccgattcgcgcgcggcggcggatcgtgcgggggtgggtggatcggctcgctcgctcgcgcgaggcgagctagcttccctgccctttcctcctcctctgcggtgcggtgacggcaaggggagaactggaaggggtgggcaatttatatatagcgtatgcgggtacgcgtatgcgtattccgggctccaaaatacggcgacctgggctacggagtatacggtaatacggtatatatatatagcggtagtagcagtacgcacgtaacgtcaaggcaaggtaaagctggtttatgtacatcctgcagcttttgatcagctcgagagaggagtttttactgtgtttcagaagaatgtaaataaatttgatcagaagagaatcgtacttttggaattggaatccgagtaggaaaggcaacttcactgcattgtagctaaaaaatgggttgggaacttgggatgttcaaaaggattttgacgacttcatgcacaggccatattagcattcaacgctggaaaacggatattacacgttaaatggagtaaagattccacgtttactgacatctacaaaaaaacaatctagccagttt

SEQ ID NO: 13323 - DNA, 2843 bp, Oryza sativa
ccattgttagagcaaggcatacaaagctcacattcatcttctgagctatcatcagatcgatcagcaacttcagaacaagctgttacccaggtacatctatcgatatgatacaaatgtagatccactgattaaaagctgcacatcccattgttagagcaaggcctgcaagttcattcatcttctgaggtaacatcagattgatcagcctcttcttcctctggcaaaggagagacaattgcggcacagcagaaagaatcacggtccttcaggaggaggcaagttccatctgagttccatttcaagtccacaacccgaaagtttggcaacggaacgttgacgcagcatgcaccagatggtgtccacatgtacaggtgcggactctccgtgcagaaaacaaggcgtgggcaattagggtcccaagcggcagcacggattggatctttctgaacaagaacagcagcaagatcaaggcggcagatatcccatatccaaagagcagttggcatattgtcattccgagtgaagaaatagtgactgtcgctgctccatgacagcatacctgcacatgaattgcaaggtgagattagttcagctacagagaaaaaagaacccttaatagtagaatatgaaatgttaacaatgcagtttatactgaaccatattctactagaaattcatgaatggccaacacaaatcacgcaaggggattttagtacttagaagggttatcgataatgtttatagtaggaaccattatcacagtttacaaaatgaattagagatctactgcacatcagatacagaatgtgtaatagtaactacagtagttcacaagttcatgacactggtcacaagtgtattaggcattaggaaaaagaccaacatcctgatccatatgcatgagaaataggagcaactaaccaattccctgcttggggttgggcttgtctgtaacgggtttctgtgaaggcaaagtgattggagcatccatcacagcatacttaactcgagaacctccctctgtcccattttctgaccacaaaaaaagatcagtctccaaaactaaacataaggttagcgctggccctaacacaaggcatcataaaacatgccaaataatttatcaaaaaaggaggaacaagatgcgatataaaagtatcgttagtaatctcaccagcaccattgccttgcatgttacgggagaatccttcacttaggcataactctgacatgtcaagctgccatggatcatccacttcctgtgacattttgtagttacaatcagataccatgaacagaaaaacactagatctgctaagatgtcaattagtgatagatatcagtaggcttaccttaaatatagcagcattagtaggatttcgaatagatgctgcgtgtgagaactcagcaaaagttttccatgtcaggtggttcaaagtccgaactgcttgatcatagctgccaactgctaaaaactgtccacatggtgaccacgcaacagttttcacacctaatccactttcatatgctaagtacttgaacaggcacctcccatccggtgaatatatcagaacctgtgacaatcatgttcttaggattatcagtttaaatccaaaaactgctaacaacaacataagagtagaacaagagattagtatccgttgagatgaaccctatattttatctaaagcagaaaaaaaaaacatagctctataaaaacagactgggatgaacccttaagagtacaataagaaattagttcagctacagagaaaggagaactattaatagtagaatataaaataagttcagctacacagaaaagagaacccttaagagtagataagagattagtttcgctgcagagagaaatgactcaatgagctcttgaacaggatattggttaagaaataaccctgtatgttttgggggagtcatgacccaatataccaactgattgatcattaaagtccaactaataaccagatccgtcaatgtaatcaaatatcaaccgagaaacttgagtaaaccagaataagcaaaaaaaaattgttataagtgccatttgaagaaaaggtggtgtggtttgccatacatgcaagataaagtaattcacaaccagtgcccatctaaattctgaagtaaataagtgaccctaccaacaaaaagtattaacaagttatatgcatatataatgacatacagtaaatgatgatgattttcaaaagtaagcaaataaaacaacaatgggagtacaatgaagagatgcaccttgtattccagaagtgaatcccagaccacaatagcactatcatctggtgaccactcaacacctgccaagtctaccgtgtcaacagcaaagacactcattatctcccaggaatggcatgacagcaaatttacataatccttgcagtcacgcctagtacagattgcagcgaacttcccgtctttagtaaaagaaacacctctggaggcatgctttggccactgtacatgtatgcatgctgtatttacaagagaccaaacagtcagacggagctgaaactctgatgttgttagtatatgacgactgtcagggctccagcgagcatatgcaatcccagcagggccctcatcaatcttgcaggtccagtcaggctggctcagtgaccaagcctgcaccatgggtcgcttgtaaagtccacatagaatatactctgaatccggtgcccagtccagaaagcttatcttgtccacacatgaaaacaactgcaccacctgcataaattaaagcaaaccatacattgttgtcaattgtattctctagatatgactagcagttcttatataaatctccccag

SEQ ID NO: 13324 - DNA, 27098 bp, Oryza sativa
ccccagattcagcgactactccagaaggcacaaaccctaaacccgcattccagttccggaccactaaaacaggatcaagcgggggaggaaggaggtgaggggggggaatggcgcggataccttgagggagacgacgtcccggacgacgaggcggtagtcgacggcgacggcgaggtagcggccgtcgggggagaagcagcacggccccgtctgcttgtacgcctccgtgaactccatcccttcgccttccccttgtcacgcggcggcgggcgggcgggcccggcgccggatcgggcggcggaagcgagaccggggggctctcgccggcgtcgaggtgggggagaagaatgcaaatctactcgcctgaaatttttttttcccttgctattttggacgccccgtggttggaatttgaaattgtttggagggtagagatgataagtgggaacgtatgtacgcgcgccaccgcctaacgagtgggaacgtttgtctgtgcccgtagagcggagcagcggtaggctcctccaggctccagtgcacccgatcgttgtcgttgatacggtgagaatcgtgtaatcccaccttaaaatttttcagcatgtcatatcgaatgtttgaacatctatataaagtagtattaaatataaacgctaaaaaataactaattacacatagtgcgactaatttgcgagatgaatttttaagactaatggctccatgatttgacaatattgtgctatagtaaacgtttgctaatgacggattaattaggcttaataaatttctctcgcagtttactaaacggcttgtttggtaactcgagggaaggggattgggagtttacacgagggaattgatgatgagattaagataggaatttgatttttaatcccaatatcttgtttggtaaaggtgatggaaattaatagggagtttaggagattaggtcattaataaaaaaaggatggctgagattcgtttaaacaacgtaaaggaggaattccctcccaattacctgtccctactcaagtattgaaaaggagggagttccttcctcaattctccatccccatcccactaaaattctcatgcctcccatccaaacaaaaacacttaatagcatcatctctctaaactcccaatccctgctaaaaactccctccaaccaaacaggccgtaagggattatgtaattagtttttttattagtgcccgaacaccccatacgacaccctatataatactcgatgtgacacgccaaaactttacacccatgaatctaaacacccccatactcctacatgagttgtaaaaaaaaagattattacttactatacaattttctttcatgtatttatatattttgtaatttgatcaattattcaaatgtttcaaatgactgtgttgtatggtgtgatttttggagaaaaaaatgcaatttacattcttgataaatcattcaaaggttaaaaaataattgaggtgatgtggtttcatgaaataaaaagataattagtattaactatatttagtagatatgaactttataggtatatacgatactttgtttgtcgatgttttttagccttctatccacgattttaaatgtatacagtttattacccctttgtttcataaaagtacatataattttagaccggcaatgttttagtttcatcggtcctgtcttatatcaaacttatatgaatattaaagaaaaagaaaggacaacatattacttaagcatattacgttcaccatgtaaattccattcataataatcaaacaactaaaagatatcaatgatctaatcaaagcaattattagtcaaaacagccaaatacttaaaaaaaagctaattattcttccattggtaagaaaacagtcggaatcagcagcatctcttcagaactaaccggtaattgaccatatttatcatttaaactactcagtatcaacattaatacgataaaaaaattagaaaaaacaaaatttaaaaatagacaaaaacggtacgatcggaaatagtaccccttaaacagaaacgacgtctggtcgatcgagaatttccgtgaccattttcatccctaggtaagtgacataagcatcgacagcgaagtgtctataataactcattgatctcaagatacgtcgacccattatttgaaggaaatcagataaatatatgcgcgtatttataggagttagcgtgcgcgtgtttatataaaaccatgagtcataccatgttatttgaaaaataaattatgaaaagggaggggctatagaggacccatgtagaacgtgacaatgtcagccaaggatatagaaaggctgcatccatcttccagcccaggaacacagtcgcaactcttaatctcaaaagtccaaaaaacacccttgtagtcttcttagccagtggcaataagcccaagacccaacggcgggctgacggctcacaattcccatcctgccgccggcggctaccgcgggcggtgctcgactcgacctcgatggcgagctcgcgggagcggaggcttccgccgccggcgtaccggatggagaaccccttcagcgtgaaggtgctccaggtcttcaccggcttcggcgtcggctgcggcgtcggcatcggcgtcggccgccccatctacctaggtatagcaaagcttccgaagctaagtgattccgccgtttcctggatagtttgggtctggggattgggatggacatcgatccggtcggccatgagtcggtgggtttcgcatttcgtcgagcggctgagggttgtgattattgcccgcccctggcttgtggccatttcgtcgaacagttcgtgtcgtgtgtcaccgcacatagttccattgcttgaactgtggataagatagtagatgataaaaatgggatgtttgctggtgcataggaatacagtttacttttagttaagtctactagtctgtcgaactgacactggtattgtgcacttcccctcttcacagactacagaccacagttactgccccatactgccatactatagggcatttagggctcgatgattaatttcaatgactttaagtagttggcttctgtcttgatggataggtgtcataccggggcttaatcaagttatgaccgcaacaaggggcgcaacggatgccttttcaggcgtaacaaggcatgttaattccgctgtaagtaaagataatccttgtgtaaccacgaataattaggtgccaatcacgttagtaggatacttttgacttatgttaatctaattatgtattttggacttgtctcgatctaattctgctgtttttcttccttatttttgtgctctagctaaggaagtcagggttaaagaacattgaagcaggcattggctgtggagttggtataggccacggttttggaataggtacatattgcagcttttccatgtagttagtcctctaaattttcttttggtgctgtcctagtaggaactattgtcagtcaaggtcatcttttgtgcttgatatcctcatatcttgagcatatctttcctgtttattacttttgcagtgatcacgccattttttttaacatttgtattatcagaaaccaaaacatgtgttcttgctaggcggtggcaatgtcatgctttattcatagtttcttttttatacagcaatcagattaaatttaggcacctggtgaattggtgatactttgattcttttgtatgttttttattttcattgactgctgcagcagatctatcagttcatctaatctagtccaaaaatgaagtgataattgaggggactcatttaatagaaccacatttcatactttcgcacctagcatactagcacactccctaaataggatccatggaaatatctataatatctgcaacgcttccaggtcattgtttttgttagtagaaatcatcagctgccaagcctctgctattttactcttatttatattctatatcaaatgctacacatctgttaaatatttttcttgcataagcatgcaaacttgtttgatctgaagctgaaccattaagtatctcaatactcaggaattgcattgaagccacaagtaattcatggaattcagtcaaccgttggagtacaaacctaaactttgatcacctgaatttttctttgtttccctttttggtgtatgaattctaagggaactttttctctaggaacttatgtctaagttcacttctaggctgaaggataccccaactttgtcatctgcaccaaatatggctggttctgtgcctagcaatggacaagctcccaatggtgtgtccattgatctaaaggctaagaccacgaaaagtaatttccaccatacaagtaatgaaacatcacaagtaaaaccagctcctgggttgcaaagccagcatggaatgcaaccagatatgactgaaagtcggactgaaaaggttgttgccaactttctacagtctcccctgttccaggatgaaaccaagatggacatcagagatgtggtatgcactaaaacattacctcaaatatctaacctgcactatatatattgcacaattatgggttgcccctatgcctctcgctgctaaaatttgcttagtcagacatgttattcatggactttgaacactcttttctttgttctttttgcaggctagaaattcacatgggatggataatgtgctggaattggtgagtccagttatacctagtgtttcttatgctatactccataatcccactcttgcttggttgttccatcctcattctttgaatttgatatgttctactcacgccatcccatacagcccccttaacatgaagcgcctctaatagtctaatatttttaacaagtaatgtagcattaaaacatgatttcacaagtaaagttctataacagaattttgtcttgcatttgttttaaaacttagttctgtatagtgtacagaatggtccacggttgtctttctacctatgtttatgccttcactgctgtctgctaactgagcttttcatttctgacccagttgctgaagcaccaaagaattattgacgaactgcgggacgagaacgacaagctccgtcaaatgctcatagaagaactcaaggtttcaccttccaagttacaattagatcataaaaatggagtgaaggcctacaacccatgctcggactgctttgattgccggaggcgaagtcgaaaaacaagaagatgataatggaattgcaggattgcattttggctattttcgcaatcctttgcaatttcttggattcttcagtagctaaatagttcatcggattagctttcgacataatatcctcagcagaagatccactcttgttgttcaggccagttatgttacctatctcctgaacattcgtgaacacttgatccaattgatgcgttacttctgtgctgaacatgcgcagactgatagcatcacagcagtacgtgattttagttctctctttggattctattcaatgcagtcaaatctaaaatcattagtagatgcaaaactattaaggtttaaaatataaaatttatattagtagattatctgtgaaaaactcttttatatagttatattttaaatattttttataaatataactttttatagcataaccgtatagtttgagaaatcaatgacaaaacatttgtaccggaggcggtaatacctttttcttttctgccgaagtagagagttttctttcctttttttttttgtgataggagttgagagttgagacgtgccaggtggagttctactgcagcaacgggggaggctgcttttctgtgtacgctggtgtttgggccgtagcaattacaagcccgagagagggaaaaccgcgcgggaaacgccacgtgctcagatccacccgctccccaaaactcccacccccccgcaccaaaatttttcccgcctcccgcccaccaccaacccacaaaatcgcacaactccaaggtccaaatcgcaaaaaaccaacccctcctcaagtgagaaaccaactccaaggaccaaatcgcaaaaacaccaccccctcctcaagaacaaggtagtagtagtgtactagtgttccccccattctctctcccattccccaaatcctccgcggcggcggcgcctcctcctcccatgccttccgagcactagcgcggcagatccgatccgagccccctccgccctatctccgatggactccaaggctgccggctcgtcggagatcgagcgggcgtggcacctcctcaccgtggtcatccgcctcggccggcccgccgccgcctccgacgtcgcgcgcttcgcgaccgccgacgacgtcgagcggctgtgccgcatccccgggtcgccgcttcggctctccgggggcgtcgtggcggcttccgagacggccttcgtggcgttcctgaggtacgtggggttggatgttccgccgccgagggtgagcccgagggcgcccgatgatgtgatgaggtggttgcggaggcgggtgcccgttacgtacgagcgcaagcggaaggcgtcagatgcggggcgcttcgtcgcgaggaagcgtctcctggcggctcccgatgcaggttactttgcttgtttttctgtactgatgttggtttatgcggagccatcagtagtgtggttttgaactccatttgggaaaattttgtacagatttgccggaacacgagctgcggcagtcgcagcaactgatcgtgcaaagctgtgctccagttgctactggagaggtgtgctatctctttcaaccttcaagtttttctagtcgcagaaatatcatggtgcagtaacacaatgcataactgctctagtagctttgctgtagataatgcagggaaaattaggttatcacactgagggcttgttcggttaatccccacgagtacaggattaattccatacctaatcccctccgaagccccttgtggagggattagccaaacaaggcctgaatctgctgtcctacatttctgatttactttttgctcgataattaattacaattggggcttggtctgctccttctgtggacatttctcactgcaaatgacgagagagatttctttagttgactatttgactattttggtcactaggttgatgctacctattgaattgacctgcaatgttctcagtgattttatgaaataagctatgcagtccaatgctttgatacacatatttttatggacatatcatactctcaaaatggatgaccccatgaaagataattctcttgaatatgtctcaagtttgtatgttagtcttgatcttgaccctccaagtagttaaaactttcattattagtagaattcacctattacttcatttttctcttctttctgtgtcttgcctcaggtacatcaggaggctacccaagaattgcaagacaggcttcctagtctcaacatatttactgctcagcgttcctttgaagtttcaattggctctaatgtattttcagacattgaaattagcatgccttctcttccgtccaagattgaccagtttataggaggcaatgatggcagtgttcttgtgagcatggcttctgcactagtgccaaaggaggtgacagacatgtctggctgtatcaatatcttccatgctacagttgacagagagagtactaggattggtgaacctgaaggatcagcttcactttgttgttctagagtagaggaccgtgaggaactagaaaaggagtccaccctccttactatggcagttggcttagctgtgggaaagaaaaatgggattgagcaggatctgaatcttagacctagcagtcctagaaattgtagcacaaaggcaacagatgatatggaaacgttcgatgtgatttcgaaagaagctgaagctctacaatattgcagcccaaatgctcaatacccacagaagatcctaacttgtggtcaggacagtgatgctctagtagttaatgctcatgtggcaattcatgagaataagatagaagacattacattccagcctcctgaaggcaccaaaacagaagctattgtacatgaaatggtccatgaaactatgggaagtttgtgtcaaccttcttcaaacacaaaggttgaacatgcagtgttgccactacaagccccaacttatggttgcattagcaatgagaacttgaacattgctgctgaaaacagagcaagcacacatcaaaatcatgtggagccatcaacacagaacgaagtggctgtcagattatctaagaaagagcaagatagaaagattatgaagcaaagggataagggcaagaaaaaagaagcactgcccaaagaagataaggatcaagttgcagcaaaggttcaaaaggttagtttgtccacatgatgatgactcaactgttgctatttcaggttctttctatttatgaacagtttcatgcactactgatgtgttgtaaccatcatgaaccttgtatttcttttgaaaaatagcttatactgatcttcaaaaaatgatttattgaatgttgctgcttgcagggtcatacagaaccaaaaccactgcctaacttcaaaaattttgaaattgaagaagaggaaggttcaggtgagaatttctaaatattctgttaaaactttcttggtttatattgattgctgaccaatgtgaatgtttacgcatactcagggggttacgggactgtttatagggctcgaagaaaatcagatggaagactgtttgccataaaatgtgtgtacatctctttgctagtctcgatttgatgttttttcatgtggatttgttgatctataaatgtatcttctgttgttttgtcttttgacagtctcagtcatctttctataattatatggctaagatctttacaagagttaaccctgcacctgtattttttttattaacaggtcctcatgcaaatgctcattcacatcatgtttacaatgaacagaagatgttggaacgctttgggtactaataagttcatgtcctccgaaaattttataatgatatttttcttgttccatgcagtaactttaaacatatgtatcatgtttttctgctgcagaggcaagaatttcgtgattaaatatgagtgctctcttaggagtggtgatctagaatgctttgttctagaacatgttgagcacgatagaccagaggttgaaacactcatgttgtctctgatgtttatttttccttttattggctattcatattggtccatcttttgttgaatatttcttttatctctgcagaatctgagaaaagaaataggtttgtttgatttaaggtggtatgggttttgtctgttcaaagctctggcaagcttacataagcaggtctggttaaatgcatgttaccttagtcaactgctaacttgcgtttgtcaccagcttatcttggatatctgatatttctgtttccaggggatagtgcatagagatgtcaaacctggaaatttcctgttctcccgtaaactggcaaaggggtatcttattgacttcaacttggcaaatgttagtgcatatacttatctcccaatctgatgctcgccttctgttttctttatgctaattttaacattttgtgttttccctgaaaatccatgcaggaccttcaccagaagttctttcgaaacagtaagttcactttctaagtttcgaattttgttttgaatttcgatggttaattgcagtgcattgattgttatctgttctgtgttattgcctcttccagttttaggctctctgtactgaatatagctcttgaaaatttccatgccgctaataatatcctgggaaatattccactttggagcattttatcttagtgttggcatgttagcattattaaattattccaacagttagtccaaggtttggaatgattaggctatttgaggtggtaacgaatttattttttgaaaatgcattctgcttcttattaaatgcatttcaaactcttcagatttggaatgttttaagactgttgctgactgatattttggtttaattggttaggtaaatctgagacaatctcacgtgggaaggataccatatctcagcctgcactgaagtctaccccagtggttcaggccaaagaaccagttgccgattcaaagcagctccttggatccaagaggaaaagatccaacagaagcccagtgggtagtgcacctaagaatgataataaaagtaggcatggtatccaagctgctgatgtgtctggtgtaacctctgccaaggatcctacaagcacgaaaacatcattagacaggttgaagcagccaatgccctacaaagggcggaaggaattaatgaacttcttgcatgatgcaatgcaaagtcctgacaaaaatacttcgacagcacctgtttcccaaaggaagagggttgctgctcctctcggaaatgtggatcagaagctctttatactcaccccgatgcccctgtgttcgggtggtagtgctattgctggttctggcatgcttaacagcaaaggtgtgttacaaactttataccttctcactgaacccagcatcctctgagatgtttcatctatataaatatctcaatcttgcaggaaatggaaaacatcgaagagaaggtccatgtgttggaactaaaggatttcgagctccagaggttttagtctctttcaaaccatgagagcttgtctttcagctttgcgggccatgcatttatgtggtgtctttacctgcaggttctttttaggtctttccatcaaggttgtaaggttgatgtctggtcagcaggggtgacactcctgtacttcataattggcaaatcgccttttggtggagatcctgaacagtgagtttactaatgcattttgcaaagctctgattcctcaacatgttaaaggttgttgctgatgatatatcttctcaaatacaggaacatcaaggaaatagcaaagcttagaggcagcgaagaactatgggaggtggcgaaactgcacaactgtgaatcttcctacccatcggtaagtgttgataacctttgaacatcaaggaactgtgaagcttaaccaaaagtgttgataacctttgaacagctttgccgaaacagaaacagcggtgattcttagaacatttctcattgctttcaggacctattcgatgccaaatcgttgcgctcagtggatctcagggagtggtgtgcagccaatacgcgcaggccggagttcttcaagtcgatacctgactcattgtttgatcttgtagacaagtgcttatcagtcaaccccaggtgcaggatcacatcagaggatgctctgatgcacgacttctttgctccgtgccatgatctaattcggcagcacaggcttgctagaaggccagccccttctaataatctgccatgtttgcctcaagacaaatcggtcaaggcaaacgagtcgaagcgatcttcttccaccgtgccgactactgttaactctgtaagttgattgcctccaccagcaaattaaccagtgtgccaatagtcttaactattttgctccctcagatgttgatgtaaccatgtaaatactatatataccccccaaaaatatgtaagatgtcaaatgtaccaatgtttgctccagatggcagcgtgatgtactggtgttgaattcatgcacgatgatcatgtgctacttgatgtacctgtcaatgttgatagactgatagtgggtcactgacgtgtgggcccaacttttgtgggacgtgggtcactgacgcgctcctttgtgggacgtgggtcattgaagtgtgggcccaacctttgtgggacgtgggtcactgacgcgcttctctgacaaagttagatggacgtgggttactgacgtgtgggcccaacctttgtgggtcccacatatcagtgacaaagtccctctgactttatgtcagaggagactcgtccagactgataataccaaccagtagaccattttgcttcctggaatcgaatggggaaaaaaattttctccacttttgttcattattgttcacttcttttttatatatgcggtgtacatttcgtgcgtaccacacggtatacgtggtctaccattgaaccgtatacgtggtctaccattgaaccatccgcattctgcttcatcagtcaacatcattcactcgtatgtactccatctgccatgccatttcgcagcaattgcaacgctttgctcaccacgcgtcgcgcataaccctcctgatttcttatccaaaacgattttgtcaaatactaaacccaaacaaaaccaccgtctaaggggctattcactttgatgccaaaataaatcttactaaatttttacaataccaaaattttggtaaggttgataatattgccaaattttggcaagatagctattttagatgtgttcactttattgctaacgtacatgcacccaattttggtcattactatgcagttgccaaatttctaggatatttaccaaagttaagaaatcaaacagatgcacattttttttactttattaaaaaattgtatggattaaaatgacatcaaagtaaacagcccctaaggctgagttcggatggggggagatgggaacccaactcctgcgtacggaaaacagagcagtctattaacgcgtgattaattaagtattagctaatttttttcaaaaatggattaattttattttttaagcaactttcgtatagaaacttttttaaaaaaacaccgtttagcaatttaaaaaacgtgtgcgtggaaaacgagagagagggaatgggaaaaggtgcatgcgaacacagcctaaatgttgtccacttccccggctgaacggcaaccagatacaagtaaccaccacaagccgttaaccccgttgtttacctcctccttgataatctaacagcgtttaattcccttcaaacaataatattccgttggattcaaaacactaatccaatatacaggattcaaaattcaaaatggatttgctccaaaattcagaatttgtttgtatttcggatggatactgtgtggtgtgtgtgtggctgaaaccgcgaggccgccgcgagagtcgagaagcagcaacagatgcaaaaggagaagaggccgagaagggaaggcaagcgaagcaaccacaccaggcaccaaggcaccaaccaaccgcgcgtcgaagcttctgggccacgccgccacaaaagccgaagcggaaaggaaaagcctccctcgatgcctcctctcctcgcctccacctcctccacgtcccctctcctcctcgcctctcgcctccgcggaggcggcggctgcggctgcggcggcgcccctctcctccaccggacgcgccgcggcttcctcgcgccgagcaccaccaccacccagacgacgaggacgagtttcgcggcgatgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccaggtcagccagccacagattaactcgattcacaaacctaatcgcatgatttcgtttaccgtaccttgctctatgcttaatttcgggttctttgattgagtgggtggcagggaggttcagaattggggatttcatttacgataatttcgtgagggtttagtggaattgaagaattaggctactgatattactagttcagttagtaggagtcactagacagatattctactgcaaatttttacagagaagaagaattcctcgcgagtaaggtaaatcactctatatacgaaagaaacgtgggtgctgtcgtgcacagtaagagctcaaacctgtgacaagtgcggcatagaattgactatcagtactgcggtttcttaattagcttgcaggtcacggctgaccggaattattgatgagttcctcaccaaccaaaggagcttactttggccttatgttctttacgcagttttggtttacagcaagtaccacaatcccataatcctgagcactggcagagaatagactgtcatagcgtcatggttgtgttaggctgtgggcactcagcgttgattgtcctgttcatgggaccattgggcccaatgaatcaggttctgttatattggatcaagaatttgcagcatcccagctgcagtttgcactttcatcatcaaagggccgaataccaagtggctacctgcatattaatcttgagcagtcaatgttatagtgtgggtactgttagcaagtatataccatcatattggtgttatcggttggtttgacaagcatctaattttgtagtggtgctgagtctagcatgtcttgcagtgtttgtaatgcataaccttgcacttgggcagcgctatgtaattttgcaagatcgattgcctatagtatgtatcattttgtgttcactaatttatgtataacttgcatcttgattctttagattggtggacaattgactgctaccaaggagtgccaccaaaaataacaaactaactgaaaaaaaataacttagcctgttattttgttctgttttctgaacaaaccaatgctgatttgcattagataaacttgttcctagacaattagattctatttctttcaagcatccgtttgactgtttgacataactgaagtttctgatcacatatactctgaactctttgtatgcagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaagcggtcgcttcgggttcaggcagtctgcggagaagggttgcaacgaccccatccgttgctacgggtgaagggcaagtttgaaccagaacgccacacaagaacagtgcttgaataaggataaataatagccagacaaaaattatgcagcataatactattttgttacctttgtttgtatcaatccatcgattgtaagagatgagctgaacctggaccatgatacttgccgctgattatgtacaaaccaccttagaaaacttgatatagtattatccttttcgatgcgggaagaaaaccactttttctgattgaattcattcaaatggcaatagccagtagcacttcaggaaatgcagtgtgctctccaattcaagatgaaagtcactcgctgagaactcagacactacagtgaggtcattgacgaaaaatgttgaaattcacctgtaaaaaggtaagttttctaatcttctcatccaaaaaaaaaaaaggtgagttttctctagcgattttttttgcaattgtgttcggagttacatgattgcagtgtggtagtggactgtagtagcattttgagttgtgatacgttctactgttatggttgctgataactgttatttttaccatcatctttttacaaatactccatccatcctcatccatcctaaaatatacaggacattggtaccatgtgatagtacgaatctatctataccaggtaagatataagtatgaattaactgttatattttattgagtggtctcatctataactgttgctatattttaaaacatatattttgttgttatattttatcgagtggcctcatctataactcttgctatatattttaaaacagagcaactaatttcgtgagaccataaatcatgatttagcacttcactacataagcaagagcatgccaggcaatgtttggttggtgcctatgctcacacaatgaaggttaggcaaggcttagctaacaatttattggcaataaccaatatcgacctagttacactaatttacgtataacctgtatcttgatccactagattggttgatgccccacgttactgacctcttagacaggtttgcttagacaggtttggtttcctaacgaagagttgcaccaaagagaacaaactaactgaaaacgaacttgttatgttcaacacaacttgttgccagcactcaaatgataaggcttcaaacaccatgcaatgcaactccacatcaaaggattaaagcaataccatatatcaagagcaactggtaaatgcatgcataacatgcaacataatgaagaaaaacttcagttcgcacagacaaaggttcttgagatgctgatctcaattctcaactataaaatagcagctaaatagcacggtagatcttcagatgccaactctccaggttcatagtgacaaggcattttagacctcatagatccatgggtgctggttgctcctccactcggcgatgccctcagggaaccacagagcaatctccttcctggcgttctcgaccgagtcgcttccgtggatgacattcctgcaaggtatgaggtcatctttagaacttggattctggatacatatttaggtctatgaacagatgagaactcaaagggataacatgagtactagtagaaaggtaaatttgaaggactctagagcaccatttggtgttctgtcgaccatacttgtccttacatactccctccattccaaattgatctacgtatagtttttctgaggttattcctaaatgatctacatatttgtgttcacttattaagtctattcgttatttgtgcattggagtaaatgaacattgatgcatgtatccatgcacacaagtatttataacccacatgcaatatcttaatttgctattgactaggaaatattggggatggtgcatacatcgagtttgttgctagagtaaatatagtatgagagagttattagtttttcttggtcttggtgtacctatgaaatatgtagatcaatgtggaatagagggagtacaaggcaatcattgtgatagtaagatgccagtcctaatgattgttttttgtttttgctggtcgaaatgatgaagtgttattgggccattgaaacattcacatggtaaaatgcactcttattcattaagaaagtatatattttttctgtggaccacgaattagacttggaaaatttggatgcaaggttaatcatggtaaaccatgtagcacatggtgctgtcccacagtggacccataaagtgatatataaaccaaaattcaatcaataagatactagtagtagaatgaatcagcacggttgcaattatttggtatgattggacagtgtatcacttggtacttcaaagtgcataaaacattgcatatggccctgtcagatgctctcaccatgcttaagctagacagaactattcaacagggagtcagtcaactaagctcccaggacagaccaatgctatatattgcacaataaaataaacaacacaccaaaatgtactttagaaacataagtaattttgaactacacaagccttcatgtgctacataagtttaggtgtttctccaaaagcatttaataccatgcctcttgggaggaaaaaaatcattttagcatctgtttctgaaaataaagcatcttagaataactgtgatgggcatctctaattatactccagtggaatttgcatttgaatctggcgcacagcaacatatgagcaaatcaaaattaagagtgagcaagcagtggaggatgcaactgaattaaaatttatcacccactgatgaatgtaaaccacagagtgaatgaacgaaacctgacctgccaatgtcgacagcgaagtcgccacggatggtgcccggctcagcggccagggggttggtggccccgacgagcttgcggccggtggagacgacctgcttgccctcccagaccatggcgacgacggggccggagacgatgtactccacgagccctccgaagaagggcttggaggacagatcggcgtagtgcttctcggcgaacgacttctccacgttcatgaccttcatggctgcatgttcagatagcatatcagcaaaaagaaaaaaaatcatcgctccccacaaagcaatcgatgcataaatcatcaaacaagccactaattagacccacggagtgaggaaagatcgaagaaattaagctactcaacaacaaaacatgcttagtttcagagggagagagagaaatccttttaacacataaatagcatggcacatcgtgttgtgtagcacaaagattcaatctaatcttctcacggtgcagcgcaagcacaaatcaggatcattggcaaggtgggcatggttacctttgaggtagaatcccttcttctcgaagcggccgatgacctcgccaatctgagcaaaacaagcaaaagacaaacacattgaagctaagcactagccaacaccaaatcgatgcgaggggaagtgaaaggtaagcttacgaggcccctctggacgccgtcgggcttgatcatgatgaaggtctgctccaacgccattgctaccgaaaaaagacaagctcctcgagatttcggggtctggttttggaggtggtcggcgccgtaggttgagggagaagggaaaccctagccgtgggtgcccctcccatatataggcctcctgcactgtccggcccaaccacgtgagacaccgcatcgatctccacccaaccctagctagactcgcaaacttgggcccaaattagatctcgtgggcctccaaaacggcattcatggcctgagccatttcacccctgtctccatttcactcgacattatagagagtagtagtaggaactatactaatcacttcattcactcatctcaaagaaaaattaacaaattcttcccggtgtacattgtttgattttttttctcttccggataatgaggtgtatatgctgacagttcaacttgcattactttcggtaaatttctgcgttccgaactagtagtgaatttggaacgagggagtttcgtaggattttcacaagaaatagttcattgacaccaaaggaggctttaggttcggatcttttcagcttattagtcggattattgaaacggatggtttacttcatacttgaaaaaataagtttttttttacttggacaatttgtttaagttagttcttaaatttatttctcaaaaatatatatatatatatatatatattgttcttataataaagttcataatctgcaacaacaatatccactgtaaaataaatttaaaaaaaaaggcaatagtgtttgtgtcaatgggaatagttttgctggcattagctgactttacttgcaagtgtaccggcacaaagagaaagagaggtaggcacatcagcacatggcaaattttgccaattagcaaatgcatcggtgaagcgaaggcgacggcgtgtggaggctggagctggaggaggtgcgaccttgcaagtgcgacttccaggaagcattggcgttgccgttgcgttggttgttagcagttaggtgcgctcgtctctcacggtcgcatggtacgattggcaaatggcaactacacttccacattcttctcgaagaaatggagagaaaaaagggtataaaaccaacaaacttcttggaggtagtacggcattgcaggaccatgaataatttctgaacttgaatgaatgcagcaacgacttgattcttcagtaatttcagagatcatcagattcagtggccaaaacacagagtattctctagtcatttcttgcaaatgtattaggtatttgatcaagaactcaatattggtcaatcctctattgctacagaagaatgaatgccttaccaagaaacctctcaattccttttctcagatcgagttgagtctctctcactatctatacattctacggatgattttttttctctctcttttttttttcaaaaaattctatgccaagattgactttatcaagaacagccaggcagatctggccaattacctgttgaatcgtatgatcaattagctatagctcgtagtaagtagaagtgtttgtcacttcggcgatcttggcgccgccgccatggaccgccgcgtcggccctgcctcgacgtcgccgtcctccttcttctccaccacggccgccgtctcctcctcgccgttctccgccgccggggacggcagcgagggcccctccaggtcgtcgcggacgcggaaggaggcgtggagcacgatgaccgggacgccgacggcgagcgcggcgaggaggttggcgatggcgccggcggcggcgaggtcggcgaggacgagcgcgacgaagacgagggcgacgaggcggcggtcgaggaggcggcggagcagcgccgagttggggaacacccggaggagccccccgtagaggaggaggcccttggaggccgccatgaggaagagcatggacgccctgtgccgcggcgcgagcgacgccaggaggagcgcccactgcagcgcggcgtagtggaaccggaacgtgcggaggttgcgcacggcgcgcaccgccgcggcctccgcgtcggccgcggcgccgaacgccgacggccgcggcgcgaaccgcgccagcgcccgccgcgcccccctcgccgccgcgcacgccctgtccgccgccgcgcacgccgcccgccggatcgcgcccgcgcccgcgccggccgcgcccatatcgccgagattcgcgctgccgccgctcggatcccccgcggcgtcggcgtccttgcacggctcgctttctttatttggaggcggagtctgagacacgggaggagaggcgaggtcaagacgcggtttttaacgggtcgcgcacttccgggagacgaccggcgcgtcgcctgcgctgcgaatacgaaaagaattccggctgcatatcgccaaattttaaatttttaagctgattttgaggggttttttttatcaaaatttatttttcagtcaataattttaagtcacaaaagttttattcataaattacttctcgtttgcaaatatgcgggccgttcggccccatcttttcctcatcagctgctgctaaaatttaattttaaagttaattattttgtgaggaattttaaagtttttttcattgaagttattcttttaaattagtattcaagtcactaataacgtactccctgcgtttctaaatatttgacgctgttgactttttaaaaatatgtttaaccattcgtcttattaaaaaaaatttaagtaatcattagttcttttcctatcatttgattcattgttaaatatacttttatgtatacatatagttttacatatttcacaaaagtttttgaataaaacgaacggtcaaacatctgctaaaaagtcaatggcgttaaatatttagaaacggagggattatatgtataaaagatttatccatattttttattacgttatacattatacggcgtattatcggtatttgaccaaactatggagccttcgtcgccgtatttgcagaaaaaaaaaaaaaaaaaacggggccgtttccactagtttttccgtggaattttttgttgcgatcgccaccgacctcatggtgccatggaccatggtggtgtggttggttcttcccaaatgttcggccgagtccaccaagacaccaacatcctcttctggcgcatgctagcccagctgtttgtttcaattttttatttacacaccttaaaaaaatcttactaaagtcttaatcgtttgatttaacttacagacaataatgatttactcgcagcatgccatatgagcgtgtataataagaatttcataagaaaaactttacatatagcctttctttattttgtttcccttgatgatcttttttaaaagaaagaaatatttttgtcatattattatgttggtgttggagcctaaaaaaatatagatttgacaaagtagtaatgcatgttagtagtagcaatcagtggtcgggctctgattaggtagtattttgtttgcagactggctgactgagttggaatattcagagtttcaccgattcagtcttcagacagtaacaagcttgattactgcagagattggggaacagtgtgctaaaatcagtgaacccccacttgattgggttcctgctttcttgcccagaaaattggaagggtgtactaatcaaaagtgagtttttttttaatgatttttgctccggtgccttaacggagacatcacggtttttcgctgaacaaccggggaggtggatacatcaccaacctaataacaaagatgagagcataagggaaaaaagatgctaggtattgttctttgcttggtcgaagaacactatcagaagagtctggacatctaggaaaacgattgcttaacattcactcaataaaacattgtattaaaaataatatattcactcgagaacaacagactgtgggcttgttcttttcttcaggttagcctgcgtgcgtgcgtgtgtgtgttgtgttgcccaggttattcagagttcagacaatgagacacttttagcctgcgtgcgtgttgtgttgcccaagacgaccttttctttctcataccacaacattcagtcaaaaaacagcatagacctaggcttcctttttccccttttctctgaagaaccttataaaaatcagcctggctttacaaagtcgtttcactccaacaaagaaaacttgcaggatcattagacatatagttcctgcttactaacttctactcctctgctagtacaatacgagcttctttcagcgaaaagattgcacgatttgttggcgataaactctacaagcagatcatgtattccagaagaaggtacatacaaaattcatctagaaaaatcgtacatggagaaatctacatggatcaagttatactgggccctgcctgagcttagtaggcttctcttcgataagtgggccactttgggcctttcctgcttcccctggtattggacctgagaggccgtgtcgctgttcctttttctagctcgggcttcaatagcactaggccatgagcctagtagggttcctagtataaaatgctcaccttttctctcaacaatggaaaatggtaaccacaaactaaaattcaactgaaaatacaacaaaggagcatatgagtaggcgacagttccaagtcgaaaattcaggacaacaataaaacgtgccatgcaaagactctgtgttcttccccacctttcccaactcaccttccctcgtgttccgcacacacttttcaaactaataaacggtgtgttctttacaaaaggtttctatacgaaagttgctttaaaagtttatattaatccatttttcaaaaaaaagagacttaattaatcataagaacatacgtcgctccattttgcatgcgaggaggtgagttcccaatctcacttcccgaacacagccttatgtgagcaggcaaaaaaaagtgggatatactccatatcagcggtactccgtattaaggaggaggtgactttcgaagccaagctagttagtgcgttaagggtgtgtttagttcgtgtaaagaaaatttatgggtgtcacatcggacgtttgaccggatgttggaaggggttttcggacacgaatgaaaaactaatttcataactcgcctggaaactacgagataaatttattaagcctaattaatctgtcattatcacatgtgggttactgtagcactttatggctaatcacggactaattaggctcaaaagattcatctcgtgatttccatacaaactgtacaattagtttttttatctatatttaatgctccatgcacgtgtccaaagattcgatgtgacgtttttggacaattattttttgaaactaaacaagacctaacttatgggtctttctataggctagcatcatgtgagtgggctagttagcctgggttcaagactcacctcctccttaataccattgatatggaaattttggtaaattttgttctcagtttattgtctagatatggtaacccctcttcaaaccgtaagagagatgtggaactcgtgctgctgtcaatttttttaaaaaaaaataaagagagaggagacgaggttgtaatcacgtagggtagtagtagtagatgtatctgttcatcttgttctgagatcagacagttggaacaaatacagcgcagctaggggcagcaccacacccagcaagccaagtaatactgctgctacacttgcctcatgctgcttggaagggacagacaaaccgaaacagatcgaccacgcatgctttgctaattgctgtgctttggcgttttcgctgtaaagtctcctcctcctatatccatttctcactccctcacattgttaaacaatcaattaattaatttgacagctaatctaacaacagatgcatcactctaagatgctactactaatctccctgtggcatggataagacacagacacttgtaattcataacatgagcatatgcatgcacactgaatgagtgtcatcacagcattagatgggatcagggtgtcatgtcatgcagcttcatgctagctactagtagctatactaactttctctctatctttaacaaaaggagataattaaatccttcacttagaccggatgattagcatctgagggcgacgcaatgcagcatatgtgcatgaatcatgatcatcatcatcaggctttctgctgtgacaggacctggaaaaaaattattctagtagcttttggttttgtgtttaactatatatatggtgataaattaagccaccctgatcacatggatcagagtctggctggaccacgggatcccataaaatcggctattaaatcgcaaaagggggcaaaaaacaatagcaatattctggatgaactgccaaggtgtctctcatgtgcattcttgtgggtatattccttccctcttctactagttttcgtccaaactgttccatccatctgcatctttcttcagatcagttcacaatatacttgtactacctcattggcacaggcacattcttgtgggagaaattttggatagagaaatggagatgatgctcctgatgctgggaaagaacatcacatgcttgcatgctcctcgacgtgatgagcaacatgtaagtatatgttagtactgcagtagtgcccttgcagcatcgatcaccaaccaatctgtcgcctgcatggcagaatctgattgtctgttcctcacaaacatgtcatattctgatgcctcctagcaatctgaattactaccatattaaaattttcacccctcctgatggtgttttcaccttctgttctgacacatatgttaagatttcaagttgttcagggaaacacttgtgatatgtatatccacccatcccaccagggttcaagtcctgttgcccatgaatattacagacatactagtgggcattcaatagaatttagtaagatcagggatgtgttgtggattcccgtctctttgagcatgtgttagatggcgcatctgtcattgtgtgagtgtggtgttacgtgtgtagtgttgtgcatgcatttacatctgtcgtgtaatcgcaaaaagatttcaggttgttcaggtgtgtatgtgttcagtgtatctctgaattgatctgtgctgttgctgcatatgctgaagctgacacacatatgttcagtttcagagttcagtctgtttcgagtgttcaatgtatctctgaactgatcactgttgatgctgaatatactacgctgaagacgacactgacattttgactaactgggtgcctataatcagcacggaatacacgaggaaaaacaaaaaatgaagcgccactaatcagttaattaccgtttcaaatgatccatcattagccaatacatgcatgaatttttcgtgcggaatgcccactgctagaactgcgaaacaccctaattctcgctgaatttgtgtgcatgtatatccatccattcatcgttcggctgcctaacagctggaaaaatgactttgtgcatcttgtgagaattgcagctaaagtcaggttagctctgaaagtgctctaccctgcattcttgccaaggttaaattcttccaaccaatacacgctctcgaatcgaaccttatcactcttgtcataaattaagctgcaagaatcagatgattccacagttcagataaccctcaagaaaagaacttcacaagttcagaattcagactgacttaattcaccaggttgccgaaaattcactgcaagtactaatgcagtgcagccgtacgaacctatctgtacggtcgatacgaatttaagcaaaaatccgatccatcattataatctaaatttgagagtctgatcaaacccagatttaaactaatttttaccaggttgctcaaaattcactgcacgtactagtgcagtgcagccgacaaatccatctgtacagttgatacgaatttaaagcaaaattaaatccatctttataatctaaatttgagaatctgatcaaacccagacttaaactaatttttacctgcttgctcaaaattcactgcaaggactagtgcagtgcagccgacaaatacatctgtacagttaatgaaattttaaagcgaaattcaatttaaattcgagagagagaagaagaagaagaagaagaaagacagactaatcatgccaacttgcaagcccaaagacccaatctttccttagaaatttaatttttttttcatctctttcctcgcgttttccctccctttataaccaccaccaccatctcgtctccttcctcccgctcgcttactgctcgactcgtcgccttcctcctcgtggcgagcgatcgatgaggacgggggaggtggcggaggcggtgccgagggtggtggcgatcctgtcgtcgctgctgcagcgggtggcggagcggaacgacgcggcggcggcggcggcggcggtgggggaggaggc

SEQ ID NO: 13325 - DNA, 6799 bp, Oryza sativa
caacgtccaccgcctcctcatcacatccgtcctcaccgccgtcaagttcgtcgacgacatgtacgtcgctgcaccaccactctctctctgtttttttttacttcctaattccccatttcacgcgaattacgcacgacaacgccaccgacagagttgcttgcttgcgatcgtcgtcgacagaattgtagattgattcaacggtggcatttgttcgtagcttctgaatttcaaattttgaaacttcaagagcaagtgtagataaaaaacgaactctttttctatcttgaaaacacaattgcataaacacttgcaccggttagattaaaaaaagttgcatattcttgtattatctagccagccaaatcaaatcgaactaaatcaacctgaaattctgagcaaagttgcataatgcagcagcagcatgatcgcataattcgaccttttttttctctttacaatcgcacaattcgactttagtagcgatgttgcttggcgaaatgtgatcgaccaatcctttttctttttcgttttttgaaccaaatgtgatcgaccaatcgatggatcgatcgatcccctttggattgattggcacacgagcactgctgcacagccccaccactgtaccacaggcatgtggtccccactcacagacctactagctaatcccctttttcacctagcaatagcattttccaactggcattggcaatagcatcaaatccaagccatcgagttggtcacaaatccaaaggacagttgtcgaattcgaggttgatgcggcggccattctactaccaaattcgccattcttaccaaagtgacagacaccttgggtgtgtgtgtgtgtgtttgtcctatctaccttctcacaggctcacattgccctcaaaacaagccactcggttttgtccgtttcgccattgacaagagctattgcttcggtgacatgctggctggcctggccatcattgatcagtggtctaaaactctgaatatgctcttcttcttgtcgtagtttggaatatgttttttttttaccgggttcgttttatctttcggttgaactggtcggtgcatacaattcaacctgatgaccgtcacaatgcgtcgtcgatgcagatgctacaacaatgcctacttcgcgagggtgggaggcatcagcttgatggagatgaattatcttgaggtggacttcctctttggcatcgccttcgacctcaatgtcacgccggctgccttcgcctcctactgcgccgtgctgcagagcgagatgacctacctggagcagccgcccgccgtcgatctccccaggctgcactgctgtccgtccgatcaggacgatgccggctgccatcacaagcagcagcagcagcagcaacaacagcagcagcatcagctcgccgtctgaatgttcaggagttcagaatcaatgagaagttcagagctcttcttttttgtcactggatgtggtgtcaatttgcctttcttttttcttttctttaatcttttttttaccgtgcttggtacataggtgttagttaattgtggttagtgaaagaattgagctttgattagataggtggatcatggttcatggatgggtcagcttcttgggatatttttttcgccattgttcgttcgatggatggatggatcatggataggtggatcagctttgggatcttgccattgtttaagtgatgctaacttgtgcgcatgtgagtcacagcacattgcatgtctcttgtttgcttcctttttttttctctcttttattttcctcttttctgaacattattcgcggcaggggcaagaaaagggtaggagagatatcatgggattgtggcgacaattgggttattggtcagaacatggcatgtttcttcaatgtttggacgaaaatgatcagctcagcatctctcatgaaaatgaaaattttcgattatatatttgatgggcatagaacctgaaaactctgaataaatgcagagagcaactgaaagttgtcagtctgaaatagtagtcagttgatggtactggcataaatgtcactggagtacaattccattaatatggaaagtccactagggcaagaaagaaccaattgtttttgttcgatctaccagaagagaagaagttccattgctttcttcatactccagagctctcctactagtttagttcgcgaaaaaaaaaaattttaggtgtcacatcgaatatttgacaggatgtcagaagaggttttcggacacgaatgaaaagactaatttcataactcgcctggaaaccgcgagacgaaattattaagcctaattaatccggcattaacatatgcgggttactgtagcacttatggctaatcatgtactaattaggcttaaaagattcgtctcgcgatttccatgcaaactatgtaattagtttttttatctatatttaatgctttatgcatgtgtccaaatattcgatatgatgtttttgggaaaaaaaatttagaactaaacaaggccttaacagcaagcaacaaacatgccagagttgcatcaggggttacaggagcagaagtaaatgagtcacaaaaaggaaaagaaaaaaaaagagaggaacacaattaaatgcaatgtcaattcacctcatgtacttgtccaaaagggccaagtagatgagagattctactacaaggagatggagagattctcatggcagcagaggcatcttgggcggtactacctctgttcacaaatataagctattttagaacaatactgagtcaagtatttttaactatgactgccagtaaaataaaataaaaatcaatgacttaagaatgatgttacagcaattagagttaaacaaactatcataatatgcaactctttttatttgaaataattatttttaaaaaatacttccattgatcaaaataacatattggtgaccatgtccaagtccaaaatcgcttatattcatggacggagagagtatatcagacaggtaattaaagggtgccattaccatgaacagtagatgcatcatgtcatatactatctatgcagatgttagtagtggagagcaaggaggaggggtgataagagaagagaagagaacgtggtgtgcatgaggtttgtagggctaaggcagtggttgtggagggcaaacactgcgtgccaacttttgagctgggggtgtaatatataatgcctttggccttaatgctgtgagctggacatgaacatggatggatgccggtcacaagaaattcggcggttgcaaatggtgatctgatgagatgaccagtgatgcagggcgaggtgaggtgaggtgaggcttaattgcagccaagtcagaaaggagaagtagtaaacgattccctctctagtctctatgctcatttgacattccaggtgaaggttatgtgcatcctaagctaatgtgctgtacttagtgatctaagctagtgcacttatactatattgtaactagcttgttcttaattgcggcaataacagcatacacaattttattacagatgtggtttgtattttgtatttttttaaatgaaaaggtcaaaataatttattttgagctattaccttatggtaagaaaattggatttgttagagtgtaatatatttgggggaagatgtgtcggtgggtaaatgtttaagctgatgaagcgtttctattggtagaaaactattatggacaaaattaaatatatgtggtgagaattggcatgtgggtactgaaccatgtgactccagaactgccaaagccaatggtatttgaacctgtgatgtgaagcctagctagctagctagcccatgcaatgtggatcagtggcctaaagaatcacaggagtaaaccatcagggacagtgatgattctttgggcatttgcttttcataaaggcttccatttgctttggttgttcccctgtgaaatggagatggattttggttgggagcttaactttatctatgtactttgatgccaatgcatgtgtgtgcctttaatcattcttgttgagttgctggtacatgtcttctgaattccatggcttccatcctttcttatcttctggaatagtgacaagtgcactaattgtggctcctatgcaatagaagtgaaaacagggatgtcatgagctcaggaccaccacaggggatttactaggggttgaagtatacagtaaaaatagtttcttttcttaacatttgaactcacaatatgaaattgatcgatgcatgatgcatgaaactcaacaatcaatttaacccgtctccagtaaatttgcacaaccttattaggtgcaaattttgtaaggataggcaggtggtaaacattacagaagccccaaaacaatgaagactgtactttttgatgttaaaccctgcagcacagttttcttgcaaagataagttgaccatcaaacaattaatgggaaaatttaaatcatgccacacaaaatttacaaaatttatgatataccaccctgacccacatgtcattaactcatgtgggtcctatacgtcattgagatacgggtggcatatctcaaattttgtaaaattagggtggcatggttccatcaaacccaacattaataccctatttgattaataccctgtctagaaacagtgacctctggcagtctaggatattgcttcctacactagttgtgtacaaccatgactactacagtaccacccagtagatcaccatcagataacatggaagctagaaacacttgcacatgatcgtacccagctcatacggggtgaccagctcagtacaagatgacaaaaggcactctatcattcatacttcggtctaccatgtgtttatttgaagtggacactattactctctatacataagacttcgctctttaaaacttgcgaagtctgggccgttagattaggatccaaagtttcacatatcctcttctctatcaatcgcacatcctcctatccggaggcatgattttgttaaacaggagagttgaacgatgtaattttaaaattttattaaaattcaaatttaatgtttttttctttagaatttgttgtcatgtgtagggcccaagcctaagctgacctacacgttgctccttctcatgctccttctatttctcaaaaatgaaagtgtataattctatatcggacatacaaaattggcattactagaattaccatatgaaatgcttttgcaacagtaaggttctttttttaaaaaaaactaacactaaggtttcttgaaccacagttttccgccttacctccctcgtttagtaaggttgccaaccttagctgttcgttttccacgcgcacgtttcctaaaccgtaacacatgtgagaatgacaagtgggccacagctgaattccaaagcctaaatgttaaggccttgttcaatcgcggcccatccaaatgagccccaaacggcaacacgagtaggcccaggaaaacgtaaaccccggcctgctagtagatctgggcccatagtgccgctcgtgtgaaatcaaacagatctcgtgctcctctcctcctcgtcgccgtctgcctcccaccacttgacaacaacaaagtctctctctcttctctctctcgcctcgacgccccaaaccctagccatggccgacccagccgctgccgccgccgccgccgagttcggggatcccgattcgccgcccgcgccggccgccgaggaggccgaggcggctgcggcggtgggggaggaggcggtcccggcggcggaggccgcggcggcgaagaggtggcccgggtggcccggggacagcgtgttcaggctcgtggtccccgtgctcaaggtcgggagcatcatcgggaggaagggggagctcatcaagcgcctcgtcgaggagaccaaggccaaggtccgcgtcctcgagggccccgtcggcgccaccgagcgcattgtgagtgccccgcgctagttagtttatcgagtgcctatgtagttctttccgttcaatttgtcgagtattttagaagctctaaatttgacattaaattgttggattgtctggtaggtaggatcttttcttagagatgttatttagtgctctgaattagagattttgtgagttagctgcttaggttgggtgtatattcagtaaaaattttgttgattgttttgctttgacttatatatgttagcctatgagttgctgcaattgttaattgcattttttgtcatgtcaaataatagagcagaggtggacaggtggtttatattattcttaaattggttaaaatttcaagccaaatttagagctgatgttgattgcgtgtagtattggtgtgtggtggtggccttattgtaattatgcttgttagggtggtcttatcctgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgttatcctttggattcactaactgaatcaatcccacgcctcttggttataggttcttgtgtctgggaaagaagacccagccttggagcttcctccagctatggatgctctcatgagagtttttaagcgtgtcagtggtataacagatggagctgctgagg

SEQ ID NO: 13326 - DNA, 5147 bp, Oryza sativa
attcctgcagccctactctcgcttgatgcatagcatgttaatacaccattgcctttgtgccaatttgatggttaaaattgctgtgaaagtttgattttacaccagggcttgctgtgcattattctgtgatcctttgtttatactgtttgtatgggtttaaggctttaagcaagtaatagatattttgaagtcttcccctgttagtattaaccatggtcttgatatgcgtattttattcaaagaaagcgtggtagagcactttgcatgtcttcttgcatggaagaacgtatcatgtccattctactcttggtcacagtcagtagaaaatattgtgggaaaagtttcaaattagcacataacattgttgcgtagaaaacccaaaggcttaacttttctagatgtagaaagatatcaagggatcaacaaaaatgaattagtacaattttgtacaaacaaatgcgtgttgatggtattgtacttaaacaccctctaaaattttcaattaccctgaaaagtgacagcaatatataatatcaacttataaatttatgtagatgagcgagagcgacctttctatgtaattgaagatgaaaggatagttgagatccagggggaaacagagaaagtcctaaaagcacttcaagcagtttctaatcatctccggaagtttttggttgaccatagtgtacttccattgtttgagaagactgtaagcacatttatctcatgttttactttacccttcttatcaatcctaatatatgccgtttctgatttgtttctcagaatgctacagtaactcaagatcgcagcactgatgcttggactgatatatcacatccttcaattgtttctgcacaaataaaccaaccacctcctgtggttgatgaatatattcttccaatgaagagagaccctctgtttctcgaacgggaaccattgatagaccacaatattcatcgctcaggtgtttcgctttatgggcgggatcctgccttgtcaacattacgaacctctggaatacatggtggtggacctggtggccctctactttcacaggtatggttgatcttgggtttcacatgcatcttcattttttttttctgatgagctgtttgctggaacaaacatgattcatgtggttctttgattttgaaatctgttgtaatttgagtctcttttgcctttgattatgcatcctatccattaatatatgtttgccagttattatttatcagtacaaatatttatttcctcgtactgtttactgactagaacacgtggcacgcagataactcaaacaatgcaaattccccttacctacgctgaagacataattggagtgaaaggagcaaatattgcatacatacgagctaacagtggtgcagtcgtcacaattcaagagagtttggggagccctgacgatattactgttgaaatgaaggggacatcatcacaagtacaagctgcctatcaactcatccaggtaataccatggcatatatatactccttaaaattttgtattttcaagtttcagccataaaaatctctaatgtcatgtcctcctccctcaggattctctggcggcacatagggattctgtcaggagcagctatgcaggattagatccagtatataggccaagctattcacagtatggcagctcgacctatccgtcgtcgtcattgccatcgtattctagcatggatgggggtggatattcgtcttcaggtctcggtggatatgggtcatcttaccggtactaagcagttagtcgataggcttgttgccgccctgtatccatccctgggccatccttgtactgagccagcaatagatgttttgatggcttttgttcttctcggctgtagtcctgcagaaatcattgtgtcccggcaaatgtttttggtatatctgcttttgttagtgtgacagggcatgtggtttatatctcatcatggaaagatgcccctaatttttcatagtttagttgcattttttgtgattcttatggttgtgtggtctacctgtttgtgttgaaaacggatgagtcaatgcacgtgttatgttcatccaatattttcatgctgtaagcatatgaatgaaaaggaaaaaaaaagtaccgtgaagcataactgaagcataaagtcgctgttacatgtaatactttgatactgtgcccttctacaaaatatatgaaaaagaaatagccgtgacaactagatgatacttcaacaaaatcatttctaccaatacgatcttttacgtacaaagatagcaaaactaagggactttgaatcaaaggatttatataggaattttataggatttaaatcctatagtaaattttactatttggccctttaatttaaaggattgaagctttctaaatcctatgaaattcctatggaatggcacattgcatgtggattttgggggaaatttagcaagagctccaacctcttggaaaattttctttgagtctatctcttatccgattcctgcgtttttcctgcactccaattaaacgatcattcctgtgttttgcaatcctctgttttacacttcaatttctgtcagaatcctatgtttttcctattcctccgttttttctaccttgcgattcaaaggggccctaaagcttcatatttctagatgtacaaagaatgtgagaatatcactgcctaccgacaatattaagttgattggaccttcaaattgatcccgtatcccaatactgttgttgtaacgatgaactaatgaagaacacactaccgagcgtaaccacttcatcgtaccctgaaaatatgggctctgtgaaacaggcttttactgtggattctctggcgttttcagtgatcttccagtgaccaaaaaattagtactcctataattacaaggccacatagatgagccaatcattcaagggccaagcgtacaggacatattgttatccaaattacatctccagcggcacaaataggagtaactgttagcttctaaattgctgcaaaaaaaggcctacgaggaaataaatatgaagattactcttcacttgcatacaatgttgtctgtctgttaaagttgaccagcatgttccacagttccactagcccatcctgtagtgacaagaaaaacagtatatcagtcatatcgaattgttttattgaacataaataccatacttctgagttcaaaacatacggaacagggacgaaaggaaataagctgctgtagctacatgacacacttcaaagtttaggcaattcaactgactactcatctttcagtcatagcaatcctactgtaaaccttgtactcgctgacaaaatcactgaaaaatcctgaccatctggaaaactccgttccctcaccatatacaaacacacaacgggagagggaggagggatggagaaaataaaaggaaaaacacaacaagattcctctgttcagttttttttttcaacaaataacgattcctaccaaagaggaacaattcagctctcctgcaaaagcacattgagagcctcagccgtctttcctgtataacaggaagaggatcttcataatctagaaaacagaaacaaaaatatgtttgcatagacggaaaacaactcgcaaggcaaaacatcactgcaaagaaaacaaacaacttcataagagatatggatgattgtaagggaagtgcatactttctctttctaccaccctgtccacccatgacatttctcatgtcgttctttgggatattggtgccaggggttcctgcaaactgcataggagacattgcagatgcaccagctgctgacataggtggcaaagatgatgatggtgcagcaacaggtggaaccacggtcgacggcactggtgctgctgggggcactgttgctggtgcaggtgcaggtgcaggtgccggagttggttcaggaggagggcggggtaagatgtgcttcaacctattgttcctatagtttttccagaagaaatattgctgcctatgagcaacttcctgcgaataatttgatggaaggaattagtttgtgctactgatgctaataaagcacaacagacaaaacagaattacgaatatgcagtacaatatgaacaaatgatatgcttccaatttgttcagttgccccctaactaattcataaacaaataaaggtgcccattcataagtctgtaagaacaacaataataaagttttagctcatccccattcactaacaatctacagtcaaagtaatacattccaaatacacttaataaaggggaaatctgaaaggatgttataggcggtactataaaaggttgaaatggcacatgtgtactaggaaaaagggtttcaaagggtcaccttgcttgctggatgggccattgcattccggaaattcgcattttggaggagctcaagaaagaaaaggcagtgcggatacctacacaaacaacaaccagtgtgaccaagctattttgtcacagcaagcacctactagcaaacagatctaaattatacggccactcacattatgtatttgatgtactccggacgctgccagtatttgagatacttgagatacccgataaatgcctcatcctcaaagtacctattctgtgctagatctgtttcaacataagaaatattagccaaatgccattttacatacagtattaatttcagtactcatttaacaagtttgattccattaaaaatagcagaagcattgagagtaattgggcataagcaaaacataatccagacatccataccttcctactgatcaacatacacttcaattatgcatccaatctacggtaccagactaccagcaaactaattactctaggcagtgtatcacgcttgctgaccaacacaatcaaattgctgtttatttttccttaactaataccatcaagtcaaagattaaacactaatttgttcaataaacctaatgaaaagatccgcggtaaaaccccaagccaagtgaaacgagaacgaggatacagtacagtacagtggatgtaggtagggtttgcgaggcactggatgaactcgagctccaacaacaaccgctgcctcgcgtcgttggggtcaggcgccggcattgcctccggctccatcacgcagcaagcagggctgcaggaatt

SEQ ID NO: 13327 - DNA, 2850 bp, Oryza sativa
tcccccccccccttggacgaaccctagagcgaggcagcagcagagagggccgcggcggcgggcggcgcggcggcggcggcggcgtactcggcgttcccctttgcactggcgctcaggcggcgagggcaaaagtgaggaccgattagatcagggacaaaatcgtccatgaaaacaaactaagagcaaagataataaaaatggagtaaatttcacgatactacataatactttgataataaaactacatatttaataatgtgtttcataaaactatagatttagtgtcaaatttatcatggaactaatgtattatatcatataactatagatttaacaactattttatcataaagctacatatttacaactttaaataaataatagtgatacgatctaaactctagaacatgtagttctttgataacttcatcactaaatttgaagttttgtgatatggtgcattaaatctgtagtttttgtgaaaagtttgacgctaaatctgtagttttatgatactttgatccaagtgtctacaattttgtgaaacttactataaaaatgagaaaataaggagagaatggcactaaccggaatcattcgtaccgcgggacatttaatttattgctactttaagatgtggcaattaattatttgccactcgctatctataacatgtcagccctcatgtgtctatgacatgtggatctagtgataaataatttagcaccactcgtaagagtggcaaatagttaattattctctgaattaatagatgtgaaatgttgtaagacgttagtgttacatactagtaatttcttcgcatgagaaggggacacgatgaggatgagagaaatacacaatgcttcagcaaatacatgttttttgaaagttaaagtttttccctcgctattattttccaaccttccattgcacacaatttgatagtagaatctcatattgaggaaagatgcttggttgatttagatcacataggcttatctccaactataagggcccctttaaatcgtaggaatgaaaaaacagaggaataggaaaaacacaggattctgacaggaatacaattataaaacagaggattgcaaaacacaggaaaaacacaagaatgatcgtttgattggaccacaggaaaaacgcaggaatcagatgagagagatagactcagaggaaatgttccaagaggttagacctcttgctaactttccttcaaaatgtgcataggattacccatcccataggaattttaaaggatttgataggattcaatcatttgtttcaaaggccttcataggattttttttttcatagaattaaaatcctccaaaattcctacatttttcctacaaatcaaaggggccctaaaaaaagaaggaaaacctagtgcgtaaaaacggatgttaagttcatccttatgtaaacttatgggacgagaaaaaaaaatataatgcggttacactgtatgagctgcaaaattgtatgatggtcttgacactcaaaacgatacaaccgaacaacagctctatccaacgcagctccgaagatccaattactaaacccaatgatatctcatgtggaaaacaggtttaggtaagacaggcttggtgatatgaggcagacctcaagctacatactatatactagataactaaacacatttctttacttatgtataaaatttatagaacaagtccttgtatgtttctgagaaaataattataaccctttatgttataccaatgtattattggtgtattaaataacatgatacatattgatgaaatatgagatattccttgtattttatcttagggacatgttatttatggaacttgatagacatagctcacgttgtcgtgacaaacacctactaaaatacacacagtagtgtgatgaatgataacccctttgaaacgattcaagaatatgctctgctagtttactgttgttaggatcacctccattcgttttgatcaaagggactgtttggtagagccttttagatccaaatccaataaagttgaagttctatcaaatgattgagatccatgcaaaaatggagcagagtgggttggataactcttacaagtcttacaagttgtacttgtggtttagaagttctttaaggaaattaacattgatatatattggttgtaaatttgaaacacatattcatgtcttataatcgtacatcaaaataaacgtaagtaataatcatatttatcctctcatctctttcatgatttctgaagatgatagtagcttgtaagtattggagttggatccccaaaaaaaaaaagtattggagttggatcatgaattaaggatttaggacaattacatatttacaaacacatgctaggatttaagaggttgcttggcaaatgggttaggaaaataatctcacctaccaaaaaaaatatatttttaaatcctagccatccattattccttcctcattgttttcctaaccctttatccattttgctatcccaacagtatcccgcttatctcattattatcccatcacaccctacgactgtcaacgcttccaaatgggccctagctgcacggcgaaaccaaacgcagccacgccggcacggcacgcgcgtgggcgtggtggccgtaggccgtagccgccgcgccgcgcgaataaattagcaggcgagatcggccgccatcgcagattcacgggtcgagacggggcacagaccagacggcgcggctcctccccattcgaaaaagccacgggcgcatcgcaccgcaccgcatccgcgcggcggaaacggaaagcactagccgagagggacgtccacccacccaccaggccaccac

SEQ ID NO: 13328 - DNA, 4321 bp, Oryza sativa
aacctcagagcctccgactgggacgacgtcgccggcgccgtcaccgcccgctgcgggaggttccccacggcgacgcacaagtccggcgtccagtgccgccacaagatcgagaagctccggaagcggtaccgcgccgagagggcgcgcgccgccggccgctccaagggccccaagtggcccttcttcccgctcctccacgacctcgccggcggcggggcgcccgaccctagccccaaccccatcatcaagatcaaatccaagggccccgccgccgcggccgcctccccctcaccggcgtccccttctcccgtctcctccccttcctccgaggaggatgaggaggaggaggcggcggcggacgcggggcggagcaggagccttcacggcctcatctccaacggcgggagcgggagcggcctgcgcttcaccatccccaaggcctcccgctccaagcctgtggcgcagcgagaacaacccaccgccatcaaggtggagaagagcgaggaggacgccgaggcggaggccatggccgaggtggcctcggcgctgcgcgccgtcggcgacaagttcctccgcatggaggagcggaggctggagatctctctccagatagagaaggagcggatggagtctgagatgaagcgcacccagacgctgctcgacgcccagcagctgttcgtcgaggccttcctcggcaagcagcagcaccaccaccaccaccacaagaaggccaaggtgatctccgccgccgctgccgcagcaacagccgccatggatgaggattgatctactccatgttgttggtatggcctactatgtgtttagtaatgtttacttctcattgttaactgctggtgttgacttgtgataattctactagctgttgtttgtgtttgggagggtgattaaagtagtcaggtgtaggatatggagtgggggagtgaggaggaggattaggagtgagtgctcagttaagctgcctgtaatcagttcagtgatcttgtgcttgagttgctgctgctgaagctgccttgtccaaatacttctgtagtagcatattattgtcaggtttttactcaatcagtgtcctgtgtcatgttctatgttttgatgatcctaagccttggagtatgtgacagtaacttgaagaagccttgcactgtagtaacatgtttttctccatgaatcaaattaatggctggtttaagggtactatgatagcttatcagttgtcatggacatctggacagctgaaaacaacactctggatgcatcaaagagggtatagcgaaatgtgccggtttcttcgcgcttcttgctcttttgcactcagaacaagactgaagagtatcctgcacttaagcttctaatttattcttttgttagtcaagtcttcttgaaaacaaaaaggaacttcgactagccttctgtcaaagttaaatacaaaacgaagcagaagagagtgctgacatcggtcctattattttaattgttcaaatgaaataaagaatgacaacaatctagtaggactatgtttcattaagccaacgaaattctgaggtaaggcaatgtttcattaagctgttttatttatatgctttccaactaataaatggtgtccttttgtgcgaaatcaaataaatctgtttttcaagtttaatatgtatgttttgggaccgaagtaatgagcctgatcggcacacaaatgcccgcattcagcatggggtcatagtgcgtgtggtaatgacagatctgcaagtgaattcctcagttcgcactgcaaatgtactcagacactaatggtcagttcaccaaaccatatgagcagagcaatcgtagtaaaggccaaaaacggagtcctcactagtgaaactcaatgcttgctcgtacctatggaaaatgaaggcactcatgagatgtccagaattcagccgttgtaatgatggggcaccgtctggttttcatatattataaaggatgattgtcaatatatttttactggaaactggattatccctagatacaatttgccatgtcaccatgattatacaaagggtctgatgtagacaaaccatctgtgttgaatcaggaccagacaaaagagcgcgcacgtcctgtcagtagtttggaaaataaacattccagttcttaagaaaaaaccactaacaaagtgcaaattttttcgctgaaaactaattgcaaaaggtctagcacttgataatagacgcagacttgcaacgtatcaacgtataattgttcaaacttgcatattagatatacatgcggcactccaatgaggctccaaaatcagcttcaaatttaaggttgaaaattcaaattttggccgataagtataagcataaaaaaaaaaaaaagatgccagaggccttttattattcatacattgatcatgtggtcagtttggttgtctcagaagtaagaatacatggacctgtggagagatgtgttacgaatttatgatccatttttcttcaagaaaccttgatataagatcgtcccaggtgtggaacaaatagaaatgagcattacaaaaatgataaagcaatcacacagtgcacaaccttcatcgagttaactcattcccgctgtggcacaacgaacattctgcaaaacaatatctcgaaagacagcttgacacacaactcacaaatcacagcgcaaacagaacatgtagagtaaaccagaataacagaacagcatccagccttgtaaacaaataaacagaaagaaaaacaaggaatgaagtccagcgccagccaatcaacttgctacctctgagcacaagattggcatcagttctatcaggccccgaaggcttcttttgtgatgcaagaaatcacatcttccatgttcttttgtgatgcaagaaatcacatcttccatgttcttttgtgatgcaagaaatcgcatcctacataacatgattgactgccaatatgataatgtagtaatgcgatgggaaaaaatgatacgatgagaattacttcctccgtttcacaatgtaagtcattctagcatttcccacattcatattaatgttgtctagattcattatcatcaatatgaatgtgaaaaatgctagaatgacttacattgtgaaacagatggagtaaagtttatctgacagtctgaccacccaggggtgcgactactaatcgaggcagctttgttcgaaatcaacctatcataagctcctctatggcgtacagtaagtttcaagacattttcaaaatcaagcaagatgtgccaaggtagttgttgccaaatatcaagcattgctccagcttacacaacaagcagcaatgagtatttataaatttggcccctcaaaaactacacaccagccaaaagctacataaaccataagatattggaatatcacctaacttcaagtgtctcgccatcaaagtcaaaacggagctaaggtcaatgacatatcccataacatatctcaatcttcaaacttatttaaaccagaatattagtggtgcaaaaaaaatagtaagcagcattcccacactagctgagcaaaatttccagacctaccagtgaagtgtatgtaagcatgaggcactgaattaggacatcctaattatacttattttttgtgagtagaacaccatgtggtactatctcagatttctacaaggatcatagggtaggcaaccattggttggaacaactaaaagaatgaaaacattacttatgaatgtcctattgcattcctttattcaaatccaacaatgtatacacataatcagctatccgcctgaaccttaatactagaagcatcacataatccatccatccagacaggctcatcttgcacaccttggcaccaacaaagcaatgagccaatcactaataaaacactaatcagggaatttagcgcaagcaatcgacatcaaattcaaactataactaagacaagaaaatgaaccataaccagtgaaaaattgacacagaacgtctcccaatatgcttctttaatagatccatactactaaacatccacacccacacaagcaggcagtagtaccattacatcagggtgattgagattaatttagaaaatccaaaaccattcattggctgctactcagaaagcgaaaagctttagaaaaagagaaaaaggatgagatggccgtgcaccagtaccatcccatcgccgccgccgccgccgcaggagagagctcagaagcggagcttggtgaagaaccacctgttcttgccggtcttgaagcggtcctcgaggcgcgccttggcggacttgcaggcggcgaccttcttgtccctggtg

SEQ ID NO: 13329 - DNA, 23253 bp, Oryza sativa
ggtgtagcgggtgggcatgaggtgggtgaagttgacgagcttgaggaagcacttgacgcgcgacttcttcgccgtcttcttcgccgagtccttgcggatcaccttcttggggtacttggcgaggccggcgacgaggcagtggccgtaggggcggtcgcgggtgccctcctcgaacacccgcacgatcaccgccttccgccccgcgaacctcccctgcagcaggatcaccgccttcccgggcttgagaaacttcaccatggctgatatcctctgctgcgccgccgccggggaagatggagttagggttcggggagaggagaggctttttttaagctcttttatagtcgggttgcggagaggatggtttagggtttggggtggggatagaatgacgtgtttacccctaggatgcggtccgttagatgcgaatcgggcgggtttaattgatgggtagtggtggtggggccaatgtgtcagtggtaagataggtgggcgagcgtaggggcaaaatgggaagagtgggagctgggctgagatgggctttgcgctcgtgagtgccatgtaggcccagttatcagacggccggcacagcatctggcccacgtcgagacttaatgtacagaggatcacaggaattttgcatgatgttcagagatgtttttttgttttctgaatgttcttaggttttttagacttcagaacaaggcttaagataatgcatgcggcacatacaccatttagctcctaattattcttttgatagtcaagtcgtcttattgaagaaaagaaacttcgacaaagttaactactagtgaagaaatgaagcagaagagagtactgacgtcgccacgccggctctattttttttattattcaaagggaaaaaaaaagaatgaactactccaagctagatactatctcttcttgtagggccaaaattccgagctagatatcttaagctaccgccctgtacaccaacctattccaagccctgtctcgtttcttccttagcctgtcagcaatggcgaaagccagttcaagcgactgcgatgcattcagcctggggtcgcagtgcgtgcggtagcgagagctgagatcatcaagggtcaccgtcttggatccaccaatgcactctgtaacgttctgccctgtcatctccaggtgaatccctccagggtagcttccctcttgctcatggacatcgaagaaagccctcagctcgcactgcacatgtacaagaataaacacaaatggtgtcaatatgtcaaatattcatgtgtaataagtcagttgttcatcaaaccatgaatggtgaagtctcagggcttgttcagattgatgtcattttaaaccatacaattttttttactaaagttgtcaaatatgtacatccatttagtttcttgccaaactctagtaaataaataagaaaccatgctaaaacttggcaatattgtcaaattgccaaaattttggcaatgccaaaagttggtaaggtttatttttactacaatctgaacatgccctcagttcttaccctgatcgcgtcgaatgatcttgtcttgagaccacatggtgcgctgatggtgttcccatgcatgggatcactgacccaagtgacaatcaacccagcttggcggactgctctgatcatatgtgggagcttaacgcgcgtgttctcagcacccattcttgtgatgattgtcagtcttccgggcttgttgtgaggattcaaaatctcacacaatttaacaagctctgaaggttcgagcttgtcactcacctttttaacacagaaaaaattaactatgtgcatagacaactcgttttgtataacaaataacaataaccataaagtcatggctactgtacttatatttgcgatggcatggtaaacatgatatacaatgttttttttctggcggtctttcaaaaaataaatattttccccgacaaattagcatttacatctaaggctaaacagcataagaccgatgactgatgatgaactatggtactactagtaaatattgttacttgtcatttgagatggagcttaagtacctctagtagtccaatgctgatacatagtttgagagtttcagtagatatattacatattgaagatattggctgaaagtcttatacaaataagccaactttgaagaggtggattggttacctttacacctagagggttggaaataccacgaaggaattcaacatgagcaccatccagttgtcgagtcctctccccaacccaaagcatatgagcagagcaatcgtagtaaagcccagaaatggagtccaccctagtcaatgcttgctcatatggcaaatgaaggcactcatgagatgtccagaattcagccgtcgtcatgatgggatgctgaggagtcagaccagcagcaaccataaatccgatggcatcgtgaaccctctcggacagctccatatacctgctcacagaaaaaaacaaaagaggacatgatcttggtttccattgtataaaggattattatcaatgatacttactagaaatccctagctactatttgccacgtcaccatgattatattaagggtctgatgcgtacatgccatctgtactaaataatgcaattcctatgtctgttgtttggaaaataaacatttgcattcatatgaaacaaccactaatatgcgtaaagagttttgaataaaactaattgcaaaatgtctagcacttgagctaagctaacaactacctgtccccttgcgtgctgtccctcaagaagtcaagattccactgggtgactctctgcagatctgcataccctccatgagcaaatcctctcagaagattcagggtgctcgcggactggctgtaggctctaattaacctttcaggatctggtgcacgcgacttctcatcaaaaccatcgctgttaataatatcacctcgataggaaggaagtgtcactccatctatagtctcagttgggtttgatcttggctttgcaaattggccagccatccttccaacctgaaatatacattgtcaatcagtcaatctctccacctgtctatcagcacttgaatcattaaatgttaagccatcaatggtttgaagaacataaacctcaaaaagaaaactgcaaatacacttttgtttgtcaatctagattccagaatagactaagatactgaatctagcttgtcttttaaacaatatgaatgcttatggtttcatgtgtgcactggtggccacgtctgatccctgtctttcttgctgctgtaccttgtctgtcaaatattggggatggaaattggcgattgacttgttgatccgttaacttaagactcatagcatatataactgctaacaatcaaccatctatgcgactatgcctttcagggggaaaaaacagaaaactgaatggatgaatccgcgctgtgccataatttataaattataaagcctgatctttcagaacttgacagcgaagtcgacacgattatgtctacatcgaccgatcgccatctcaaagagagattgtgaagatgacagctgggaccctgcaacagcttaagcccgagtgatcagccacatcacatatattcgttctatctgaatgcgccaaaatcccaaacagtgcagcgtgtggcggacaggaaacagataattttcgatctcgaattccaatcgggtataaaatggaggaagtggattttgatctcttgaggagatatctcctcgttgcttgcttgcatgttactcaaatggttatgaaaaaatttgagaagatgtattaacgtgtgtaatatatcactccacaaattcaaattcagcttctatatctggcaacaaaattaattgtgaatatatgttaactagctgcggttctacatctcgcaacaaaattaattgtgaatatacgtaaactagctgcggtttaattaatttaatttttttacgagatcgttagggatggattggagaaggagaaatggtgagaagatgaagccatgggagtaggcgaggaggaccttgatggtgggcatctggccgccaaaggtgaggacgacggccatctggagcatgaggcgaaaggtgtcgcggatgttgttggcggcgaactctttgaagctctcggcgcagtcgccgccctgcaggaggaaggcccgccccatggcggcgtccccgagccgctcctccagcttccgcgcctccccggcgaacaccagcggcgggaacgacgccagctcgcgctccgcgccctccagcgccgccgcgtccgggtactccgggatttgcctcgccggccgcgccctccagctgcccggctcccacccgctcgtcgccgccgccgccgcgcgcaccgtgatcatcccccgccgccgccgccgacggccggtggaccgggcgtcctcgagacgcgtggtggcatggacgatcgccgcgtgcccaacggtgagagccgccatggcagagtgacacgtcatcgagtggatccgcagccggaggcaaatcactgggtatttatatgtagagccgccgtataatactccagtcactacgtataatagtcacaatttttttagactaaccaaaacgaagcaactacaaatcggccgcatgaaaaatgcagaagttgtttcatcactagacttaaaaaagtgttttaaacaattacaatatcgtctaaatttacttgaaacatttttcaatcatgcggtaaacaacaaagatacattgattgaaacattaaaaaaaatcgtgaaaatctacatgtttcaaacaaatgcaacaccattttaccccaagttgaaatatttttctagcacgtatgaaacatcaaaaatccaaaaatataccggtctagatctagcttccgcctcttaggtggtcgaatctttagcttcttctgagccgaccaaaattcgaacaaaaacatctccatggaaaagataatgggaactaaaaacccgattagtacaccaacatataatagtcacaatggtgtacacacactgaagttgtactgtacgtctatacaataaccattttatgaacatggtacaaatatgtatacgttcataagtaacaacgcacatactcatctccatatgcatacacacacattatctatagcatatccgaataactggataacgaaaccgacaaatctcgctgtttctaattgagctacactcacctcactacggtaacctcaaagctttagggcctttttaaatcacagtaatgaaaaaacggaggaatatgaaaaacataggattctgacaggaatgaaagtgtaaaacaaaggattgcaaaacgcaggaaaaagaatgaccgtttgattggaccacaggaaaaacacagaaatttgaggagagataaaagactcaaaggatttcttccatgagattctatctcttgttaaaattcctctaaaacttgtatggaaagaggcatttcataggaatttcatagggttcattcctttaattcaaaatgctttgtaggaaaaatttctataggaataaaatcctctaaaattcctatgaatttcctttcaatcaaagggggccttaaagttttatttgattagaatattgaacagattatcgttttgattatagagagaataaattatttaagaaataaatttaacaaatatcttaaaatagaaaaatattttgagaagcgcaaataatatgtttaaataatccaaagacaaggaagtgtagcacaaataatccaattacataattcaatgaataaactgggaaaatgaccatgcaaactgaatagtccttgccaaatgatcacacgaaactgcaaacaaataattattttttttctttattatttacgctgcaggaaaatccggtgcagagtatacacggcagaaaatgcatcagaatacgcatatcatttggtctggcgatcacgtatattccggatcatatttacagctgcagcacaacgaccatggatgcatatggatcatggatggtcagtaggtgtcatactcatcggcggcctcctcttcgtcgtcgctcttcagctcggcgagctccgcgagcagcgccgggtcggcggcggccatgtcgccggggaccttggcctcctggatgatccgcatgatctcctcgacggcctgcgtcggaggggcggcgtccgtgtccttgtagtcggccttctccctctccgatatctcctttggcagattcttcagaaaccacgtgtgcttctttatctcagggatcgtgatcctctgaacatcaaaagttcagggatgcaaaaactcgagttagttaaattcagagggaatccatctcgttaattaattagagacatagtttgagcattagaacatataattgagatcatataggccgcattacaatgagtaagattacaggtagaatctgagtatgatttaaggttaattttcccttcggagtaatctaaagtttggtctagtttggcaacttgggatctcacttaaactgggaggtaaagtgtgtgaaattaagtacctttgaaggatcggcaacaaatatttgagatagaaggcgcctgcagtcggaagacaccctcacgtagtccgggatggagtattgcacgccaagaattctctgtcaagtggaacaaggcatgcatattcagagtttcagactcaccattgaagcaaggtgtagaaaaggcttggatgatgaacagagggaaatggagcacttacgctgatcgttttgcggaaattcctcggatcacctggatcttcaaacgggtatgaaccgacaagcatcacgtacagtgtcacaccacaggaccaaacgtctgctacctgggtaaggagacgcattacctcagatcatgcagagatgcaattctatgatgcgatgttccaggaacttcagtagcgtcctaacattactgaaaacgtaaagcttatgctgttcggtttgttttgcactcaatgtaagtatttcagctgcaatggatcacttttagctaacgtctaaatgctcaattgctacggttccatgatgctagaaaagaaaaaacaatagtgatagatactgctatctatctttactttacagccaaattcagattgcaaaacatagaaatgagaaataacttgccttgccatcatattcttttcttgaaagaacttctggcgctatgtatgctggagtaccaactgtagacttcggcttcgaatgcagcaaagcagactgaaaatcaaagaagccaagttgttcagtactccagtttgattctaccaagaaggcaagaacaattcaatctatttctagtaaagtactctgagatgtagaacagaactagtagcatccatgttagcacctttgagtaaccaaagtcacaaatcttcacacgaggtgttgggcttccatccaggagggtgttctcaagtttaagatcacggtggcaaatttcctgcattttgcagaagcagttaatgaccacttaacttaatgagcttacgatgtgcctgttacgtctgcagaatttcaacaagcaaaacataccagagaatgacagtagctgacacctgatattagctgctggaagaagtaccttgcctattgacatgaatcaattattgagcacagatggtttgcaaaacgggaagattagctcacaagaagacaagtagggcctgaaagcaacctcgtcttcgctgaatcgccctgcggtgcagatttgttcaaagagttctccaccagcagcatactccatgacaatggctaggtgtgtgggtgtcaaacaaacctgctcttgatcgacacacaaaacaagaaatcgttatagcagttgaatttacttcgatcttaagacgatacactacttactaattgtatggtaagtaatcagccagggtaagctttgtgcttgatagatgtataaacccaaaaccttatcattttactttctacagtagcagtggagatcagctccatctagtttgactgtttgactgactgataatcagtgaagctgccgaacgaactgatgagtgaaaagaaaatctgaattacctccttaaaccgaatgatattgggatgccggagcgacctatgattgatgatctccctctgcacattttcatcaatctgcacacagagcaaaccaaccatccatgcatcatcaatcaatcaaactaaaagctaagactcgtcatgcatctggaacaacgagttgctgaaaacatcaactcgcacacaccatcaaattatcaatcagtccgacgcaagaaactgcgaaataaatcacaaaaggagagaagagaagacagagacagaggcagcatcagaccttcttgcccctctcgatgtacttgacggcgacgagctccttgctcctcttgtccctgaccagcctggccaccccgaagttgccggccccgagctccttcaacgcctcgtacctctcctccattggccccctcgaaacccaaacccaaagaggagaagtcgccgcggttcgagaccgaagccgaccacccaaccaacccaatcagaggcgagctaacctccaaccaaaccagaccaaatccgaagaagggaggcggcgaggtggagggatatgaaattctcttcgtcgccgtcaccggaaagcgacgagggtctcttggtcggacttgaagccgaagcgaagcagcgacggcgacggcgaggtgcgcgacacgtggcccccacgagtgccgtcgcttgtcacgtgggccccacgcgtcagctcagctaatcggcgggcggggtaggagtggggcccgtggattaggtggcgtgtcctgtgaatacgacgtggccgtttcgtcgctccgggttgccacgtggctccatgtacgtattatatggaggcccacgctcagaagagggcggtgtccagaaacatggagctgggcttttcttttccaaagatgctgggccggttttctaaagtgcaaaccatgggctgcacgataaattaattgattaatcagttttagctagtaatcgttagcaaagacgttggttaacttggttttcttgctagtttcgtagggatttcaaatggttatgagcagtcgttcaaaaaaaaaagatgattatgagccaagcaaaccatgggactactatcaattcgaagcatccgctcgagaatcttccatcgaagatttggaacaatgttgaatttcttcgatgtgacataaacaatctgcctggtcgtggttcactactgtggtagtagtactattagattactctaattattgcgcgtggctgaggtaaaccatgacacattagtgctggaattgttgcatgtgaccgagaggtaagattagcgcaagttggcttgcaatttctttgcgaaatcgtatgatctgctaatattccgtgtggctctgccccttctcgctgattggagttgcgcttagccgtcgtaatagtcattttctttttcttggtttttttttgtcttttcttctttttcttggcataagccagtctgtctgattgcgttatgtaaacaaatatttttttttaatatattgacttaattgttttgcgcgttcggaaaaaaaaatctgcgaatattcccagctgaccaaaatgggaatggacgacgacgacgaggtcctcccttcttcgcttcttccaatccatgggccgcaagtccgcaagggccgcgcgcacgtgggcgcggtgcgggtcttctttcccaaaagaagtcgggggaaagcgaggcgcaacggactcggggcccacctatcgcgtaggtagtaggactaggaggaggcatagcccgtctcgtctcgacacccctccgaccccgacgcgtcgcgcaccaaacccccccgcccccaaccccgacctcctcccgtgctccgcgctccgatccgccgccgccgccgcgcgcgcgccgccgggggagtgcgccggcgtgtggtggtgggtgtgtaagggtaggtggaggggtgggtgatgcgagatcggccgcggcggcggtagagggggtgtgtgtgctcggctactccggtgggtcgggtctgggcggggtgcgcgtggggatggggtgcttccagtcgacggcgaggcgtccgcgcccggggtacgaggaccccgtcggcctcgcctccgagaccgcctgtgagttgttgttgctgtacttgccacttgaggagtactctacagtactgtatttcatttcatttcatcaagtagttcatctgatttatgcaatcgatgggggtactggaaattctgagttagttgtttgggatgtgtagttagcgtaagtgagggggaggctttgttcgagctgttcaagaccattagtggttctgtgatcgacgatgggctcatcaataaggtgaacatctaactgtttcttgggggtatctcaccatattggcatcatggcatgtgtgattatgagcatcctgatacatttactaatctgcttttatagcttgttgtggaattacaaaattagaccttgccgcattcgaatatatctactgttccgtctttcatcaccatattggcatcatgtcatgtgtgattatgagcatcctgatacatttactatctgcttttgtagcttgttgtggaatgacaaaattaaaccttgccacatttgaatatatctccatgtactgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccgactcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttttgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttttggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacaattgcaacgtaaccagcatgtaattacaatataactagggtgtaagtggtatgtaaatacaccatagctcagtggggaagtgcgcacgcatgatatccttgcgcctggggttcgatacccagcagctacagcatgcggaattttttcccccttcctagcacgaatctcagagcacatcgtacgaccccaaaactgacagatttgtccaaaaaaatatgtcgaaagttattttgcgattccgatgaaattattataattaatacctgacatcattttgctatgcaggaagagttccaacttgcattgtttaaaaacaaaaggaaggaaaatcttttcgctaatcgggtatccatctccttatcaaccattctcacttaggttctgttagtaaatattctgagtgctttcaggcacaaccttattctatcacttgaaatttacacagaatggaccttgcagatatttgacctttttgatgtgaagaaaaggggggtcatcgactttggtgactttgttcgagctttaaatgtatttcatccaaacatcccaatggaagagaaaattgattgtaagttattgccattctgttttatctcaacttcgttgataccataatttcacttcctaaatgattgaccccttggacagtttccttcaagctatatgatatggacaacactgggtttattgaacgaaaggaggtaatgtcttactatttctgggcctatgattctgcatatgccaactgttttctgattcggaatttaataaaatggttatgccaaagatatgtattggtggtaatccagtggtttgtaagcaaacttctttacctctgaagtaacatatttacgacatgctttaacatacatcctattgttcgttggtaactaaaatttctattcttattctcttgtacaggtaaaacagatgttgattgctcttctaggtgaatcagaaatgagattatctgatgagattattgagacaatccttgacaaggtttggacatttgattaaaaaaatgtagttaaaatgtacgtaattctggtgtcttatgacagagttaagacttacaatgacttatgtggttaatggcagacgttttcagatgctgatactaatcaggatgggagaatagatagaacagagtgggagaattttgtctcaaggaatccctctttattgaagataatgactcttccgtacctcaagtgagtataacagagaatagaaatatggacacattttactgctactatgtttatcttccatgctctaagaaattagtggtgctgttccaatttccaaagcttaggcctatgccatctaagaaaagataagatagactgaacttttgtaagctacgacactcacacctcaagtgagtattgcagagaatacttatatggaagcggtttactgctactatctttatctcccatattcaaagaagttaatggtgtcattctaatttccaaagcttgactgaggtctgtgccatctaagataagatagacaaatgaactttcgcgatctatgactctttcgttcctcaagcgagtatgacagaaaatagaaatatgtatgtgttttactgctgctatgtttatctccaatactatagaaattattggtgccactccgattaccaaagactttagcctatgctagctaaaaaaagataagatagacaaagaactttcacaatctaggcatgtgtggaattagaggagggttgggtggggcgtaaattgggtaaggtatgcataattcatcaacttctaaatgtgactcatgttaaatagtgctatatagttgccatgagacatttatttatcgcagtaataaattgtttgacctatatttctatttcagtcatctaaaacttgcaaaaagagatcaactatgtaaatctctgtagatatttggtttcagtgtggtagattgctagactacttacaaacattcttgcactttccatgaacatttgacatgctgcagataacatcatttctaaacattgttgcttgcatttttcagggacataacaaccacatttcccagttttgtattcaattctgaggttgatgatctcgtcacatgatcgtgtttctgttaccggtgtacagttaacaaaaacaaaaggagttgatttatgagtgaaagaggcagaacattcgcaggtgctattatcatacaaggaatataattgcgcagcagcttggaagcgtataacttcattgatgatgtcgtcgcacaggatattagcgttgttgttttagtgttgttgattagattcggaatgtaacatttgtatgtttgggtttgcagttttcaggtctttgccaactataacatcttatccttgtccccgtagagatatacagtatttacctagttttccaaacatgagtggaaaatcttctgtctatctggaaccaccctttgtgttgttctgtatagtactgtctcttttttgttttaaccatgatgatggcttctcgtagagtgttgcggaaagttaaaaaagggggaaaaggtaaaaaaaatgcatggtagttgggctttcttggcccatgaagcaaagtatgtgggcctaacctgagcccagcaggagcagccgacaccgaccgggaggaaatcccgaaaacacccccggcctccacgacagaaagaggcggggttaaaaatatctgcgccgagttggggcgtcatttttgcgggaaacccccgggctcttttcgtaattacagcggccgcccacccacctcacgcacgcacacgggctccctctctcgctctcgctgtcctcctcttccccgcctcgtcaccactccgatctcttcacctcgatcctgcgccaaaccctagccccgcccgcgagcgccgccctcgccggctcgccctcagggggttgcgagagagcggaggctgtggcaggggcgcgccgccgtaggtagggtatgagcggcgcgtacagggatcgggggttcggcggcgcggcggcggagatggaccggaagcgcatcaaggacgtgctcgagaagcacctggacaggtcgtccccgtccacatccaggggggcggcggtggccaaggagagggaccgcctcgccgccgcaggggggaagctgcccgcgccgctcggcaaggccgggaaggtctccgatggtggtaaggatctggtggtttgtttgttccgcgcgaggggttgtgtgctgtttgttttgacggtggttggggttggtggcgtctggtgctacattgcctcaggtctttgcctgctttggttagatgatgatgcagcttctgtttgtttctcgggtagaatcttagggtgaaatttggtgcgctgtcgtgataacgtaggcttctgtatactttctccgatggatgaaatgggatgtaagagtctggatgttcaccgcattaactggagctgaagtaagcgaagttctacatttctgtttgaacttcacgtgaataccatcccacgtactgcattaattgatgttatgacttaaatatgttcacgaaacatcggttagttctaaacaatgttttaaaaagcggtatgtagttttgtgcggtcaccccatattgtagcacttatgcggcatagtcagacgcttatgcggtataatcgaccacttgtacggctaagcggtacaaggttggggcacctgttccttgtatgtggcgaccttctttttagatgctggttctagaagcagtaacaattactaaataaataaacgtgcactggaagtttatgagaagccggtcaaagtagggtcttaatgcagtcaaagcatgcaatggtgaaagaatcagatgacagaagctacaataaacgtaggcaagtatgggttagggcaccttatgatatagaattcttaggcaagttggtttttgcgaggcattagggtaactggccacatggaatggaattttggactggtagttattctaccatggcagtggctgtttaattaggtatgcatgagacacaattagagcaatgtatttttgttgcagtggcaattaatgcgatgagttaaagaggtagcgaagagtttgagacgcgtgaatgccattttgcatacagtcgtcttaacaggataatattgaatttatcgaatgtttagcagccccctttatatgttgatgtactgtaacataggactgaactggcaacggcatccatatgtagccctaacaaatctcagaagagaaaactaacatgtccaattgaaggaccttctatatgagatgacccaatgtcttgaatagtttcagtcatattgtattgtttgtttgtctttggggccagtggagatctgaagaatttctctatctgtgagactaacatgatattgaaggcaaagagcaattgctaaaagcattaacatgatgtcatgatgttatattagtgccttgataggttactgctttatgaggaactcgtttggcatgaaaaatcctccatttgcttccttactttattggtttttgtctctgtagaacatttattttgctttcagatgtcaattactctattggaattttgggcatgtcattagctgtaatatatacagtgttgaaataactttcagctgtgtagtgacaaatgataaaaactcgacccaaggggagagacatcccgaaggcattacacttaaggtcgaagaaaaggccctgaaagccggctcttgcttgtacaagggctccattgccacaagccgtatcttaacccatactttagggaccacacaccgagggtccttttgtttgtgagaaccagggttgaaaccctggttgacaacttcacaactggaggacttgctgccgtgctataagcatgttctcaaaaacttgaccaacctagggggaactaggtgccttttttatttaagaagaaataggcacctgaattcgcttcgatgaggacttgaacttgggcggtctgggcatcaatgtcctcgaccaactgataatgtctttatacatttcacagctcatgttgaaccaaaaaaggggcataattgcaagcttacagttatatctgtagccagtgggcagcggtaattaattgtagtttttgagtgatcagtttccataataagaaccgggaggaaccaaatgtgatggcatagcacttggggagttggggtataggcagcattgattgatctcaactcttttgtttccatttgtgtcatacattccagtttgaccgatgtttgcacgtgtagagccgtcatgatctgatcacacaggaagactctctttttgtttgaattgaaaagggaactattccagtgcctccactgatgactcactgaacatgctgcttcactttgaccattttgtttgtcaatttcgcttgatatgcaaccagggcggtaacacacctattgtgtggttgatgtgaacagaaactggtacatcataatagcaccaaaagaagaggatagattgcacaatagataagtagagcaccagcaagcagaagattgaacctaggactagcatcttagtactccaacaacaccttctttaatgagttatgaaggagggggtaggaggttactttgacttggaaaccatagaaactcttggggatgttatatcaaactacactgaacttagttttacagtgatatgaatgtttgtgcagtgatatgaatgtttctttaatttctctgtgcatcgatatgaatgtttgtggtttttcaatctgtaagaaaactgcttgcttttattatacacttgaaattcataatattgtttggcagggtattacttgtgactattgctttactgcagtaactgcaattattaatatgtaattttttaatcatcattaggtgcctctaatcccttttttcttttgggtgcagcagaagaatttgaaactgacagtgaagattcagatgtcagtggttctgagggagaggacacatcttggatttcatggttctgcagtttgcgcggcaatgagttcttctgtgagatcgatgatgattatatacaggatgatttcaacctttgtggtctgagcaatcaggtgccatattatgactatgcacttgatcttatcttagacatcgagtcttctaatggtgagattatttttctct

SEQ ID NO: 13330 - DNA, 8367 bp, Oryza sativa
  unsure (1)..(8367): unsure at all n locations
attcctgcagcccagcaagggtctggctgcaatggtaatctgctagcagtttgaccatatttgataggctatgcttgcttccttgactacttgaatactaaattattctgcttttgccttctgcagttggagaagttcaagaactatgactttggaagatgcccccgggtatactgttgtggccaaccctgtcttcctgcagggcaatcagatattcctaggtctagcacagtgaagatatactgtccaaaatgtgaagatttacattatccaagatccaagtaccaaggcagtatccttttgattgtttgtcttagatgtgttttatatgaactgctttttttcttaataaattgtactcatatatggagttaaaaacgaggtgatatctgatagggcataaattagaaattgtgatttcctaagcagaatcagacttattattcgcaacagctaaagcaaagcacaacacgaacataggcagaattatgaatacatgacccatttgtgctgctctctaaaacacatcctttaaaaaatcaaactactgagtttttatgccacctgtaatggatttcaccactctcagtttctccaagttataggttggtttttaggcagcacttgaaaaggggctctgtgtagaggattctcattcaaacatggttttcctttattttttttatgcgactcatacaatttgattagatttgtttggaacataaccatgggtaaacaaacattgattttgtgctatcatgaatattgtgttactatttttcttgcacttgtatctcctttactttgctaagacattgacggagcgtactttgggacaacattcccacatctcttcctgatgacatatccacacttgaagccacaaaagccatctcagcagtatgttccaaaagtttttggcttcaaacttcacaagcagtcatgacaaacttgtacggtaagctgctgcttgtttttacctagtttttagggagagaacattgtggcccgaaattattgcggtctgttgatgtgagaacatgtgagcttgaatctcgctgtaattgccgagcaactgtatctgtttttgtactgttaattctgtgatcctaggttgtctcactgtatcaaattatgttaatccgcatgcttttcgggttatattatatggattttccccccagacttcggactttactctcactgggtaacatcgtgacactagtaagcaaaaaattattcggtatttgcttaatgattgatcgcttcttgggttgcttcttcttgcaaccttttttttctcaaagttttgtctactgggcattcttttattcatccagtatattttcataaccatggcatctacatttgtctactatttgttcccgtgccttttgtttcacacgtgttgccatcaacttgttcttcgatttttctgggttattattaccaccttagttttagtcatactgctatatggtgccttcttttgttagcactggaatatactgtaactaaaatattctgattcctgacaccctgaaagcttgaatattaatcattaatcattaaacacacgtaggatcatgtcgttgttgtggtcatgtggataagcatgccgatctgaatcgacttatcagcatctcgcggcgtttttccccccctgcgtctctgtcgagccgacgacgagattacacatttcatgcgtgcatacatgcgccatgtcctttgttttgacgtggtgacgctcccagtatggcagtgtgcaccgaattttcacccaaattgtctgtagattatttagatcgcggtcagcaacacaatcatttgagagtgagagaatgcccaagaatatccttgggaagaacatgtggatatttgtatgatacaattcgatcagttttctgcgaaattttattgtgccttgtagaactttgaaagacctttttttggaattgaacaaggtctagatcaaaatgatgaggatcaactacttgggaaaagtggtcaaggacccacttttctagggtctaattctaactctggccattagtccttggttttccttgttgctgcacagagagagagagagagagagagagagagagagagagagagattagacagacagatccaaggtaagcagagccgcaagcgaagcacacggaaataggaggggaggcggctgcttgcaacttgtagctgcctgtcgtcgtcctcgtctacttccgatccttgtgctggtcctctccgcacaccactcttcatgcactgcttatgtatctataaaccacaagcaaaaagaaaaaaaaagttctaacaatactttgttagctgctgagtgccattattagagtgttaaaacatactattactaactgtggaatggtgggcgcccaagattgctagtgtgtgccttatcctcttggtcgttccttttgattataaaaaaaatgtacatatttcaggactgttcgatatgttgccaaaatcaaccttgttaaaacgccaaattttgatatatgttgacgttacatttttttttgcagtgttggatgtgttggtttatagcttcgtcatattttaatagagtagcatgggtagtatgtttagtttattatcctatatacccacctctctcatctttcaatgtttattgactccaagcatttggtctctctctcaaggttatattaccttgtttatgcaagcaaaagtaaataaattactagttaacttagttatatcttcatttgatcctattttaatgcttatgaacgttaaagctataaaactacacgagcaaaataataaatttgctcattaatcagcaaaaacaacaaatgacattaaattagagctaagggcgacaactacaactacaagtggagcaagacaaagacatttaaacaagaaaaaaacatttaattttcctagtcacccttatttaaataacttcaagaagacgacatgtcgtatagtgctactctacacaaatgattgttccaatttaaataatcattttcttttttagggtaaaataatcattttctatcacaggtttaaacagaatcaacttgttgtgggaaattcaaattcaaattcaatttgaattatgttaaaagctagaacaaagggggaaaaaatcacaatcaattcgtagttttcagaggagaattgaatttgaataaattcgtttaaaaaacatcgaacaagaggggaaaaagaaccagcgggaactcagggaggaggagaacaaacaagagaggaaaaaaaaagaaaaaaagagagagagagagagagacccggaaaaatcggtgcagaaaagagagaaaagcgcgaggcggctgcccccacccccacccacgcctacgcctcgccacgcacccccaccccatgtcggcttctgcctccccggcgaagcaacccccaatcccggccgaattgatcccaattagatgcaccaccaccaccacctccccgtagtcgccgccgccgccgcatcaccggacgcggccgccgcngaccctcccccctcctcggatcccaaccacctcgggccccctcccgccctccgcatccacatcccctccagcccccaccatgcgctcccctccacccctcacaagcgccccgtcatgacctcctcctcggcctcgtccaccccgaccaggccgtccccgtcgccgtcgccgttcgcgccgccgcggcaccgccggaaggtcgcccccgccgcggcgtcgcccgcgcccgccgcggcggcggcggcggcgaggcacctcctccgctgcctccacctccgcctccgcctcctcctcctcctctccctcccgaccctctacttcctctccccatccccggccatcctcccgcgctccctcctcgccgacttcctctccgccgccgccttctcctgcgcgctcctcctcctcctctgcctctccctcccgcgcctccccttcccgctccccttccccctcccgctccgccgcccgcgccgatcccccatcctctggtccatcggctcctcgccctccgcctccgcctccgcccccaccaccggccatttcgtccaggtctacagcaacggcgatgtctacgagggccagttcaaccgcggccgctgcaccggcagcggcgtctactactactacatgagtggcaggtacgagggggactggatcgacggcaagtacgacggctatggcgtcgagacctgggccaggggaagccggtacaggggccagtaccggcaagggcttaggcacgggcacggcgtatacaggttctacaccggggatgtgtacgccggagaatggtccaatgggcagagccatgggtatggcgtgcacacctgcgaggatggcagccgctacattggggaattcaagaggggtgtcaagcatggacttggccactaccatttcaggtgtgggactgaacttatatatttcatttgctgctgcctgctagagaatttgtcattgttgtgaaattagctgttgcaactagttaagagcatgtttatgatccatcattggtcagtcaaatagatatggatgttgcaaaatgtttagtggtaatgtcaaattaggcaaatgcatgattgtttaaccacagtatatgataagagtgaaattagcatggttttggtgttttgcaccagcgattgctaaattattcccatccttgtggatttgtgtatccaaacaagtatcttgtaattggttataacttataacacagttttatcttcgaaccttatctgcttataccagtaagttaggtgttgcttaaattttagatcttgtgaagttgagcagaacgttagattctctattatctatgtagttgtctactatgttgctttatatgcactgaattttagagcttttcctaaccctagtagataatgtattaaatgtgaatgcttcatttgatcaaagggaatgacttccattagcttattgtttacaagggagagatgaaatgttgggctggtagtggtaccttcttctgaaagatccaacttggaatttacttttgccatttatggtagattctgaaaaagttgtaattatcactagggtatagcctccaacgaccctgtatttttttaccctctgccctgctcatgaatcagaatataaggtgttcctttatgttctcagcctatatcattaggtaggaaatcaatttggtgaagcagagcagattaccaactatagagataaaagttagagctgtagggaaaactgatacttttaccacctcagtctactaatacacatcattttttgttatcacttatcagaaagcaagcttttttttacacttaatgcatgcctatattcttctagaagacgtttttaaagttaaaacaagtgatgatttgcctgtttatgctagtctagctgtgttttgtgagcatgcttagctgtcctcctgttccatttcttcctggattgttgatatgctgttagaagctgatctcgtgcaaatttgcactggtcaagctgagcactagttatttcacatgtggaatactggatgtctaatttgatccattgcattttgcttattccattagtttccatttttggttctttccagccatatatctctcatctctctgttgtattatatctgtcttgattgtttgacttcctaccataatcccatgtgtatccaagtagtgaattagtgataatctgaaatggaaaacagggtcctctcctctgttggtttagcttctggcatatagctcttctaaagctaaatctgtttctcgttgttggggatcattctgtatttgttgattagggtaattgttggttcattcttagttgtagcttcaatctaaatatctaatgcaagcagtcttttggtatcgctaatactaatatgattgatgttctcttttatttatgctgcatcgtttaaccgtgcgggatttggccatccattctctgttattagttatctagatttatgtccgtaatgcttattgatttatgtctgattggttacgagctatattagtcatcgttgacagtgtcatgtcatgacgggctgtttggatttggaaatcctactttgttgtcctgtgtcagggacgaatattaaaaatccatatatatactatacctagtcttttcacttccatctaccaaattaaaacttgatggtgtattcatttttttttttgcaaagtttatgagatagcatgatatattgtgtgtgatgtatgttagttgtaccagtctactacatatttgagcaccactatctgtttgtatatttccttatctttcccttgtttacagtttcccgtgtgaaactttgttcttctctacggattcattttaataaaagctgtatgtttagatttccacatagcccataggccatagatgcattgttgcagtttagcctgattcactagtgctctatatatctatttatacgatgcagcatcctgtacaagtttattgggttgacctttgaactaacattttgttaacttgtgtcaaggaatggcgatacctatgctggggagtactttgctgatagaatgcatggcttcggagtctacagttttgccaatggtcacagatacgagggagcttggcatgagggtagaaggcaaggattaggcatgtatactttcaggaatggagagacacaagcaggccattggcaaaatggagttcttgacaccttgagcacccaaaacattatccctgggtcccctatagctgtgaaccattccaaggtcctcaatgcagtgcaggtaatgttcctgaacactattacgccattagctgtcagaaagtttctctggccatttttgcttagtacaattctactctctaagttctgattatgttgcactatcaggaggcgagaagagctgcagagagggcctatgacgtcccaagagtcgacgataaggtgaacagggccgttgcttcagcaaataaagcagccaatgcagccagggtggctgctgtgaaggctgcacaaaagcgcatgccaaataatggcaatgatctaccgttgtcagtagtgtgagaaggaaagccaacataaggttggcacgaagctgcttcgcgatgtcatcgcgttgttaccaattcgcccgacacaaccttccgcttccctacagggggaagttgctccaccccatcgggccgtggcgataccctgagtgactgccgttgcagcagagcttcggaaccagagttttccgccattccctccatacatcttttgtggtgtcttttgcgacgcagcagaactcctgcgcagagagagagagcttcctgttgtcgaaggcaactgatcgaggtcagtagggttctcgtgctttcttttttttctcttcttcagtgtaatactcatcctatgtttagagatacgatgatgtacacacccccaacatcaggagacaaaatctctgttgccttttgtctcttggctttaagcatgtatagaacctacatattccacggtgccggccgtgctggttggaggaaccgcatgccgcccccgccattgtctgtactactttgtacctgaacgcataaagataaccatgaccttgaatgaatggaatgcctcctgttgttttcgtggttgatgtgtaactgcacattggattatactattaccattagtaggtataggaatatatgccaaaatccattatcatttgtggggactggaaacacgagctaccaaataattgtggattgatcaacaagcatttgcatcttgaaggaaattattggcgcacccaaagcacaattcatagcatacgatgctgcttgctgtttaattaaagcatacaaactgaaccgaatagtgattactccaagaataaattggcattacaaattcaaaccaaatgctgctcagctaagtaacaattagaaaaatcagagatgagaaacggcgatgataccggattactcagccgtccgtcaggagtcaaatgccgcgttcaaaaatttacgtaagcgatctgtatcatcagcgacagctttggtacagttcaatcagagccgtcgatgactcgatcgacggtaggatgccgcgtccttcccgaagaaggcttcacctgccgcgtcttgcgggctcgcaaatacacgacgcgtctcaacgactccaccacgagccgagccgagccaacgaagaaatcgttgccaaccaaatccacccgccgattcgcctcccccctcctcgccggcggcggcgaccccgcggcggcggagagatgatgatgctgatcgactgctcgggctgccggacgccgctgcagctgccgcacggggcgccctgcatccgctgcggggctgcaggaat

SEQ ID NO: 13331 - DNA, 3324 bp, Oryza sativa
  unsure (1)..(3324): unsure at all n locations
gccacgagctcaagggttgcatcaacgacgccaagtgcatgcgccacctcctcacgacgggcttccacttccccgacgactccatcatcatgctcaccggtaactacccgatattacctccctattggttgaattctggttcgggtatcctcaatttcggggtttgattgatcccccaccccaccaatagtggcctgcgtgtgaagagattgttctggagcgaatttcagggctagggtatgatcgaatcaaggagctgtgggtggctttgcattttgatgaattttctgctcgctttttattttactgttgcgatgaataggcaggggcaaatgatgaggaattgagaactgtatttttttcgttggcgatatcaaaatgtaatttaaatttattcctgcctcaataaactacgtatggtttcaatttgaagataaagctggtttggtttgatccatcacactctttagggctgatataagctaatgttgttgtgagtcatgggctcatgttttcgcaaattatggttttactaactaaatggaatctagtaggatgcaaatgctagactgaaaacatttaagacaggaaaagggcaaagtatttttttgtcttatattatctttctggtatatgaaatttgttttctgatgatctgttgaaactgatcataacccaatactattggtttatttcttgtcttgcagaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacaggttcgcttatcttgtgcaagctcttttttttttggcacttgaatgataagtacatggacttaacctaatggcaatcttattatcctatcttcactacaaactatgtttgcaagaaagatgctatttacttctgaaccaatttgatttgaatgccatgtttgtctgattatgtttcagctgatgatgatatgattttggagcttgctcaaatattctattgaaatgcagtttgaggacagcattcaattattttttttgtctcatgatgattatattctgtcatcctgctcaaatatttttactggaatgtaatttgagggtagagccagtgaactatgtttcttagtcaattatgtcaatacaagtagttaccctcttgggactgtcatttgttggaaacagttttggtgtggtactgttcaccatccgtttattttcacaacttactgctaatttgcccatagtatgtccatcaaaatgttgtttatcctaggacaggaatgtgctgtttagagactatgctgttttattcagttggttttgttttggattccttggttgtagtgtttactttacaaacatagatctgtagatcttatgatggaaatatgttcagctaatatccctggtcttctttggtacaggagtgggcaatatgtatgggaagatcatcgacctcgatctggtgtctggaagggcactagtggcggcgagtgtatttcatttagtggttgtgacgatgatcagacatctgcagatacttcagtaaatttttgaattcattccttctctgttagcatcctaggctgtcattccttattctcttcgaagttaatatatgcttaaaagatagctttggcaaggactctgattgcagatcatgcctgttctgttactgttctattggtcagttgtgttctattctgtttaacccaatttataggtattaacatttgattcatttgcacttgttccaatcaggctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcaggtaaattctggagtttgacatattcctctctatctagtgattatttaaatcctatttccgtgggtacaatacaaaaacacacagaacatgttcttttggttgtatacaatttccattcccttttcagattgtcaacaatactaactgcttttctctaatctgcaggatccacagctaactgcaaacgagccattcgatgtgtatgcgaagcccttttctctatgacacgatcctggtattctccaccgcgtctatgattatatcactagtccccgtataaattatcatgatgtaaatttcactgttgaaagggctccatttcataaatagagctaacatgttgcatgtattgttgctcattacattgttcacgccctttggaatgtgatttgtaccttggtcacattgttccttgatcaagaccatattatgctcagtgcaatatgcacgggttaatgagattgtagcatatgtgtttctttctttctttctttcttttcgttctccttttcttctctcttgtccttagatttgaaaagtccggatgcaggttttggctgttgcgtcctgcttatatatgtcgtagtttgactctgtaaagtacgcgtgaaaggttgatttttcagggaaaagaagaaaaaaatccgcaggtttgatttggtcgccgtctgccggcccaatgtatccaacataaacctgcataaagttcaaacacaaaagttcaaaaacgtcggcccaatccttaccttattatctgctactttgaacaaatagaacccaaattgtttgctgctgcaaacgagctatttccttgcaaagttgcaaaattattctcagctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13332 - DNA, 659 bp, Oryza sativa
attgagcgtctgcatagcgatgtcattgctggccgtaagcggctgcaagtcgccgccacctgtgcaaagtcaacgaccggagccagcagcatgggcgatggagaaagcccaagacttacagcagatgctgaactcaattattaccgtctccgaagtggaatcgacaggataaccgcgcaggttaactacctgcaggaatacatcaggacgcaatgcctgaaataatttttttgcaaatcacaaagtcaatttaatgagcctcgcgatgcggggcttttttatgtccgcagtaaacgcgcatctcacgcgcatattaacgagagcctttcagtaagcgagcctgagaaatgccgttataggtggcgacctctctcgggcggcttttctgtgagacaggctcactttctaaaaggtaaagacgctatgaataatccgtcagttattccggccttcgacttccgcgaaatggtcacgaccctcgacaacaagataatcaccacatcactcaaggtggcggattactttggcaagcgacacaaagacgttttgcgtgccatacgtaacctgaaatgctccgatgacttcacccagcgcaattttgcgcccattgatttcattgataaaaatggcgatgttcagcctatgtataacatcacccg

SEQ ID NO: 13333 - DNA, 13341 bp, Oryza sativa
  unsure (1)..(13341): unsure at all n locations
nnnnnnnnnnnnnnnnnnnnnnnnnnnnnnnnnnnnnnnnnnnnnnnnnnnnnnnnnnnnnnnnnnnnnnccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaataaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtgaagaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcgccggcgccgacacgcgggccccacacgtcagtgagcaaaggggacaggcgcacggtggacacggtccaccgcagcctcgggcgcacgtccaccatttggacggcccagatcggcccgagctgatcgggcggccgaggggagcggcggccaggggcactggcgcgacacaaagccggcccggccgagccaaggcgcggcggcggcatgcagccaccggcggcagcagccggcgacgcggaacgacggcgggcagccggaggacagcggcccgcacaggggacggcgatgcacctcaagaggcggcagccggcaagaaagggtgacgggaaaaaaaaaggggagggaggagaggtcctcaccgaaaacggcggccgacgcggaggaagatgacgacgacgacgattgcccgatggcggctggcgaggacggagggcgaacgaggtcgcccttgacctgcggaaggagaagagggagttaggttggggagaaccgatgcggggtgactagaaatgaaggccgatggcgacgacgagaggtggggctcaccggcgaacttagaggatgagttggagcggcggaagacgacgaccaagcagcggacgaggtgagggcgagcactgcgaacgcgccagaggcagcagcacggccgggcgaggtccccctcaccggcaaggagcggctggagcgctgtggaagcggaggtagctcggctccgcggtgggagggggttccggtggtgaatgggagggatgaggcggcggccaggcttgcccttgtggcgtcgaagccggcggtggatgcggcgcagcacggcagcggcgggaccggcggtagcgcgcggctggagggcaccgacggtggtggagctcggggtcgacggtggaagcagtgctcgggctaccaaataaaggggtggtgcggcggccgaggcgtggcactacgcggtgcagcttttggtggcggtggcgcagcgcggttgcgacaggaacagcggtggcgggcggctggagttcgccggggagcggcggagagagggagcacggtggggaggtggctaggaggcgcggggtgctcggggagaggggaaaacggatgaggggaggcacgtgagtcgtttatataggtcccggagggggagaacgtggccgggagaggcggatttgaagggggaaaaggcgccggcgacgtgggcgagtggcggagcaaaccggcgccggtttttgggggaaatgggggaggagagtggaggaggtggaggggatgcggttgctctcagttcggatgcgagcgcgtgaacgggaggacgcgaaaacggcggcatcgtgggcggcaatggcggccacgagcggctgctggctgggatggagggaggttggggatgacaggcggggcccatgggtcccacacgtcggctggagagagaggagggaaactggggaggcaaagcagacttccctcaaggcctgagccggcctagagatggaggaggcgcgcggcccgggaagggggaggggattttgggccaagcccgaagggaggagagggaaattatttggttttctttttatttaattgattaaatgatcttcgtgactttaaactatttctcgagctccgaaaattcacggaaaattatggagagtacattagggcacaaagaatattacaaaatattcccggccaataatttttaaaggaaattttaatttcctctattaattcacttgaataaattgcttaactttttatttaatttctaggaaatgcattatcaaatgatttttaatcccgaacgaaaatcggggcgttacagtcggcctcctatcccccttctcctgccggcgcggccggcggcctctcccatttctccagtcgatgcggccggccgcctctcctcctattctcacaggcgcggccagcgcggccggcctcctctctcccttctcccgccggcacggccggcgacctctcccctttctcccgctgatgcggccggctgcctctcccgccgacgcccccctctcctgccagctgtcccgggctggaagaaaagaaagacgattggctgacatgcggaccccacatttttcttctatcacttacatatggacccccacaatttttttattccctctttgcggattaggatgccacgttagtaaaaccatctattatactgccataggacctattctacatgatttcgtatagtttagggggggagatttctggtattggacataagggatgttttacagactcgacataaagttgagggacggtaggtgaacttattcctcgtaggaatcgtgcaagctgggaataagttcactttgtgaccctcaaaagtgattgaaatctaatccgtgaccctaaaccacaaaaccggatatcttgacccccaaactatgaaaaccggtgcaatttgactccctcagcggttttggagggcggtttcgctgacgtggcggtattgaccaggtcttctttacacgtggcgttgatgtggcgcttaggtggcatttcaattaaaaagttatacgtgggactcatttgtcattcacacacaattgtggggc

SEQ ID NO: 13334 - DNA, 5316 bp, Oryza sativa
tcgccaccatctccgcttgccgcgggagagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctacttcctccacctcatccccacttctatgtatcttatcctctcccaagggagtagggtgagcagagcggcgcggcgcggtggcggaaatccgctgccgacgccgatctccacagcttcggcgctcccaactccttccgccgtcatcatcacgccttctccaccgagctccactactgtcttggtcgccactcctacttccccacctgctttgacgatgacgatggcaacatgttcgaggatgcacacctcatcttcttcttcccagtctcctctgtcttcgcaccaccgtccctcgccatgtcagctgccgccgcatcatacaggcccctcttctccctgctcccacagcatgccacactcccccttctagccgccggacccctctcagcgcagcctctgccacttcgtccactccacctccttcctccccttcatctatttcgactccctcgaggacaatgctctccactctgtccccatccttctcagcactctccaacttgctcgtcgtcctcgagccccgtctccgccgtcctacgcgccaccccccgacctcgacggcatcctcgccatgggcagcggctcgccgcgctgtcccctcgccatgggtggagaaaataggaccaccaacatgtgggtaccattatttttctttatcttagtttgactgaccatattttgtgtcaattatttagttttcaattttgtttttttccaaataaaactgtcacgaaaaagccacgtgtaacaaagatcaagttaaattagtcacgtatgtaccgcgtaagccaaaactagagataatagtaccgaagaacttcgtttgcactggttttataagttaagggggtggttgtatctggttttcggtttagggcgtaaatcggatttggtatcaagttaagagatatcaaatgaacttattccaacttagtttcggtcagcccatatgcacaaaactcatggaatcagccgtaccttaattgaaggaaagaaaaagaagaaagaaaagatactgattttctttttagaaaatgaattaaaatccggctacatcgatgtacacagcacagaaaagatactgatcggtaagcagacagccattcgatctcttgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcactacagggagaggggatccaagtttttgaccagctttgacgaatcctcactctcctctctcgcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaggcacttggcgcagcacttgttgcagaacgtcaggcacgccttcttgtactgcgtgttggagcacctccccgcgcacttgggcgagcactcccacggcctcaggttcccgccgccggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagctagctataaatctgtagctcgctgtccttctctctcctcatttatctccttaaaatatgtttgcagctggcttatagcctgctattgtacctactctaagagccagtttaatagcatagcccattgctagctccaattcatttatagtcaattcatataatagttgtttactatactattaatatctgatcccacctaccataacacagtcttggagtccgtgctacagctggctacaaatctgtagcccgctgctcttctctctcttcctttatctttttaaaatatgtttacagctggcttatagcctgctattgtacctgctctaataccgggaatcaaacgaacccgaggagatgtaagagcaagtttaatattatagcctactactaactacaatttatctatagtcaatttaatagataaatcatacaatagttgtttattattttattaatatatgatcccatctgtcatatacacattgcgttttagagtccgtgctacagctgattacaggtctgtagcccactactcttctctcatattttatctcattaaaatatgtttatagctggctaatagtctgctattgtaactgttcttaacaaaaaaataacacgacgaggtggtgagatgctactccaagtctagattaaatcggtgagtgggtcatatactataagtaatagtactccgtagtttacgtccactagatcggcggcacatgctgatgccctttttccagtgcacctccactagctactagttctggtactccattctactcctggagagggcaccgcacatgcgcggttcgtatccacagcttgcgggcaccgcacatggatgatggatcgttccaggtttgtattcaccacagctcttgcggcacatggactcccccatctctctaccctacagattgtcgtgcactcgtgcagcagttcaattcgccatgtagtagtagtagtaaaaagtaaaaacttgtatatatactcaggtacttgtactatagtagtaaaaaggcgtccctcgtcgtcgcagagctgttcaaaatttcggttgcacggggcacgagggcagccggcaaaatctccctgttttgctgggggcttttcgcacgccaaaagtccaaacgctctctcgacagggtttcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggttaccgcggttaccgtgcggtaaccgtgcttaccgccggggcgcgggcaccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggag

SEQ ID NO: 13335 - DNA, 20015 bp, Oryza sativa
aggtgagcttgggataattcagtgacatttttatgtgaatgtgttaaaaattaaagggtagtggatcttttgggttggagtggagctgtggagcagaaaaaacccagctctacacctgtagtttattttttaggagtagctctactaacttcactccaaaaacagaaaatatggatcgtttggtacagctccgactctagataagttggagttgaaagttagagccgtgccaacggaccctcgtactccagctgagttcgcaatgttgcaatgcacgggcgacgatcgtcgtccgtggagtgtagattcctatcattttggtgacctttgcagagggcgttgttgatcgatgatgcgcatttcggccattgcagatcaggtgaatcacgattagcgccctattgtttaggttcccggtcaatatggtcttactactgtatatgcgtctgattaatttcgaattatgtttatttatttcttctccagcatgtgtagtgctccctccgtcctataatatagcaatctagtataagacgagatacttcatagtatagcgaatctggacatgcttcatgtcatgtctaaattcgttgtactataaagtgacccatccggttctaggttgctatattatgggatggacgaagtagtagagtatgggtgtgttcggcactgctggttcctaatcttttccatctcgttttccgcgcgcacgcttttcaaactaataaacggtgttttttttaaaaaagtttctatatgaaagttgcttaaaaaatcatattgatccttttttaaaaaaaattagctaacactttattaatcacacgctaatggaccgctccgtttttcgcacgcactgttcccggctgggaacctccagtagcgaatacacccatatgtgtggtagagatctggatcctctgccttaggaaaaaagcagaggtgcacgataaaatgagtctactactatggtagaaaacagtgatttgcagttttcactgtagcaacagtacaaaacagtgaaaaatactgtgcgcaattactatagtgatcgatctcgtccatttcgtgtgaaccagacaactgaaaataccccaaagtcacggtactgttttacctctgactttaaccccgggaccttaatccgtgtggtagtagataatatgctatgcacatctcccgtgaggcaaagcgtaaccttgtggattgtcctccccgtgcgtaaaaaaaaactaaaatgtattcgatagaaaattaagtttaaaatcttgtatttttcttacctaatgatttgctttgagttccgtgctctgatgacccaagctcttattctacagttgaccccttctcctttagttctggtgaccccctacaaacagtaatggagctagtgtttagggtcctcgattatggctaggggtaaggccgtaagggtgggggagggggaagagagggaagatcgctggatttagaaggatggtcatgggaggcggcggctcggtgttgggtcgtggacatgagcaggcggtgaggcgctcatggcgacgtcgaagccatgagaatagaggaggatgatgagccatcgttaatgacgggagcaaagcaaacttgtggtgaggggcggatcaactgtgttaggtgtggtgtcacctgacaccaatagattcttgtttaatctaagagcaggtttaatagtatagccccactattggctccaattcatttatagacaatctaatagccaattcatacaatagttgctaactatacttgttggcggatggcatgaggcccttcgaccaaatttgccgaaacccgtggcgaaggctatgaaccaaggatgaggcgaggcgaagggtcgcgtgagtacctgacgaagaaggatgacttcgccatagccagttcgccctggcatccagcgaagaaggacggcttcgccatgtccagttcgcccccgcaagggccgaagaagcctttttggcccatcaagcttaggggctatagggccggcggtcgcctgacggcccatcaaggacccataagtccccttgacattatgtaaccctgtaaacgtctctttcataagggcaaccatgtaaattcccccgtataacctaaaccctattagtaagaacatgtaatggggctataaatagtcccctagggccatgtaatggggggatcccaagtaaaattaaaaatttaatacacttcgtttctttcccaaccactgttgagtaaccacgtctttcgacgtatgcggttgtcgtttcgacaacagctggcgccgaccgtggggacctccgagcgaaaccactaagagcgaatgccaccgaagaaggtcgcgaaggagaaggttacaaggcgaaaggaaagcgacaccggagtgggcatggccgccgaagaaggagcggagccttcggcgtcggtcgccgaggttggaggggcaccgtctgcttcggcgacggcaccgtccgcttcgacgccgacaccatcactgctgccttcggcccctgccacctctgagcaggcgccgagtgtgaatgacgtggcgaaggcgaccgcagtggcgagggcacttcagaccagggcggagatcctttcgacaagtcagctgctggtcccccaagctgctccgtcgcagccagcagcggcccaagctgcgctccctgccatacaagtccaagtcaactccgaccctgaaacacaagccgaagccgatatggagggcatgcggcaaaacatggcacgactccaagacatgcttcgccaaatgcaagaacagcaacaaacgtacgaagcggcaaggcgatccaaggttgcttcggcaccgatcctccagtattcggcaggttttgtcccacctcaagtctatccgcaagtgcagcccaagcccgctccgccgcaagtcttgcaggcaccaatgtactttgtcggacagccgacagtggcaacagtgccccaagccgcgacccaagtatagcctcagccacttggccagctgtcgcaagccgtagcagaaggggcttcggctctgcaggcacaattccaagctttcctccagcaaatcaatcagccccacaacatttcgaatacaactccctcaactcgtccagaggggaattcaagtcaaggtgcgctcagttggttgccgccgaaccagccgaatctgaggacttcgccatggaatcaggtacctcagtgcgactttaccaataccgctcaggcgcaaaccgttcggccgcaagcaccaacaccaggcttcggaacaagccaagcaccaactcatgtcgccatggcgtggtcgcagccagttttcgatccatccatggcggctcagcaagcatcaccagtcggagccgggcagccgaacgccatggctcaaaatcatgcgcaagccgtaatttcacctttcgccacgccgtacccacagcaaggcaccgcaggcagagcgggaggcgaaaagggtctgccgctgagtgggggaatcaagaaccgcccaattccgccccagttcaaattccctcccgtcccacgctactcgggcgaaactgacccgaaggagttcctatccatctacgagtccgcgattgaagcggctcatggtgacgaaaataccaaggcaaaggtaattcatctcgctcttgacggcattgcccgttcttggtatttcaatttgccagccaatagcatttactcatgggagcaattgcgcgatgtttttgttcttaactttcgaggcacttacgaggagccgaagacgcagcaacatctgctcggcattcgccaaaggccgggagagtcgataagagaatacatgcgtcgcttctcgcaagcctggtgccaagttcaagacataaccgaggcatcagtcataaatgctgcttcggctggtctgcttgtcacgcccggaaattcactagtaatttccgaacttatttgtgcataaaatcctcgtccaggaatcaaccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgatttattattgcaaggtgagcatatgacatactcagcaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacagcacacccatgctgcataggcccaaccattctgaacaaccatacccggctgaacagatctaactccaaaccaggagctaagcaaattattacccggtataacatctataaatattgtgagaggtgtgagactaatcacgaaaaacattgttcaactcgcccataaccgcgggcacggctattcgaatagttttactctggccagaggtgtaccactgtacccacaagacacagcctcaacatcatgtctacaatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttgacaagtaattaattaaccaatcacgattaaccatcgtgaactatctttaaaccatcattaaataataatgagtcataagttatcccaatagtgtgctaatgtttctaagcatggctaagcaatcatatctaatatctagctgaaccaatatataaagctcaaccagtcaagttataatctcccaaggtatcaaggaataaagtaatcaagatcaaaagggccataacaaagaataggttaacaccacccagtgacattcgaaaataaatgcacagttgaaataaatagagaatttaaatataggatcaacatgctcaaaggattgtgtttaagatctgtgtgacttgccttgcaataatcggtcttcaattaatcttcttgaatacttccggcgcactcgcgaaccttcacaacgacggaaacgacaagctaacacgtaaaacgaagaaaaagactaataaaaaccaaataaacagtacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacctttatatggattttaattgaattatgacgcaataatgaattatttttgaaaaggaaaagaaggattattgcgtcagcgggctagggtttgcggtggaccgggtgcacggcagcggttcacggaaatgaacggccgagatcaaccctatccaaaacggacggctgagatcgatcggtccacgaccggctcacgacgaacggtcccgatgacgtcggcgatgacgtcacctaccggcggcggcttggacggctcggacggcgcacgctcgccggcgaacgacagcgcggcggcgcgaacggagagctccaggacgaagagcgcggcgcggcgaactcaccgatgaccaaagcaacggcggaggagcaacggacggcgccggcgacgaggaaaaggcggcggcggtcttcgggtcgacgatgacggcggtgctccggcggtcttcggtggcggcgaaggagcggacgaggacggcgacgaccttgcgaacccgatggcggcgacggcgaccgacgacggcggctgcaacggcggcgcagcgcggctgaaccgacggcaacgacggcggcgactaaggctacgcggaggcggcgctagacacgacggcgggctaaggcaaaggtggcggcgggtagaggagacaccgggggtccttataaaggggctagcgagcggcgacggaggcccacggcgaccggcggcgagaaggaaaggtcggggattcggaggaaagagaggaatccgattcgacctcgaatccacaagtttccaaaccgaattaggcgatgattccaaaagagaaaaggaagaggagatctcaaggatcatttgccctcaaacaattcggccggagaaggaaagacgcggccgaatttggaaagcggcggcggagcggctcggctagggtttcgggcggcggcggcggcgcgaggaggaagacgggcctgacagacaggccccacctgtcagcggctgagagagagaggagagcggcggctcggcggactgggccggcttgggccgagaagagagagaaaaggttttgggccgactttcggcccaaagccaaaagagacttttaaaaacccttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaaacttttaaaatcatttctaattattccttttaaacaacaatttataatttaaggattttaaacaagaaaagctcttaacaattataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctaataataatttattaaatagtttataaatcctgaaacgaaaatcaggatgtgacactgctcgaaggcgaactcacaaggaaaatcgccaataaggaaccacaaacactcgtgcacttgcttcgcatcattgacggtttcgcaaggggcgaagaggattccaagcgacggcaagccatacaagctgagtacgataaagcttctattgccgctgctcaagctcaagcacaagttcaagttgccgaaccacctcccctcgcggttcgccagcctcaaacggcgatccaaggacagccgccaaggcaaggtcaagctcccatgacctggagaaagttcagaaccgaccgcgcgggcaaggctgtgatggccgtcgaagaagtgcaagccctccgcaaggagttcgacgcccagcaagcgagcaaccatcaacagccggttcgtaaaaaggtccgaaaagacctttactgtgccttccacggacgctcttcgcataccacagagcaatgccgaaacatcaggcaacgtggcaacgcgcaagatactagaccacagcaaggagcaactatagaagcacctcacgaagcagcccaagaacaaacacccccggtcgaacaacgtcaagacgcgcagcgaagggtaatgcaagtgattacgagggctgacccgccaggccaattatccaaaaggcagaaaaagatgcagatccgagcggtccacagcatcacttcggcgggtgagggggcgccacagtatgtgaaccagctgatctctttcgggccggaagatgccgaaggagtcatgttcccgcatcaagatccgctggtattctcagctgagatagccggctttgaagtccggcgaatcctggtcgatggagggagttcggccgacgttatcttcgccgaagcatatgctaagatggggttgccaacccaagctcttacaccagcaccagcgtcgctccgggggttcggcggagaggcagttcaagttcttggccaagcacttttgctgatagctttcggcttgggagaaaacagacgcgaagagcaagtactgttcgacgtcgttgacatcccgtacaactacaatgccatcctcggccgtgcgaccctgaacaagttcgaagccatttcccaccacaactatctcaagctcaagatgcctggcccagcgggagtgatagtggtcaaggggcttcagtcttcggccgcgtcaaaaggcgatctagccataatcaacagggttgtgcacaatgtcgaagccgaattgcacagccggccgaaacacgtgccaaagcccaccccgcatgacaaaatagtaaaagtgcagattgaccatgccgaccccgcaaagctcgtatcactgggggacggcatgggtgaacaagaagctgagggcatcctagcggtgctcaaaaagaacattgatattttcgcttggagccccgatgaagtggggggtgtttcggcagacctcatcatgcatcacctggcagtcaagccggatgccaagccaagaaagcagaagttgcataagatgttcgccgatcgtcaagaggcggcaaaagccgaagtccaaaaactactcagggatggggttattcaagagattgaccacccagagtggctggcgaacccagtactggtgcggaagtcaaacggcaaatggcgcatgtgtatagatttcacggacctgaacaaagcatgtccaaaggacgatttccctttgccgcggatcgatcagctcgtggattcaacagctggctgcgaactcatgagtttcctggacgcatattccggctatcactagatccatatgaatccgcctgacatcccgaagacagccttcatcaccccgttcggcactttctgtcacctcaggatgcctttcggcctaaggaatgccggagcaacctttgccagactggtatacaaagtcctttgcaaccagctggggcgaaatgtagaagcttatgtcgacgatattgtcgtgaaaagccgtagggctttcgatcatgtgtccgacctgcaggagaccttcgacaacttgcgcgcagcgggcataaaactgaatcctgagaagtgtgtcttcggcgttcgcgcgggcaaattgctgggtttcctagtttccgaaagaggcatagaggcgaaccccgagaaaatcgatgccattcagcaaatgaagccaacgtcaagtgtacatgaagtacaaaagcttgcaggccgaattgcggcacttagccgtttcctctcaaaagcggccgaaagaggtctgccattcttcaagaccctccggggcgcaggaaagttcagttggacaccagaatgccaagcagcattcgccgagttaaagcaatacttgcagagcccaccagccctcgtaagcccaacaccaggaagtgaactgctgctatacttagtagcttcgccggtggcggtcagtgctgccctcgtccaagaaacagagtccggccagaaaccggtttattttgtctccgaagcactgtaaggggcgaagacaagatacatcgaaatggaaaagctcgcttacgccctggtgatggcttcgcgcaagctcaagcactacttccaggcccacaaggtaatagtgccttcgcagtaccccttgggcgaaatcctccgaggcaaggaaatctcaggtaggcttagcaaatgggcggcagagctatccccgttcgacttgcattttgttgcacgcacgactgtcaagtctcaagtactagctgacttcgtagccgaatggacacctgtgttcgcttccgaacccgagcccgtcgaacaaccctgggtgatgtgctccgacggttcgtggtcgcacaaaggggcaggcattgtggcaatactcacttcgccgaatggcgtaccagtccggtacgccgcaagactgcagtttaatacaaccaacaacgcagcagagtacgaagccattcttctgggcctaaggaaggcgaaaacactgggagttcggcgcttgctaatccgaaccgatcctaagttggtggcaggccaagttgacaaaacctttgaggcaaaagaagaaggaatgaaaaaatatttggaggctgtcagaaccatggaaaggtacttcatcggcataacagttgaacacttgcctaggggccagaatgaggaagcagacgccttggcaaaatctgctgcttgtggcggaccgcatttgcctggcatattttttgaagtactgcacacaccaagtttgcctgtggacagtttgacagtcttggcaatcgaccaagtgaaactgggcgaagacccaaatgactggcgaaccccgtttgttaaatatcttgaagctggttggcttccggacgacgaagcagaagcaaagcgcttgcaaatcagagccacaaagtataagttggtctcaggccaactttatcgctccgggacgcttcaacctctactccgttgcatctctttcgccgaaggtgaggaaatggcgagggaaatacaccaggggctatgtggcgcgcaccaagctgcaagaatggtggcctccaaggtatttagacaaggggtttactggtcaactgtgttgaaagtctgtgctgagcaaattaaaaagtgcgaaagctgccaacgtcatggccgaagccaatctgcgccccattataacttgcaacccattgcgccaatctggcccttcgccaggtgggggctggacatcattggcccgttcccggtagcgcgaaacgggtacaagttcgtaattgtggccatagagtatttctctcggtggatcgaagccgaaccccttggggcaatcacttcggcagcagtacagaagtttgtttggaaaaaaacattatttgtcggtttggagtgccgaaagagttcattactgacaacggcaagcagtttgactctgataagttcagagaaatgtgcgaagggcttaacctggaaatcaggttcgcgtcggtcgcgcacccgcagtcaaatggggcggccgaacgtacaaatggcaagattctaaaagcactaaagaaaagactcgagggggcagcgaaaggcaaatggccagaggaattgctatcggttctctgggcccttcggacgacccccacaagaccaaccaagtttagcccgtttatgcttctttatggcgatgaggcaatgaccccagtagagctaggggctaactcaccaagggtgatgttctctgggggcgaagagggccgcgaagtatcgctcgaactcttggaaggggtaagagtcgaagcgctcgagcacatgcacaagtacgccacaagcacttcggcaacttacaacaaaaaagttcgaccgacggagctgatgcctggtcatctcgtcctaaggaagaaggcgaaccctgtagcggttggcaagcttgaatcaaagtgggaaggaccgtacctcatcaaacacaagtccaggacgggatcctttcgcttagcgacacttgaaggcgaggagttcgaccattcctggaacgccgcctctctcaagcgcttctatgtctagaatgggtggcacccaaatcgccaacttgtaaaaatgtacataccgttatgtaagccctttggcactatgtaagcctttcggcaagaaaaaaaaagaaagagagaaaaaagagaaaaaaaactggatgtagggctattatccaccatggaggcccgaaccagtataaaatctctgtgtcctccgccttctttttatttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcagaaaataactagccgaacgatgttacgctcgatcaacataaaagcaaaagcgtttctttcaacacagaacgctacagatcgaaaacgaacgatgaaaagctgaaaagtcagtacacctatttcgctaatatacgcaaaggggccggcatgttccgacctaacaaaagcacaaaatgtgacgatgcgaaaaatagcgaaaaggaaataaaacacatttttattaacttcgaaagaatagaaggttcacacgatacaattcaccttacaagtaaaaatacatcttcgcccccataatcactatccctccctaaggaagggtcaggcgaactaggttcgtcatcactactaatatcatacacaaccttaagaggagtagggggcgaaacacagactaaactataacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttcgcgataagtaggacgaaatggacatcgcaccttcggcagacccttcaacgccacaaatttctcggtttgacttcgccagctcccgaaaggaggccgaatgcacgactttcggcgaaccccctggtagactgtcacgcccggaaattcactagtaatttccgaacttatttgtgcataaaatcctcgtccaggaatcagccgaggtacacaaactgacaatttaatatacagattcatcaataactaaagcgaataaatacttacttaagaggcacttagtcctcaacatgaagaaaactacagcggaaaataaaatctagcgaagctccggctccactcccacaggcagctcaactggggtataagccaaacgtcttctccttctggatcctttttcttcaactgaggttgattgattatcgcaaggtgagcatatgacatactcagcaagccacacagcaaatatgcaagtgcacaaggataccaaaggatggcataatattggctcatttgcaaaagcagcatttagcaaaacttttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagctccacatcatgtcaccatttgcctcagtaccaccacggtacctcggaaaggagctgtgacattaccccttgcataacacaatccaccacagcgcaccttcctggatcataatcacccccttataaacaaggcatggactccccagcgacccccgtgggcttatctccgccacttctcagtctggtgctccgcaatgaaccatgctatacaaaaggtaaagccgttgcccacactggcttgtggttggcacggttaatgttccacaacagtagctcgcgaaccagtccttaattgtcatgagcacgactctcaaaaccatgtgctcacaacccaccattatcaagttttagttggcaagtaattaattaaccaatcacgattgaccatcgtgagataccattaaatataaccataagtgatagtgaaacattagttatcccaattatgtgctaatgtttctaagcatggctaagcaatcatatctaatatctagctgaaccaatatataaagcccagctagtcaagttataataacccaaggtatcaaggaataaagtaatcaatgcaaacaggccataacaaaggaataggttcacaccacccagtgacattcgaaaataaatgcacagttgaaatatatagagaatttaaatataggatcaacatgctcaaaggattgtgtttaggatctgtgtgacttgccttgcaataatcggtcttcaattaatcttcttgaatacttccggcgcacttgcgaaccttcgcaacgacggaaacgacaagctaacacgcaaaacgaagaaaaagactaataaaaaccaaataaacagtacataaaaagtaaacaaacatgtagattacaattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattatttttgaaaaggaaaagaggattattgcgtcagcggactagggtttcggtggaccgggcgcacgggcgacggttcacgcgaacggacggccgagatcgacttgatccaaaacggacggccgagatcgatcggtccacgaccggctcacgggagaagggacgataacgccagtgatgacgtcaccaccggcggcggcggctcggcggctcggacgcacatgctcgccggcgaacggcggcgcgacgacgagaacggaaagcaccgggatgaagcggacgacacggcgaactcaccggtgaccaaaggagcggcggaagaggaacggacggcgacggcgacgaagaagaagcggcggcgctcttcggcttgacgacggcgacggcgctccggcggtcttcggcggcggcgaagcggtggacggggacggcgacgaccttgcgaacccgatggtggcgacggcgaccgacgacgacggctgcaacggcggcgcgacgcggctgaaccgacggcaacgacggcggcgactaggctacgcggaggcggcgctagacgcgacggcaggctaaggcaaaggaggcgacgggtagaggagagctcggggatccttatataggggttggaaggcggcggcgaaggcccacggcgaccggcgacggcgaaggaaacttcgggaagaacgaatccaaaacaaactcgaatccatcgatttccaaaccgaagtagaggatgattccaaaagggaaaaggtggaggagatcccggagattgtttcccctcaatcaattcggccggagaaggaaaggatcgaccgaatttggaaagcggcggcggcgtggctcggctagggtttcgggcggcggccgacgcgaggaagacgacgggtccgacaggcgggccccacctgtcagcgacagcgagagagagaggagagcggcggctcggcagactgggccggactgggccgaggaggagagagagagcggttttgggccggctttcggcccaaagccaaaagaagacttttaaaacctttttcaatttaaattattcatgaaatgcaattccatttattaaaaatacttccttagctcaaataaatcccagaaaaatctaggaattatagaattaagcaaagtatttaacaaaattttatttagcccaattttatattgagatttaacaaattaaaattagatcttctcttttaggcttttaaaatcatttctaataattccttttaaacaacaatttataatttaaggattcttaaacaagaaaagctcttaataattataattagatcattattgatcaaataattactgaactgttctttgtatcatttaggaattgagctccgaaaaattcgagaaaatttcagagagtataattaatcatggagaatttaataaaaattaaatccatccatgctttagatttaggaaattttatttcccacatttaacttcacttgtaaattaaagaacatttaatataaattctattaataatttattaaataatttataaatcctgaaacgaaaatcaggatgtgacatagacagtgcagaaaaaagcaaaacacagcttacatggtaggaataggcggaagaagggggaggtatggcataatgcgaaatgagcgaaataataatatgtcaaagacttggaccgacagtaaatggcgaaaagtaggtctgttatacaaattttaaaaacgcccaacggccacctgtttcggttacaataaaagggtttgcggcagattgccgaatatacaatggttcgccacatctagcgaacaccaaaagaaaactatgaaaatctaagagaagggcggagggcctcacacctctgggtggtcctgggcatcgcttccaccccctccggccgccgcgccttcctcttcacaaaggtccgccgcctctgctttcaccagctgctccaaaaggcgcgccttagcggcggagcggccatccttctgccagaattgttttcgctacgcacgaagtgcgggcgaaatgtcttgcgcgctgatttcccaatcccccttcgcgtacttggggaactcggcgatgtgctcgcagccgaactgctgcaggaggcccatggtaaaggccgctgacacgcgcgcacagcagtcgccgtatgcggtggcgcagtccgaaaccgaaccaccagcctgttgggtccattcggagaagtcgaaggctgaggcatcttcggaggggacaccctgcacttttgcgcccatatcagtaatggcgaggcggagcgtttggcacgctgtccgcgcggactaggtggttttcaccatctcccgcgaaaaccgccgcgactcctccgtagcgcttgcttcggccttgcgaacctcctgccgaagagcctccatcttcggctcggtgaggttgtaataatctatgagcacggcggagtgggccttctctttctccagttcggcctttaagagatcgacttcggccctagcttccttccctttctcccgttccgattggagccgcttgttttcggccttcgcctccttaagggtgttcgcaagggcctccatctccaaatttttgcggcctaattcatcatccttggcccgaagacggcttttgaacccgtcaaggcgggctcgcacggttcgctctgtcgaacagtgagccgtgaggatctgggtgcaaaataggagcggcgaagagaacaagtgttagttgtaaaaacatggttaaattgttccggaagtacagataaacacggcatgaaacatagcataataagcagatagctaatgtaagcatagatttaatatcagtgaatccccttgagcctaaaataaactatagattagcagctaagcagcaaccattcttaactgaagaatgacaaagacaaaagcaacacagtataatcaagataaataaaacatgataagcaatatttcagaaccatgtgaaagcaagataaacaccaacaccctaaccaagtaactcacaaaatgatgcaatggaacctcaccaactgggcacccaccattacccccgagcagatggcctatggctgaggacgaaacatagcttggcctatgttcaaactacagcaacaacatggtaagctagtcaagcactcagaagtcagagaggagagagatggaccggagacgaaacatacgcacctagcggtgaaggggcgggcagacctgcagccgtgggcacccgtcgatcccgttggggacggtgtgtccagccaatgaagatgtacgccagcaggccttgatagaatagcgggccgatggctgaggacgaccgtagcagaagattgtgtggaaatcagcgatggcagcgatttcggctcgacggggtagagagacaaagaaacggcggcgatggagactgcgcgggtgaaagggatatatcgatctggtgaggggaaaggcgagcggtgaagaacccacggtggagcggcgacggtggagacgcgaaggaagtcgcgggagcggatggggaatggaaaacctagaagccgcggcagcggcggcggcggcggcgtagatgcgaacgaccagaggaatatctgggagctggtagcggctgcaaagaaggaaaaaacgaacggctggatccagtcaagcaaacaatcgaacggctcctggcgtaatgcaacagtgaaacagtaaaacagtagcgtacagtgccggacggctgtggttgcaacggcaaaaactatagattttatatgatggatgacaccagtgagatttatcctttgacaccaccacgtccatggaagcagccatgaaagcccatcatttgcttaaattgcttcggctaaagttagctaatacaacccagccggctagctattgcctgttgggctgttggcagtgagcagccgaacatgttgtgtctaatcaataacgcatatcccaacatctcaatgaatttttccaacttcccattcagtttgcaaacaaatttcttttccacttacatttatataacatgtcacctaaataatgtttaaaaacttctattaatttatttggtttaggtattttatttctagagattttgggggctctaaggctccgagctgttaagtgttgttctttggtgccggttggatagtgtacggacacctggtctaaggtttttaatattcatttgtaatattatgtttgtgtagaaaaaaaatacttgtggtgctatttattttgcatatatgtatctagtatgatctagtatatagtttgtggtttttcaggatggtaacttagttttagtaccatgcgatcactggatgtttaactgctggttatttgaattattatgcaagttcatctacattattccacctattaactctactacttatcattattcttattacttttcatgtatattattactttgttagaaactacgataattgttatgatttaacgatgacaccattgatccaatatcctagatccgcctctcctagtggttaggagctaacgaggatgggggctggtggggcggggtacctcaccgctactgacttgagaagagggggggggacatcgagtgagtagcgcttgatcccgattctcgtgcgacactggtgtgagggatgtggttaggtttatgtcgtactgcatgaatcttaaagcatccgatgatctaaaatccgcaatattttattaggtgtttgtcgagctctagtgacaaaatggaccagcaggtccagcaccgaccggcccaatctttttttttccaaagaaacaatggcccaattaacaagattgccccgtgtggacgtgtggaggaataagctcattttgactctcttaaaccacaaaaccgaatatctcaacccctaactattaaaaccgatgcaatctaactccctcggtaattttggagggtgatttcactgacgtgatgcctacgtggcaatgttgacccggtcttcgtcctacgtggcgttgacgtgacacatttgtgtcattagaattaaaaaaatatgtgggacctatttgtcattaaaaaaatatgtggaacccacgtgtcattctctctcatcccctttttcctatagatggccaaagggcccgcccggcatggcccggcccaggcacggccgagcacggcccagcagcaatcgggccggcacggcccgataggcacttcgtgccggggcgtgccggcccatgggctgcacctcccgcccaggcacggcccaccagttgtcgggccgtgccgtgccggcccgaaggcatgggtggcccatcgggccttttttaaaataagtctatttttcgtccctcctctttggactatttcatatgtatagctaaaataa

SEQ ID NO: 13336 - DNA, 3919 bp, Oryza sativa
ctttcgactgcagctgcctgtgcgacgctggcaatcagccggagtggtgtggcaatgggcgagagggtgggcgttggagcggcagcggtgggaaaaccatggacggcatcatggccgtgccaagtatatacggtagggaaaaccactgtccaggagctgtactggcaatctggagctcaccggcgaggagaaggaaaccgtgcggaagctgatggacgaacacagcggaaaggttgatctcggaacgtatctctgggagaacaacctcaccatgacattctcctccaacctcgccagcgcatcgccacagccaccgcttctgcggaggccacctacttcgacaggagcaccacactgcgggtgctctgtagccatggccagctggcgcaggcgcgctctggctcctcgagtcctcctcggagccgcccgacgaggatgcctacgtcgcgctgttccggctccgcgaatggcaccgcgcggtcgacggtgggatgcagggtgtgcgcatgtggatgccgagcacccgagcttggttctctgcctcaggaacaccatgctgagcacgctcgtcaggttcggggccatatggtacgcgtggagggtgttcaccgaatgcctgagagggacgtctcaaagagccagaaagaaatagcagtggagtctaagcaaactatatagagttacagtccatgctgatcacggacaagaacgacgcgctgatgagcacggagtaggaggccatgctgagcacgggccgcatgccagggtgccgagctgggggctcgtcggactccacgtgcttgtccaggtacggggtgagcatcgacgcgtcgaggtccgactacagtggtggtcggaagctcgaggccggcgccggaggtgatgagaggaagaaggagcagatgaagaatattatgcgaacactcaaggggatcatcctggcggcagcaagatggacgcgcccaccgtcctccacaaggccgtcaggtacctcaagttgctcaaggtggaggtcaagaagctcggtgtgcgtagctcaagcagctaagtgtgctaccgacagacccgacatcgacaatgaccttgctcaacggctgacggggacgcggatggagtcaagatggagagggcggcgggtagaggcaccagagagaaggccgcaagccaccacacacttctccatgccatctttctctctatcgagtgacgtccttctcctctcccgttgaccgttgggcgccgccccttttccccgccactcgtgatgccgtccttcccgacagttgtcaccttacagggcaaaggggagagagagaagagaggggaaagggaagagaggggagaagagagtgttagccactgacatgtgggccccgcatgggtcccacgttgactcggcttgccacgtcagctaaaagccgagcatgatactgtctacgatatcggatgatcagattttataaattaagggatccattatatctggtatttcgattaaggacaaattccaggctcgacgacaaaatgagggacctagagtgaacttatccttcctatatggacccaagaggcccagactgggtcaatcctaagagcaggtacaatagcagactattagccagctacaaacatattttaatgagataaaagataagagagaagagcagcaagctacatatctgtagccagttgcagcacggactccaagatgcaatgtgtgtataacaggtgggaccatatactaatagtatagtaagcaattattgtatgaattggctatagatgaattggagctagtagtgggctatattattaaacttgctctaacagtgacagtcaaaaggggccagcaccggcgtcggtggtggcaagggaagagcgagcgcggtggacacaatggtggtgttgacgggagctcgacagcgttggaagatcggaagagcgagcgcggtgttggcctgttgggaagatttcggctccgactccggcgagggcattggtggaatgcggcggcggggacacgtgaggaggagcgaggaggcgcggaggcggagtcttcggacgggcgaaaatcgcggtcgtggtggaggagggggtaaaatcgtgggtggacggtacggattagggattagacgatgcggaggcgatgcaaatgaggatggatggtagggattaatgcagatgatttggcatgtaggattagagggtgcaactcctccttttttatattagtatagatttgtgtagaaattatcattgcaagagagatggctcattcacgagtgcagatcctctacagtactactggtgcagtagcagtggctgacgtgtggacaccagcattactacaggcaatccccgttgctcattcactatttcatcccttttctcttccgagctgttggccacttggcccaatagctgggcgtgtatcagtgcatgcatactgaagtagtactccagtacggagtaccagtgtaccacagctcttctgttcgctcgccctgccacgattttggcgccgtgtgctgtgcctgtgcgctgtactgtgatgatcaggttcacctcgtcatacggcgacagcgtcatgtcaggtgtcttcatctctgtcgccatcatttggcccgttttcggtgctttcatctggttgcagcttggtgggctggtccagtaggtaggttacgggctggcctggttcttccatactcaggtccactaattcaacccacatatgaaaaactggaaatggagtaaagctgcgtgaactgtactattattaaagaggacatatccggtgaaaatgagctaagtgttgaaaactcgtgaaaatcatacttaaaagtttcgtaaattcatgaaaaaaatattagagatagatgtagatataaaatacattctcaccaaatctcaactccaaactcaagttcgtttatgagaaacaaaaaaaacaaatttcaggtgaatagtgtcctgttattattcacctgaaatttgtcttttttgttacttctaaacgaagttgagtttgaacttgagatttggtgagaatgtatttcatatctacacctatctctaatatttttttcatgaatttacaaaacttttaggtatgattttcacgagttttcaacacttagctcattttcaccggatatgtccccattattaaactactaggtgatctcccgcactttgttgcaaaaattactaaacaattctcaatatatattttgagacaatgaatataggagttaaaatgaaaaaaaatgaaattctggtttatcagtacttatcatgaaacaaacaaatgatacccgcactttaatgtgaaacatattgataagtataatttaaatattataaaaatgatagataggtttgttaaaatattgtgtaaatgatgtaatggttgataattggatatggttacatgttgatttatagaattaaataaattgtagatgaagtatgcttgcattatgttaaatatgtaattattgatagtgagtgatgatgtgttattgttgcgcgttgagttgtaaatttagcggactataactttattatagaaaatataaataggtagatacatcatatcatcattagtggtaatcataaagcttagcatagttgtaaatgttactacttcctccgttccgataaaaaacaaatctaaataaaaatgtgacatcacctataatgaaccggataatctcaggtggtatcacacttccatctagattggtgtttttttttttgacagaggtagtactatgtgtttacacaggcgagttgaacaaaatactagttgtatttttttacagaggtttcgcggtgaggaccaaggggttgattgggaaaatatatagtacaaaccacatatatagtggaaacttagaaattaccattggatcgagaa

SEQ ID NO: 13337 - DNA, 4779 bp, Oryza sativa
  unsure (1)..(4779): unsure at all n locations
ccctgcactacatatacgtggtttccaattttcccggatgatgagcccaggcgacaaacctctcgactcgacgacctcgaaggctcgaacgactggacgtcctgcccatcggggagctcccactcaaaccagcacgccatgttcgccaccacgagctccgcgagccgcgtcgcgaacgccatgccggggcaccccctcctgccggcgccgaacggcatgaaccggaagtcgccgccgccgccgtagtactcgacgccggcgttgtccccgccgtcggcgaacctccccggcctgaactcccccgcgtcctcccacgccgcctcgtccctcccgatcgcccacgcgttgatcatcacgcgcgtccccgccgcgacgcggtggccgtggagcaccgtgtcctggatcgcctcgcgcgggatgagcagcggcagcggtgggtggaggcgcatcgcctccttcatcgccgcccggaggagcgtcatcttccccagctgctcgcctgctcctccttgacgatgacgacggcgtcttcgtctccttctcctccgtgtgcagctgctacgacatgtctcacctctgcttgcactttcgccatttctgctgggttcttgatgagctcggccattgttcattctatcgacttgtagactgtgtccgtgcctgccgcgaacatgtcctgcaatgcgacatgaaagaaatcgaaacgaattttagcatgattatttgattggtgataattggagagaacttaccaagatgaggagtcccttgacatcgatcctgtcgagcttgtagccatggtcgtcgccgccgttggccatggagagaaggtcgtccatgaggtcacgggcctcgccgtcgccgtcgtcgtcgtcgtcgtccccgcggctcggctcgtggtcacggagcaccatctcgagaacctcgtcgagcttggccgccgtcctcttcgtcctcgcgtcgagccccgtcgcccagtccacccaccggagccgcgggaacatgtcgctcactgcgatcgtccccagcaggtcggcgagctcccccaccgtctcgcggaccttcgccggctcgacgccgccgagcttcttcccgaacgccgccctcgacacgacggcgtgggtcaggccgacgatgagctcggtcaagttgacgacgcctccgcctccgccgctcgccgcgcggatccggttcacgaacgacgcgacctcctcctcccggagggcgcggaacgagtcgacccgcctcgcgctgaggaggtgcacgacggcgacgcggcggaggcggcgccaccgctcgccgtaggggctgaacgcgacgtcccggcagccgtacagcgtgccccgcgccgtgtgctgctgcggccggccgcagaacacgtggtcctggtgcctgagcacggcctccgccatggacgccgaggagacgacgagcgcgcgcacggagccgagccggagctggaacagcgggccgtgccgccgcgcgagctcgcgcagcgcccggtggtgccgcccgcggccgagctggtggaggttgccgatgaccggcaacgccggcggcgacgtgatcgccgcgccaccacggccaccgtccgcgccgcccgatctcaggtagctcctaaccgcgacgaccaagcacgtcgccaagaagagaaagccgatgagcaggccggagtcgagctgcacggccgccatgaacagagctcacgacacacacggtgtacaatgtgcaagccttcactgatttccttggtcactttagagcaggtacaataacaggctataagccagctgcaaacatattttaagaagataaatgaggagagagaatggcagtgggctacagatttgtagccagctgtagcacagactccaagacacagtgtgtgtatgacagatgggactaggtattaatagtgtaatatgtaactattgtatagatgagctattagattgactatagatgaattggagctagtagctagctggctatactattgaacttgctcttagacatgcaactagcttatgcacgaacctccaaaaatcctatgtggcccaatcaggtgcaataacatggacctcgatgacatcctataggacacgccagcaatcatagcaaacttgcctatgaaatatctgggtctccccctgattacaagccggctgagaaagacatacctccaaccgcttgtctacgcagcctccaaaaaaaagaatagaacgcttcagcaggcttcgcaagcggaccaatagcttctcgacttggacctgcaaggaaatgcgggctggacgacaaacctgattgaccaacttatcggggtttggaacgcactacacatggtagagcacgaggaggacaatataacatgaaagcttactaaccatagtgaatatatgatagtgtcatccaaaacagagtctggaccttcgccaagttggcgaccagaggttggccaaatggttccatctgccccttatgttgtcggacccagaaaacaaccctgcacctcctcgcggaatgaatctagcggcattagcggagcgggcggcgtgcggacgaataaatcctagtcagtggtggcaaactttgacggtgatagatttttttttgactaaatcaccggggggggagagaatccccacctgaatatattgagccaaatgatcttacacagggcaagctttacctacgcaagcgcaggggccctggaggataggagaacagaatacacggagaatacaacgaggagagaacagagaaagaaaacctcctaaaagattataattgatgaacgacacctgcaaaagttatcttgccaaaatacaagaggcacccaataaggcactccgcactttgatgctgttggtcggctagaagatatggaacgaaaggaatcgcataaccttccaacaaaaggagctttcagctacctctcttctagccaagatcaaggaagaggccaaaacttgggccttagcagaaacgaaaaatcttcgtaattagttttcttttagttagctcagaccaaaggtcctaagcttcttttctttcctttcgctttgtaaagctactccttctcaattcaatgaaattggcgctcgtcaattcattaaaaaaaagatatgcactatagaagttaagaagtacgcatcaacgcatgggcacagaaaaaaaattcaggcgggaaatacaaatgcaaatgcaaatcgaggaggcaaatccaacatggcggggagaggcatgatgccacgtaatacaaccatggatcacattaatggcgacgacgacgttggccggtgccaatttttccacaggggatttgctagatttcaggcacgtgccttttccccttccatatgcagcattaggacccgtttagatccctgccaaaatttttcaccctgtcacatcgaatgtttggatacattcggatacattcatgtagtattaaatataaacctaaaaataattaattatataaattgcgtgtaaattacgagacgaatcttttaagccgaattgctccatgatttgacaatatgatgctacagtaaatatttgctaatgacatattaattaggcttaataaattcgtctcgcagtttacagacaaaatctataatttattttgttattagtatgcgtttaatacttcaaatatatctctgtatatcacacgccaaaacttttggacctaaacacggccttagttgctggttggaccatcgggcctgggcttctataaagattgagctaacttttggggcttaatcgtctgatttggcccaacttggatatgggccgtttacaacatttggccccacacggattctcaagtcttacggggacggacacacctcatgcacttcatgccatctcgaccgtccaaaatgcaatcgaacggatgccgattcatctcaccatggacgcggtccagccaagcaatgccagcataaaccgcgtgcacctggtttatgtgctggtgtgtcctcgccgccgccatcgccggtcaactccggttcaaaaaaaaatttagagagaccaaccactcatcgtctctctacttccatccgcttcaaccttcaggtgcgccgcctcgccctcgtcggatccctagtagggaggggaggtctccgtctccggcccggggggaagnggcgcccgnggccgccccgcccaatggaccgggtgggcgtgcgtctgcctgcccccccactccttgattggatcgtgtagcacttgccccgagctgttcccctaggtcatcggagggaatgcgatttgggattgggcgggatgcaaaggaggcgtccttttgggttctagggtttcgcgggattgcgttcccctgttatcctcactgatttgttgttgtttatcatttcggtttggtgaatgcgatttggattggggacagtttgctgtgtgctacagtgaaaacatggagattatcgcaggatcctcagacttctctattgttttttttttggattgatatagatgcattgtcttgtttatgaggcccggtgttcggaccgcgtcatacattcgtggaacagtgtgctcatgccttcggtgtgagacgaaaggttgtgtcttttttttttttttggttctctggcaggcgatgactgaatttcgtcactagcttgtagtgttgtaggcttttgtagcttggtctgtgattgtatagtagaaggatgacgcttctgcattgattttagttcaaaggagatacttttgtttttgccatttcgggggggggggggggggcgt

SEQ ID NO: 13338 - DNA, 12343 bp, Oryza sativa
tttttttggagggggcaatgattgaatatcgtcactagtttgtagtttatgcttttgcagttaagtttgagattgtctagcagaagtacaacgtttttgcacttcattatagttgaaaggaggcatctccctgttttctgccatttctggtggtatggtacctattttatcaaatctttgttggaaagacattggatatagcctttgggttgaaattttgctaattttactattgttagcttgtctttgggccatcaggtatgcatatacatctctgaaagctagaggttgcccactgccttgtattcctactttagtacccttcacaaaatggtgaaaaaagactattgttcttagtttacgtatcattgtgaccagcatttcaaattgtgtcagaagagcatagttttgaacatatgcctgtcatccataccggagatcaatgtctcttgatttttgtaagctggtgcatgattggtattagtatagatatacagttctgagaaactacattttgttgtagattgaatcgtggtttaggagtacttgtctcctcaggattaattggatcattctttgggatcattttaatgatattagatgtgcctttacctgcatttggtgtgttgctggttaattatgccgatctatatgggagttcctgcagttagtgttcttgaacaaatctgcttcattcatctgtcttaactctataatcaatatttctgcaggacatcctggataattgacagccatagaattgcttcaaaaataaaaaatgcatctggatcggtggatgccagtaagcacaaatgggttagcaacccaactaaggcttgtccaaggtgcaaccacatcattgataacagtgatgtaagagatgtgttcttttatcatgtataagaaccaaatacgcacgtagtatatcatttgtatttcattcctgctttataccattctaaacagattaaacaatcaaataaaactacatgtgaacacctactgagtagtgtcattgttatgcacctttgttttcgtcgagtcgcctatatcaataaatgaatggatttttgctattagcaacttactatttatcactttgacagtgactcttttgtatattattctgaagtcctctgactttctctctaacatcgaagctttgtttgtgtatactttcagatacaccactcagtattaataaataatgtgtgctattgagtgcagtcctctaatgattaatatttcaccacaggttgttcatcaatggcctggtttgccaagaggtgtaaagtttgatccaactgaccaagaattgctttggcatttgcttgcaaagcatggcaaagttggtgcaaaagctcatccgttcattgatgaatttattccaacagtcgaggaagatgatggtatctgctatacccatccacagaaacttccaggtaaccgttagtgaaaggatatatatttttgtttctctcttcgtggggtgagcaagagaagtccaattttattttcatataagagtaaaattcacatttttcagcttgtatcaaatgcttgcctttggtccgttttcttttggtatttattttcttagtcacaccatatgcacaaagtttggcggtagtgcgggtgtggcaataaggctacttattttacttctctttattggcttattaacccttgatttttcactattccactcagcaacactctacaactaagtaattctcattgactggtttgcatttcttaaatggttccgatagagcattcaaattctactttcttttgacataggaatctcagtttctaactggaaaattgttgttttttgtacctctgttgtattgcttgtggtattcttcaactgacttttttttctttttcaggtgtcaagcaagatggaagcgtatcacactttttccatagaacatttaaggcctataatactggaataagaaagcgccggaagataaacactggtgatcttgctgatgtccgctggcacaagactggtaagacaaggccagtagtagttgatggaaaacaccttggttgtaagaaattcatggtgctatatatgagcaccatgaaaggtggtaaacctgaaaagaccaattgggtgatgcatcagtaccacctaggaactggggaagatgaggtagaagggcagtatgttgtctctaaattattgtttcagcaacagtttaaacctggggagaagaacgcacaggacttaacctctgcagatgctttagaatctatagttgctgaagatcttccaaatattcctccacttcccctggaagaacatgtttttaccaaccaagaactagaagttcttgagaaatctgaaactatcactgaccaggtaattgaacatctaagctttctttatttcccttccaccttttccctatgtgcagcacatatttccaggtaattcgacatagcaaagaaaatgtcaatatagtttctttataatgatattaaagggaattggataaatgttgtgccttcttttgctggcaaatgtacagggaaaagagactagcgaaataaacaacgaagataacgctgtagaagatgttgcgcatatggctactgagaaacctgaggatggagataacccctcatcgcaagatccgaaatggtgggaaggtgaatcccagttcctgttagactctcagcaactggcagagaaccttgcgatttgcgatgagttccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatggcattaatttgatacgtagaacggttacgaatttaataagttattgttttcacaatgactaggcttatgaaatcaaatatagcacaacaacacaggctaaacatctaagcatcaattgctggttctttccatgatgccgtgacaattatcacaaactggttctcataaactctagtgattttatctctacctgacaaaaccaaataaccaaatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggagaatccttcgcaaacacggtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttcctttggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattttaagtgactctcctttttccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagaggaggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcggcaggccgcagcggggacgacagtgacgccgaggccgagggcgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcatgcactcgttagtgctaaccagcgaccatccttttttaccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaagatttaattgcaacaaatacaatggtgtaatcggattgtagatcagataagtaatttgaaagaaaattttataagaagggagaaaaagacatagatgcctaacactacgatgcttctctcaaattctaaactctgatgcttctcgactaaatcggatggccgcgccaggcgtcgctgcgtaagactagatcgagaggcctcacgttatagaatttacgttcaaatatattatattatcagagtatttggtgccataaatataaatttttattcttcataatataggtattattatttataaataattcatgctactttgcactccggtcggatacgccctaactatagataaagccctgatcgatctccatcctgaaacacacgcaaaaccgtattctaattctaattaaacagaaactcaaatcacgaagacaaacaaacataaaaaaccgtttgcattacaacacaacccaaataaccttcctgtcctcctccgatttaggtaggccccaccggacagtgactcgaccttggcggcggcttatatataaaaacacgcaaagttaacacagcgcggccttcttcccggggatcaggacgcaacatattcacaacacgcaaggtctaatccgaaaaaagggaaaaaaaataccctcctcgcacgaaacgaagccaacccccaaactccgccgtcaccggcgaccccctcccctcctccttccgccgccgccgccggcgaggcgtatcccgccggtacatctagagaagaggtggtgggaagggtgggggttggggtgggagcaaacgaggcggcgagacatgaatttcttctcgggggtatgggtgaggacgatgatgaagcggctgtgcaagtcgctgctgaagaagcggctcggggatctgatcctgggggacctcgacctcgaccagttcgacctgcagctcacccgcggcacgctccacctctccgacatcgccctcaacgccgacttcgtcaaccgcaaggtgagcccctctctctctatctcgtgccccgacccgtgtgttcgattaggatgcacccgcccgtcgtgattagtgtgctatttgcccgaggttgaaattctggtggcagagatgggaattgggtgtttggggatgggaattttgtttttttttgtttttgttagaaaaaagaattttcctgtttagttgcttggtggattcaactctgtatgattttgatctcgattggttgctagcatgagagtgtgggcttgaaattttggtctagaattttttgttgcagaggaaataatctgttcgcaggaaaaaaaaggaaggctttttcctttcaatcagtaacctcgggtatgggtacagttcagggttatttgtgttcatttcatggctaaagctcatgatcgcaggtagagtattagggtttaggagaagtggagaaggggttataaagcttatttgcaattcacctttttcagttggagtgttgggactaatccgatacagtgtaatgtttgtaaattatgttgaatgcaaagcttctagaatacaataaagttaacagaaagtatcaaagctggagtaggtgattgttcttttctgctaacctgatttgttgtggtgagtagcatacagtagtcctcttatatgtgcatgaattcaccactaaagacacatctatgttcaacattttgcgatccatgaggatcatggcgctgctggtagcccaatatgatacatttgttcattcacaagtgttgcatacttgaatagaaacttataccgcaaaacttgtgaaacccactagattttgggttttccagttactttattaaaacagttctatttttttccctttccagttgtcaggatctgctatcatgatgaaggaaggatcgataaaatccctgctagttagaattcctctactattaaacatgcgcgactgttgcgagattgtcgtggaggatttggaacttgtgcttgctgcatctgtttctagcgaagatccttctggtgatactgaatgctctgtttctggtagtaatactgacgacacacagaaatcagtccaggccaaaagaaatgaatctgatggcaatcagtgttctacctctgcatctcgagatgtcgacaaaggtgtccagaggatagctaatgctgtcacatgttttcttaccaactttaacatcaagttaaaaaactcttatgttgtatttgatcctcaaaacattttggataacaaggtcccagaatttaatcgatcactggttttccgaatcaaagagaccgaatttggaaccaatctttcaacagatggtataatcaaacttcacaattttgtgacattccatgaggcggtcattgagtttttgaagatggatgatgttgatgcgcatgcacttcttcaggatgatttggatagaggaccagcagacatttcatcaggtcatagcactaccgcggtcttgacaggtcctatcggtggattctcagggaaattgaacttaagcatcccatggaatggcttgaactttaagaaacttgatgcagatatatctcttaattcattagaattgcggttacaactgagcagtatccaatggctcatggatgtgtgggattctctccaaagaagaaatctagtacatgaacagagttatgcccataataccgcagacatatctagatctgccagttcatatgtatcaagctcttcaaaatcaggttcaggttctgtgatagctagcagggaacatttgacagaggacacattttctcaactcaggcaagaaaaaacacaagagccttccctgactatgccatacttgattccggactggattccagtgcttatccatgaggatcacggtgaccctgattcagtttgtgatgaaaggtttgttcctttttgtttttcatcttcctttcttttcatgaaagttcaatgatattcactgcacctttgcaactgccatccttttttacatatagacatttcatcaagagtatacttttgacagaactgttgtcaaataaataatttttgaaatgaaatgcatttgcctcccatttgtatttccatgaataggtttggccagatgtattacacagaacttttctccccatcttcgttatatactatgtactcttgaaggttgaccatggacaaatcctccttttctttccgtgcaaaaaaaagaaaaacatttttgggtgcttgtgcaagctattttcttgctaagttacttgcctttaaatttcttacgggaagcagtttgtttaaaccaaataaagaa

SEQ ID NO: 13339 - DNA, 7278 bp, Oryza sativa
attcctgcagccccagatcaaattcctaaaggtactatggtttaaacctttcaattttctattggttgtccacattatacacttctcttgcagggatacagaacccttatcatatggatttatttattgttcttattgtgcctgtttaccacatatttttttctcctgacactctttcctgtggagtattcttggacaatgttcttcagcttcaattttcttttactcttgaacatcattcatatcaagcaggatcttttgcactttccatgaaagacaatgtttgactgttagctcctgagtagactgaaaggaaaatgttgtagaccactggttaaaataacagttttgtctggtgtgtagtaataatacattgatccactgaaaacatctcctgttagttggtattacactggtgatactcagggaatagcactgatactcaccaatgaaactgcacggtacaatttaaagttattattgtaccatccctaccttggactagtccaccttatacaaaaccatactgcatgaactgaatacttgaaacatgcagaaaaacgaaaattactgttatctcttgaatgaaggtcaggtaaaaggtacacatgctaggttatgttggcttatgaataatgacagatgttatatgttctaagatacagtaacagtctggtatcaacagatgcaacttacgagtaatgaattctctccattctcttgctattagcaaacctatcaagcatgtccaaatatctgttggatgtatttctggcattgaaccaagtatctgcagtgttttactttttctggctaaattatcagaacatttatatattgcatcactttgttacttatttttccttttcatttcctaacagaaccgccgatagagaaaaccttgcgggcttccattgctgagatatctgttgttcttttgttcagtgatgaaatggatgctggcaattccagtgttcctatcagtcaattcaatgacatgagaaattctgaaatgttttcaagctgcctttcctttgcacattttgagcaatcaatgatatctcctgctcctgctgccagcttgaatatgcatcacgttgaagccaagtgtcagaacattcatctttccctggaggtctggtctgcttccaccaatagcactttttcgtagtttatatctcctaattttatgaagcttgattctaatgttatgttcttgatgtttgcagacatatcctgaaaacctaagtctcaagggatcaattgctgctataaagcttgatgaatactatggcagtaagaacaatgattcagatcatccaaatcttggtgctgctttcttgaacaataatttttgcagagaagttcaagcttctctccctcaatctgtatttgcttatcaagattaccatgaggaaacatcacgccgtcataccaacaattcaaatgacctcactaaggtcgaattgctaaacacgtttggtgagtgcgtattccactatgatgtcagttcctcaggtcaagatggcaacccagtaagctcaacttcactatcagtctgtttggctcctttggtttgctgggtgcactttcacacaatatatatgctactgaattttatcagtaaaatcgagtctgatgttttgcatggggaggataaaattcataggaagaatgacgaaaaaaatgtcaatttgtctatgaagtcaaatgtttctttgggaggaagccaaaaggttcagatagccctgtcgcctgcaagagtcatcttttgctttccttctgaatcatgggatttgagctgcccatccatgctggataagttccttgtcattgaccacacaccatctctgaaatcaggagcagattcatctccacatcaaaatgaaatgcctaatgatgtcaatgcaatcacaccatctactttggtccatttggctacagggaactttgacatctatttggttagaccagttaatgatgaactgaatgctagaacctgttctctgagtaggcaaactttctcttctctgaagattttctctgttaccggatccaattgtcatgaaactggcattacgatgctctggaagaagtatcctttaaaagaccctgagatggtgagcaaaacttggagtttgccaaacctgcatgagcaaaagattgctcagaacaaaaatggtaaatgggttggtgtttcctcttctacaacctcagaagatcttgaggaatcaagttccagtatacgcagggagctcctccggagcacagagtttttgttgcacattaaactttcttgtgtctcagttcatctcagtaagaaggactgtgggatactaaaccatttgctaaaaaacatccttgatggtctttcagatggagcaactggaaattttgaaaatgacagtgacaattgtatgccaatccatgatactgctagccaaacatctgtcatttttgaatgcagcatcttggatatctgcactgaattggatgaaactgttgaagttggtcctttattgcagactgaactagaaggttcctggaactgtctcaaattgtcaatttcaaaattttctctgctatcctcttctaatgttggcggggttaacaatgccaattttctttgggtcaatcatggtgaaggtgagctctggggctctattactggtacggatgactatgaagaaagcaaagatgttcttctagttgtttgcaaggattcggcaagtagacgaggtgatggtgaaggtagcaatatcttgtcttttggaactgcgggctgttctgtgactcatatcatgaacccaaagtttcagaagaattatacttctatcaatgttcgttctgcaacagccgttgcacctggtggccgcatggattggataagcgcgatttgcctattgtttagttcagcttcagatggaactgaacaaccagctaatagtagcacaatgaacgattcccagggtggtgaacctttttcatcactgttctttcttgagctggttgatgttgctgtgagctatgaacctcatttcagaagttctgcactcagcgctgaaactccagactgcaaatacttttcatgccttttagctgcatcattgtttaaacttcacagcaaatctgcatcaaactctacagctactgattttgatatcgagctgcgagatctcggggttctcatttgtggatcctctagttttaaaaatgtcagttgtggctatggtgcagattacctccgtcggatgggctatgctaagattgtgcagaatacattcattgaagctgttctaagaattgatacttccttttggaaactcgaattatcagactcgcaattcgatattggtacttgtcacgatacgacacatggtgttattcaattgtgctcccagcttcagcagctatatgctccagatatgcgggatgctttagatcatctacaatccagatggaatagtgtccaacaggcaaacaagcaaaatatgggcactgatgtgtcagaaaagtcagagagtagcattgataatctgacagattcagaggagtgcaagtcagatggtttgcttgatgatataattgagaatgccttttgcactgaccaggacttcgcaagctactcattgagtggtagcgaaatggatgaagagtttggcctgagtaaggccatcccagaggcaaatgatgcctgtatttcacttgaatcattactagttacccctgaagccagtactagtgatgatctaataattgaatcttattatatgccaccttcgtcatcatcaactctatacaatgaagaccagggcaattgtgctcctagaaccgtagagtgtgacgaaggtgaatggtataataattttcccacaatagatgaaaaccatgttcaaaggaacaaaccacgagaagagcaaatatttcaacaaaaactgaagcctgctattttcatcttgaattctgatgaatcgtgcagtctgaaaggaaaggttcttattcatgatatagatgtcaagtggcggatgtacgagggaaatgactggaaattagctcagaaagatacgattagccggccgtgctcaaatggcagagacaagaggtcttatttagagtttattatgtctgcgctcaatatccagttcaatatgtatccagatggggatatttttgtttctaagctatccatctctgccaaagacatcaatatttgcgaccaaagtacacatgctccatggaaaatggtatgcatttttctgtccaaattatctagaatttactattaccactggactaatggtttctaaatcctctatccattttcgaatcaaaggttcttggttgctacaactcaaaggattacccgagagaatcttgttctagtgcattcatgttagaactggagtctgtaagacctgaaccacaggctcctttggaagattacaggtaaatatggtgtttctttacactgaattaaactatcagaaaacatttgtgattttgcttgtttctgttaatccatagtgaacattgcgtttgcctcatacttaatgggcttgcattgttaaaagaaactacaaggctacctttttgtgccctcgatgtatgaaggcactcattgcccaggtagatgtaggaaaaaacctatgtagtggactaggttccacattacagatcatattgcaggaataatttctagtgtacccagctatttgacttttttttttacctcagcacatggtaatatgcaagatgatgagtctgagctgaacaatagaggcacatttctgaatgtaataattagctcttttatgatgaatttatgtttctggattcgatataaatccagtgtttgtgtactgctgcactttgatcgcaattctgtaccctcaagtccaattcaaggagtaacgtaaaatagcagatagaacatgaaggtcctttattaattagtgttttttatcatgttagtatatgataaaatggtaaatttaaaattataatggtgatacaaatgagatagagcttgttaacgagcttaacgatctagcttgtgagccgagctaagctaggcttttagttctctaaggttaacaaactgagctgagttggctatacaccccacacgtcaacaagtttaacttgagtgcatgtaaaataaagaaacgcatagaagatggcagatccaaataaaaaaaaatcatgcatgcgtggttcttttggcagatattatttcacccttttgccctttagccctttagccgttgctccacacacattttgtgtccatataccatatctgaatgctgaagtataagtgagtttgagtactggtgtcttttttctactctctatttttggtacttattttagactcagtatgatgactgatttccttgcactatcctaaatatttcaggttacatcttgagattttgcctctacagttgcatcttgatcaagggcaacttaacttccttatcagtttcttccagaatgacttgtgcaacaaccctaatttggcttgcgaaaatgagaatattgacgcgcagagtacaatgtatcgaagcgatacaattgctgatgaggcattacttcctttctttcaggtatcttgaagtttttcagtttttatttcctctttttttccccactcatggtacttgagatggacatatggttttaattttttttctcctactttacctgatatattttaacaattgtttttacagcaactattagtttcttttcattttcaaaatttttctactaattagcagcatggatcttctttgtttagtaaacaatattatggtctaatttatttcttttgatgctagaaatttgatgtgaagcctcttgttctgcacattaattatattcctcggcattttgatcctgttgcacttagcaaaggaaattatgcagaacttctcaacatttttccatggaaggtaattcattgttcagaactatacatcatagccagtcgtatctttgtaggcaaccctgatactaaatttgctgtgcagggaattgatttaaagctgaagcaggtttctgccatgggtgtttatggtttcaataatatatgtgaaatagtagctgcagaatggttagaggacatctcaaaaaatcaggtcctaatcttcccacacatatcttacatttatattaaagatgcctgctgttgtgtacaccaataccgattcaggacatgcaatgctataagagagaatttaaaatttgcatgttggcatacactatttcttcacaaaaaaggagaatcttatatcttcctgtcttacagatgattttctattctcatttgtttcaaaaattttctattctcatccaaatcgacaatctgttccttgtttaggtccataaattgttaaaagggcttccacctataaaatcattagttgctgtgagttcaggcactaagaaattggtctctttacccataaagagctataagaaggatcggaagttgctcaagggaatgcaaagaggtaagccacatatagctgcactactatgctgaaatattttgtttgacatttctgttgatgtgttaatatatgatggtattgtgaaattcttgatgtcatgcatccctgattacacttgatggtgattgacaggtgcggttgctttcattagaagtgtgtccattgaagctgtggggcttggtgtacatttggcggcaggagctcatgatatgcttctaaagacagaaagtgcccttacagcaattccaccacctttagcctcacgtgaagcaaaaagaaccaaagacaatgtaagagctaaccagcctgaaagtgcgcaagaagggctgaagaaggtattgaattcatccaaattgcacatgaactcatcttttctgagatgaactcatctgttgtctgctaataacatgttgctttaacctaactatttgcaattctatttttgtttgtgatttgcgtttactttctatatcaatatggtaagtactgccagtataagtttcatttgctgtgtaattatcaataattcaatatatgctgaacatttttcaggcatatgaaagcttgaccgatgggtttggaaggactgcctctgctttgattggaaatcctatgaaagtttataatcgtggggctggtgccggatcagctttggctactgcaatctgtggagctccaggtgctgcagtggctccattatcagcgtcttttcgtgctgcacattatacacttcttggtataaggaataggtgatttcact

SEQ ID NO: 13340 - DNA, 20294 bp, Oryza sativa
tttcccccatataatggtgagcaagatctcaaggtctgattgcacaaattctgaatagttttctatttgagattggagggagtaatacaaatagatattaaaaagatttgaaaatagaaatatattgacttgcaatttactgtattagtatatttttgtcttctgttggaactggaagaagttagcaacggaaggtaacaaagttcatggatctggacagcttaggattaatcaataaaacttcgtagctaaataactgtaactgacttgccccaaatgaaaaatgtatatctatgcaaaagaatgagaatatagttgatttatcgtcctaaatattatcagtctgtgcactgataaaactatttgttactctgggtaaaatatgtgtttgagcaaaaacagtttatttacaccgaggacttatgagggtcagaaggtgcttggcattccctacattgacacaagctcacttaactgggagaacttgtaaccaatgatttttaactaggctcttacgaattgcaaaaataataatgtgcatgaattaggctaggcaactgactaggtaactatggaacaatctacagaaaaatctaattgtgatcttggtttgatttataatattagtggaattgagttctcttccgatcagcatcggtgaaaatacatatttgtcctatgcgaatgttacaactcttgagcatacttcatttttggcatgaccacagactgctaatgttggtttgctaatattttcttttcttctacattcacagccttgatcctgaacgcaagaaagaatctatgtacaaataccacgggcctcctcaattgtagacttccattgagaagaggtggtctgttcattcttttgcgagatctcgtatttacctggaagaactggttcaagagcacatgtgtgcaatctcatcaaagggtggtgggcaaacttgtacaggataagtcagatttccacactagcaatccaaccatttgtgaatcagtgccatctccgatgttcttgttggagttcataatccatctcctctgcaggtgtacagtttcagatgccacgtcgaaaaccttcatactgtaaattactagcacacgatcacggttgtaatcacaaacgtggccacccggagcgggtggaagttttgttgactccttgcttaggatttggctagagagagagggtcacagggagcttggctcggtggctcttgtacataaatttggtggtgattactgagtagtgcaaatgtaaatatctctcttgtttctcggttttccatttacgtttttgttggtttgagaaactgctcactgtaactctcactctacaagtgtaaatatcatcaggttttgtgctgctgcaatgagatataagcgcttgtttcgcgtgtgcgtgtctggagatgatcttttgtagtaactgatggaagtccaaattattacgcaacgcttctgctacctgaagtagttattgagggttatgtaatctacagaaaattggagatacgagatatgagaaggggtacagtattgtcattcacattctttcaactgtccacaaaacctctcctctccttcctttatatagccaattcttatacatggtacataaagcctctcctcttctttctttatagccaattcttatacatggtacataaagcctctcctcttttttctttatatagccaattcttatacatgtaaagtagggtgaggcctgattagtgtattgggcgttcattggccaagtttttcaacactctcctgagccgtcaccatgtattgcttatgcctcattaaagctccttaatgagccagtggaaaaaaaatagagaaaaagtacataacatacggtttgtgttgcacgggttgcctcattaaaaaccttgataaagaaatgcgggaaaaattatctaagggaaaaagagtacaacccctccaattattcttattaggtactttgtcattctggactaagtttggcaagtgagtcagtgaaattctcctcctgaattttacatttctctaagtttcaacatcccgatccctcagatgcacctttcaaaaggggatgttggtaatgacttagtgaataaatctacgatattttcacatgacttgtatgcaatactttaatttcgttcgtcttatgcagttcatgagcataaaaaaaacttggggtatatatgcttggtgagattgcttttcacgtaacccatttgtccttgtgcgacacatgctgcattatcttcatagataattataggagtctggatggtgttcaattcacatgattgctaaatgtggtgaatcattcgacgaaaccatgcatattcatgagaggtttcgtatagtgcgatgattttcaagtggttcatcgaagttgctactagattttgctttgacgatttctaggaaatttttgttcctccatataggaaaacataactagtttgcaacttggctgtgtgtgggttcgataggtacttcctccattccaaaataagtgcagccatgagtttccgtgtccaactttggtcatctgtcttatttgaattttttttataattagtatttttatcgttgttagattataaaacatgaatagtactttatacgtgacttatgttttttattttttttcaaaaaaaaatttgaaatcagacggataattaaaattggacattgaaacttatggttgcacttattttgggacggagagagtacccagcatctgcatatcctaccaaggtgaggtcctggttctttctgtagaacaatttcatgtccttactttcttgaagataatggaggatgtccttgatgcccttccaatgcctcttggtgggctctgtgttgtaccttgcatgtaagttgacgacaaatgctatatccggtcttgtgcaatttgcaaggtacatgagcactcctattgcactcaagtacggatattctaatccaaggacttccttcccttcttctcttggtctatacggatcttggtctacttggagtgaccttccgaccataggggttttagaaggatatgtcttttcaaagccaaatcattctaacactttctgtgtgtagattgactgatgcactaagaccccttcgggggtatgctcaagttacaagcttaagcaatacttagttttgcccaagtatttcatttcaaattcagatttcagatatgagcttgcttcttcaatatccttgagtgtcccaatgatgtttagatcatcgacatatacaaatattatgcaaattccatcctaggatctccgtataaagacataagggcaatcttcattgttgttgtagccctttttgcttaagaaatagctaagccgattataccacaatcttcctgactgttttaatatgtatagtgacttcttgagttgcacactatacagattcctgcttgctctgtcttggtttgggacatggaaatctcctaataccttcatgtgaatgtccgtgtccaagttccatagagataggtaattacaacatccataaatttcatttccaaattcaaatttactaccatagagattacgcatctaaaggtaattctgctcatgaccggagaataggtttctttgtaatcaactgttggccgttgggtgaaaccttgagctactagcattgctttatatctcatgccacgccctaaaaatcgcctaaattaataatccatattttaaatcatttttagaaattacttttaaagcctacaagttaaactctaataatctaagaaaaatttcaacataaaattgagctagataaaatttcattaaatactttgcttgtttatctattttctagatttttctgggaattatttgagcaagggaagtatttttaataaatgaaacatcatttcacgaattattttaattggaaaagttttaaaaatcctcctctaagccgttgggccgtatttggcccaacatccctctctcctcgcgcgcgccgagcggcccaagccggcccagccgacccgcttgcccctcctttcccctagccgccgacatgtggggcccacatgtcggggccatcccctacctccagccggctggtcgcccaagccgagcccgagccgccgcctccctctgccaaatccgcctctatcggtcgcccccgagtccgattagttgaggggaaatcatctcctccttatcctcttcctttcccctaaggtttcggagaccaatttcgcccggataaaccaaatcgagttcgttttgagtttatctctccaaactaacccgaagattttccggcttcgattcctctcggttggagtccgatctccctaatctaagcctataaatagcttcccctagtcgtcctcttccgtttgccccaactcccgagctccctcgtcgcttgtagcgccgccgccgctttgctctagccgccgccgtcgccggcgatcctccggtcgtgccgcaccgccgctagcgccgtcgccgccgtcgagtgcgcacggaggagggaaagctcggccgccccttcgccgccgtcgccggacaccgtagcgccgtcgccgtcgctgacccgagccgcgccgccataggacctcgtcgccggccgtcattcatcgtcgtccgtcgcgttttcttgcaccggtgagttcgcgtcgtcgttctctacgtgtagatggccttagatagcccggccgacccctctagcgccggtggtcgtgttgcccgcgccgtggccggcggtgatgacgtcatcatgacgtcataaatccctttttctaggttttctttattagatgcaaatcgattaaacttcggaaattcataactaaatcatcgtaactcggattcgagtggtccaagttgctaaatttttctaaaatcgagatctacatgttaaaaatatccacatgtactgtttatgcttgtttttgtactgttttggttgattttgttcttttgctttagtttccgacgttccggaggagagcgttttcgttgaggaaggttcggaagcatttgcggaagctcaaggcaagtaatatagatcccaaacaaccctttgagcatgttgaacccgtttaaagctaatgttttattttaacttatgcattattttcgaatgtcatcgggtggtgagcctttcccaattaattaatggccaaagatgtctttattttcctatgggtaataaattgattagcttgtaccttatatattggattggttcagttagatgctatatgtataattgcttagccatgcttagaaacattagctcattaatgggatgaatcatactacattattaattatggttatatttaatggtagctcacaatggttaattgtgttatgttaattaattgataactaaaacctgattaaggtgggttgtgagcatatggttttgatggttgtgctcatgacaattaaggaccggttcgcgagctactgttgtgaaacatttaccgtgccaaccacaagccagcatgggcaacggctttatcttttgtatagcatgatttattatggtgtgccagactgtgaagcggcgagaagtctgtgggggtcgctggggagtccattgcctctggttttgagggggagatcatgatccaggaacggtgcactgtgatgagttgtgttgtgcgaggggtattgtcacagttcctttccaaggtaccgtagtggtactgaggcgcatgatgacatgttgtggagttgtgtcttgtgggtacagtggtacacctctgatcagagtaaaactattcgaatagccgtgcccgcggttatgggtgagtttaacaatgtttttcgtgattagccccacactattcattaatgataatattgtgttaattaatttgacttttggtttggaatggtatattcctggtatggaggtttgatttgtacaaccggggttggttgctcagatgaggttgggcctatgcagcacgggtgtgttgtatagtgtttatttaatactgattaattattcaactgttttattattctttaaaatgtttattaaatgctgtttatgcaaatgagctttactatgccatcttttgttatcctgtgcacttgcatatttgctgtgtggcttgttgagtatgtcatatgctcattattgcaatattcattcgtcagaggaggagtacttcaatgaaggtgatgatctggaggattaggctttgttcgggtcgagttgcttgtggagtggagtcgccatagctgttccgttttgtttttatttccgctgcgtataattttattctttgagaggaactatccacctctataatagtttattattttattattgtgcgaatattaattagttgtttgttagcactctattatcaatttgttattgtgtgcctcggttaatttctggacgagggtttaacacacatgtaagcgtttggaattttggatagaaattctggacgtgacatctcactaactcgttattctgattttttctttcgaacaaataaccatttatgcccgtatatgaggagggatacggcttacagggtcaaatacctctcttttgtttagagaaattaactcgattgtgattgctttcttccattcgtcccaatccgaccttttcttgcattctgtgagtgatatgggctcgcagtcgagattcacgacagaggctattttcttagcaaagtagatatctacatttgctgttgctctatcaaatgattctcccgatgtgtttatggccatttcttcatgagctacttcttctgaagcttccacttgcttcctgttgttctctgttacaggggaaagttcctttagtttgctaggttctatgtgtgcacacacattgtcactgacaactctctcggtgggaaggtttaggccccctttgattcaaaggaaattcataggaattttagatgatttctttcctataggaattttttctatacagccctttgaatcaaaggaatggatcttatggaatcctatgaaattcctatggattgcctaatgccatgtaaattttggaggaattctaacatgaggtaaaacctcttggaaactttcctttaagtctttatctctcctctaattcctgcgtttttcctgcggttcaattaaacgactattcctgtgtttttcctgtgttttgcaatcatctattttacacttacattcctatcaaaaacctacgtttttcctattcctatgttttctcattcctgcgattcaaaggggcccttaggtctggtatgcctcttttcataggttccatactagtgccagatctccgctggctcctcttttttctttggatatttttgcaattggctgtaccaagccccctgtcccccttttctctagacgtttcttgatacttgaggatcgagagactggagttcttgtccttttgttctgaggcctccagactggatgagggttaccaatttcctttggtatttcaatctctccggtgcattgcgtgcatgcacatgcgacttggttacgctattcaaattacaaaaatggttaggcagttgattcactaaactttgcaaatcaattatttttagtacctctccatttgcttcattggtgcgtggatcatgcgcatggatccccatgtctggccatgtgatttccaaattttctcatccaagggttgatttcctccccataaaaaggggaaatgatcctcatcgaagatgcagtcagctaaatggactgtatgcgtgtcgcccgtcatgggttccaaatacttagttatatatgcagtctcataaccaacgtatatcccaatctttccgagtggacccattgctgttcgttgaggtggtaggataggtatatagactaggcatccaaatttgaacagatgggacaatttcggtgtgaccccttgcaccagtttcatttttgaatggatgttgtaggccgatgatctgaaattaataagatttaccacgtgtagggctgcatgtccccaacacgtgcttggcaatttacaaccttgcaagagtggcttggtgatgaatttaattcttttaatcaacgcttctgcaagtccattttgcgtatggacgtgacatatcgagtgctctgctttgattcccattgccatgaaatattcatgaaatgcttttgaaataaattcgcagcattgtccatttgaatggactgcacatgatgatcaagaaaattattcttaatttggatgatctgctagatcaattttgcaaagtcatggtttcgttttgatagcaggcacacgtgcgaccattttgaggaagcatcaatgagcaccatgaagtatctaaacggcctttataggtgctgtatagggccacatatgcccactgtattcgtgctaagaatgcagggatttcatccttcattttccatacggatggtcttgtgatcaatttcccggtggcacatgcatgcctcgcaaaatcttctcttttttttttctgaaaggaacatagaaagggaagcccctgttaaaaaaaaatctaaattgataattgaaaaaaaagattacaacaacctaatccagtttaagactacatctttatcaccctcattcaatctaaataacaaaagaaggagatcacccttgagggattgtctccaagaaaccaaggaatgaagaatattctcaaagaaatcaaattaacgtgcaatctccaatattacttgatctgaattgatgggccgcacaggtcctacatttgcacatcgtgctccatgtggctgaccgcagaggatagggtggagtccgccggtgatggatgttgtttgctatttttcttttgccggtgatggatgttgtttgctatttttcttttgcttgtcatctctatgacatgaacgaaaatgttcttacatttttttcgtgcttgctagatgatggatggctgctactgcgcaacgtcgagcccatctctataccacaccgctacacccttccatgattccatcgtcaaactaccgctcgccacccggttaccctctccactacccgtcacaagacacagactagcctctccattagcaaaaccaccaggatcctattttcgtgatggatttttcgctgaatcattttttttcttttgtagtgtgtggttaagcctgtaatttttttattcatatggctattttgtgatacaaattaacaatactgttagtatcagtttttgctcttatactgtgtattgaacacattagtaaacatattactacacgattgctacgagatcatgggctatatcgagaggaatgtggtaattcttttactcgcagaccacgaaattgaaacaatatttacaacactagtaaaaaaaattaatagcgttgtaagccggtagtagttcttttaccaccatctaggaatggtgccatatgatgtgggggcattcatgcaagtaaatttgttacttttgaatggggcattcatgcgagtaaatttgttacttttgaaggagcagatgtgggaggctgggaggagtagatgtgggaggctgggagtaaatggaaaacttcatagagtaaatccgttacttttgaaatgtgaggagatactagaaaaacagaaaactcggtaagaaaaactagatggtaaatattttactaaaacacgaaaacagaaaaactgaagagaaggaaccaaaaacggaaaaatctggatggttaattttttagcgggcgcttcgatcaagcacggataagatgtaaaagagaaaaaagaaacaaaaaaggtgggggtaaaaaaacaaattgaggaaaggtggtggtaaaaaagcggaaaaccgtaaggagggagcattgtgcggcactccaactaatattccgtatgcagcgcgtggattagcgctagggaaaatttcatctataccacaaacttttgagcggtacccaaaaaatagcatagaacttcccaccttcccaacaataccacagtagaacaggagcggaacggggcggcacgggaaatagcgcgatagacaggattacccctcaggcttatccctttcattcatgcactcgtctctccctctccaaaaccctaaacatggcggtagtggtggcggtggcggtaggtatagatgaaattttcccttagcgctactgtatgtaattattatatatttatatatatatattatacctgaattacaatgtagttacaatatagttacagtgagttactactattgtaactaatatgtaactagtactccctccatattttaatgtatgacagcattgactttttatcaacatttaactattcgttttattcaaaagttttttgcaaatataaaattatttatgtaatgcttaaagaatatttgatgataaatcaagtcagaataaaataaataataattacatattttttaataaaacaaatggtcaaacgtttcttaaaaaaatcaacagggccgtacattaaaatacggaggaaatatttaattaatatgtaactggtatgtatctaaacgaaaaccaaatgcgcccaatcggctagctccgttcagtcataaacgagaggttgtaggtttgattctttgctcctgtgcactttgcgccaatttttattatccgatctgcacgaattttgatgtgatctaacagtctacaatttgaaagtttttaagcctaaaaaaccgtaaaaaaaatatgcaagtactccctctgttttataatataagactttatagcattccccacgtagtaaaaccgtaaaaaataagtaagctataaaatgacgctcttatcctttgttcttttcctcaccggcgctcggattagtccgtccgcatccccggcgctatgcagccggccgacgacggcaggcggagggcagatgtggagtagtgcggcggctgcggatggtcgcccacatcctcggaggctacgcagccggccgtcgatggcagtcgcagccacgtgcgcctctccgctgcaactgcacgggccgacggggcatcatcggacatgtctcacctttcctggagcttgattgttggcattcaatttcttcgagactcgtcaatactctgaaattgtgcgagctggcatcagggtgatgtaatgccattaagcgtatgacaccattcatgagctgcgctttgtgtatgccctgacttaatcttgtgttatgcactgcaagaattcacaacttcactttctgtagccagggaacctttaggcttcagcatctgtttacttgatgcacctgctgtttcttaagtctatatgtttcaattatttgtcctcttattgtttgcatattatgggtttgattgtttatcctctgtttatgtttccgcctatatcatttgctaaatacctagtgcaatgtattgggtgcgactgaggagtgaggactagtgttggatggagtattagtttcagactttcagtagatggtcagatctcagatgcaagctaacctgttgagtaggtattgggattggagaatttggtgccaggcaaatcgaattttctggttcgccatttagcatggatcatggcgtcacgagccatatggtgacacatttgctgatttgcatctgaaactttcagttatgtcaatattttcctattcacatgagatcttctgactgcaattccataaatgtaaatattttcctgcaggtgttttcagatggatgggcacttattaacatgcaattccattggaattcattaatttatcattgctgccaatttgcttttcagtcattcaaagaagttcacagccattcatattgtcattaggtacttgcattcatattgttatttaatttctaatggtgagaagaactgaacacaaaaaattgaacagactacacaaaaaattagtgtcattcagtttccacacaagcaactgtcctagttgcttcctgtgacaagaacatgaaacaaactgacaaactggagtacacctaagttatcaggaggacatcaagaacagctttatgcattgagttaaaaattgatattgatattgtaagttggggaatatgttgtgatttagcatagctaataacatctagcaatatgactaaatttttttccattttaacatccagaaaatcaacaacggtagtcatagtacatattatcaaataatttcatgagaaggagcacagctagaactattattcctatgaaccaatttctaatgtcattggtctccttttcctgcttggacaacttcttgagtgaaatttccatgtctaaaaacggtccgccatttccagctctagcttcatactaaagatcatctttagtctcggtttttagtggaaccggaactattgtggatttcggccgacggaccaaagatggtttctccaccagtgtacccagattgacatgttccagcaagtgccaaagctgcttgaatgtcttttgtactcttggatgccagatctactccaatcagagtgtcatcctccttaaaaaaacaggactgttatattgacatgcatgactaaattaaaagaaaatttatttatactgaattaccactaaaaaaatgacatatgcttggaatgaaacttacctatcaacacacttcagcgtacaacttatgtaataccactacgcatcggcaatatccttgatcaccggcatcgcagcaacagcaaacgaaaagtcctagagcttcagaggacaactggagcaccaccactatgccgctgtggccgccgacagctgccaaagtccccaccgccgccaccacatcaccggctccaacgactccatgactaccacgataccgcggccaccaccacctcgctccacgaccacctcgtcactgcagccgccaaagcccccgccgctgccacaacatcgccagctctaacgactccatgaccacctcaacaccgcggccgccaccacctcgctgccacggccgctcacgcaccagccgccgccaacaccacctcaccgccacggccgccaccacctcgccgccacagttgcccatggacaagccaccgctgttaccactcatcggacagaggggattcaagcaccttccacctctctcaacactgccggtaccacctcatgggcaaatatgtatctggaggtaccacaccttgccaatcgtctgatcggatagaacgaagggcagagatttgttaccgggctacctgctgaacagaagaaaatctcttcatagtatcagaagaaagtctgctcatgcacctcggcagatcccgccatggctaaccccagacctgctcccgctttcgcactcgtttctaacatcaaaaaccacatccaccgctcaccctccaactctctacatggtgtgaacttttctttgttcttctcggccatttcaatctcaaggcacacgtcgacggctcacccaaaccagccaacgctcaattatcaacagaaggctctgggtgccgcagcgtgaagaaaaataccccggaagtctttagaaatcagctatgctttatccatataagtgataggtaaattgaagcagttccttcttgtccttattagtcagcaggcactttttaaagggctgctctacttcgtgcagctttgggcagatcgatatgctcacgaactgcatggatgaaagaacgtgtgatcctccaatggatgacagctccgagcaccgctcgagaagcaggcatttgacctaaagatttgtgcccagcggaatggactccatgccatcgcagctagacaaatgcaggatgttgagagaggtgaggctctgtaggcaggccgggaagtcaaccttacggccagacacaatagagagtcgtcggagtgagggtggcaaaaccattccctgcgggcataacaatttgcagtggattttcagatcttgtaggtatttgaatcccacgaaactatcgacaggcattgacagtcctagatcgctggagctgtcgatctctatggacttgatggatggcaagtattccggggacaagcaccgatcaagattctgcaggtcctcacaactgtaaagacctatataggtgagtccactaagacatgttgtgccattgctgctactgctactgctgcttgcatgctgcatcgtttcaccaccagtcgaaccaccaagaattgttactgttttcagccaaatatttcctgatagcattagaagttcgagggaaggaaacgatgggattgacagatttttcaagacgccacaatggaaaagcaccaggctccttaaagtcagcaggctctctagtctaaaccaactaggagaaaagctatcacccccaaaaccttggactgtaaggtgttcaattcttggtggaggatgcaaggcttcgagcactccattctcactactcttcactaaacttgtgactttctttcgccattgtagaactagattctggaggtaccgtttttcaacaaggctagcctcagcggcctcttcctcgttcttaacattacaaatagaactaataagtagagctacactgagctgattcatgcccctcaactcaccaattttccgcccatcccctgtttcaactataaaatattgcaagttccgtagacgagacagatttccaagcctacttatctctgataactttggagagcaacctgttggcaatgctagacgatgcaagttgattagctttatgacatccggactaattgcttttagacttgaaccatttgcatcaacaacctataggctgtaaaggcaccagaatttctccggcaattcttgtacaccgctataagaaatatcaagataacggagactgttcaactcgcctatgctctcaggtagcttgaccaccgtgcaaccctttaggctcaaatataggatgttggagagctgattgaaccaggtaatctcaacattgaaattgattccaaacctaagtgaatgtaatttgttcaaatcctgaatgcctctcattccgctcttcagggattcatcagcgacctcgactgacatatggcgaactgcatatagcattctcctctcattccgagacctcaaatcttgcatcaagaggcattcatccacagaaacggattgcgccatatcatggatcaagtcatgcatgacctatctagttcgattaggatacttggggtcggtttgaaaaagaaacctgctcctcaaatcatccaaatacctaatccccatatcttcaagacgtgtgcttccacttgacacaacaaagccctcggccacccaaatgtcaacgatctcatctcgttcaaagctgtaatcttttggaaacatgcagcaaaatgcaaagcatctcttaagttcttgtgggagatataagtagctcagttggagggccggtaatatctcattctctcgatgtggcagctcccacaattcactgttccgaactgtctcccaatgttgcacggtcagctccatattcaacaaacgtccaatagttttggcagccaaaggagatccacataacctagaggcaatgttgtgaccaatatcttgcaattgaggatatgattctggacgctcttctccaaatgaacacttgctgaagaactcccaaaatatatctctatccaagccttcgagttggataggcttacaattgttggtggcaacacgatcagcaacagttgtaaatcttgtagttactaagatcatactgcctttaggtccgttcttgaatggtgcataaaatgactcccactcgtcaatagcttcttgccaaatgtcatccaacaccaaaaggaactttcgtctccctagctgctccatcatttccacctgaagagcatctaaactgaacagtggcttatactcttccttggtgaaagactcaatgatctcttttgttattcttctcttgtcaaagaggtctgaaacacagacccataccctcctcttgccaaagtgagcttgcacccttggatcattgtagatgaactgagccagggtagacttccccaccccaccaatgctaaaaatcggcaagacagaaacattgccgatgcatttggcctcatcaagtctaggggccctgctgctctctcccttcagtttcttcgttctgcaggatgctgatttcgtgccagtgacagtggctgctgctctcttctctttagcccgtgcagcagcacccctggtgagtggcacacccagtaactcaatcacctgatctcgttgactattacgtccaatcatcgaacgcacacccagcttctcaatcactagatctcgttctttatcacggccaaacacttgagacacatctatgactgaacttgtctccggcatgtgttgaactgcctcgatactaagacccactgaattgatcgctccctctaaatcagccacagccttgtcgagcttctcctgggcctactttatccttgttttgctaccacggatcaaagtttttgcatgatttagagaggaagataagagttgacctgcccagctccggtcagcgtcctccatcttttgccgcagcgcctggtcatcgaactcgcggagaagatcctcggcgtcgtaggtggtgtccttgagctgcgacagaaggatcgccatgtccttgttcttgaacctgccccactcgccgcgattgatgaggaagcgagccttgggcaaggtggcctgcaggcgggacagttcatcgctcagctgggtcgcttcatagatgttgatcccggttgagatgatcgtttccacggcgtccatcacttccgtagtccttgattacttctccggatcttgccctctcgctacttctgatgagaaacaggagcgatcgattaagattacaaggagattatgtggtccaaaagcgaaaaatgtagcagcatatacataagtcaagtttacgagaaacggaatggcaccaaaaccaactcacctgcactcctccagctgttatactccctccgtcccaaaatatgaacatttttgaaatagtgccaagtcaatcatttctaactttgactactaatagcaagaaaataaaaaagatcaatcgtgtaaaattgatcttactagatttataatcaagctatcataatatgtaactctttttatttgatttttttttatttttatagatattgttggtcaaagtagcatctcaaagactgtgttgaagtcctaaaacatttatattttgggacggagggagtatcttatccttggccttaacaagttcatatcttttacggttttggtgaaaaaaactccacctattatatcttatcctctaccttaataggtgcatatctattacggttttgctgaaaaaactccacctgttatatcttatcctcggccttaacaggtgcatatctattacggttttgctaaagaaaaaaataaactctacccgttatatcttatcctcggccttaagatgtgcacgttatctactactaccgttttgctaaaaaaactggcggcagtttttgtggttgaaaactttcgacttttttaaccattcaatgcacttgaagatttgtgctgagctgagaaagaattagctagccgtgtggggaagaggaacccagaacttcccgctcacaccacgcgcatatgccatgcacaaccgagctatcaaagttttctcttggttagagtaagggtaataatacaaccgatttattggctataaggtttttggtaactttctctcagctcatccatataatagttagctctttacaattaatatatgacccacctgtctctttcacagagtttctttgttcttatatccaagccggctataagtttatagctcgcttctcctctctctcctctcttctctcctccacctcagcatttagtcttatagcctactattatacttgctcttacaagcaatgaatatataaattacagttaaagtgtagttatctcatagttgcatgttgttacactatagtaacagtagttatagtataattatattataattgtattataattacatttgaatgttttttcttaaaaaaaaacttacgacggattttgattttcgtagcttttttttttcatccacatcgtcatccgtagtgatatcgtagagctcccacgttaaccgtaggtcttcaagtgatattatgcctttaatcttaattttgtgggctaggattacctcacgtgatatatatatatatatatatatatatatatatatatatatatatatatatatatatgcctttaattttagttcggttttgctaaatttttggtgacacattttctggttgattacagtcgcttgttgagccgttggatcagtcataggattcgtgctagcatacttaattacgcgtaactagttgtgcttcataggttataggtcgctaattagcggtctactggagaattttgctactatttttttcttcactgcatgcactcaatcaagtacgagtatttgtaccgaccagcgaaacacatatgtaattaaagtataaatagtaattagtatatattagtagtatatttagacagtagttacaccctatttacacaccacttacatatgtaattagtatgtaattttgtgacttacatatgtaattttagtacttacatatataattttgggacttacattgtaaataccctaaaattacatatgtaatttattgacttacaatgtaaatacatgccgactaacttttggtgaaaaatatggcgccataaatatagctactcccttttagttttgttgattgggttgtattcaaagcctacgtagctacataagtccatcaactaacaatgctatctatatatatatctattatatactaaatatatactaaaagtacattaaacttcctacaaacactttcaagtcgtcacgtggcgctataataaattaaagaaaatcctataaattctaagaaaaaaagcaaaacatataccccttgattttcacttaaattggtgggtccaatattatattggtgggtccaatattatacatcgttagatgaaatctatctatctattatattattaaaacaaccttaaaagaaggcaccacgttcaccgtagaggctagaaattctcacattaatcgggaaaatatgaattatttacactgttagattgttaggtatgtattttaacgtatgagatttaacataaatctaacatgttaagtaagagatacggagcaccctacatgtgctgaattagaatcaatctataactgggaccaacatgcaaacggactcaaaagagttgtacgatttcctaaactaaccagatttaggacctaaatgaattaggcaagaaataaaaagcagcaagcaacaaagcactgtagatctcaatttttagatgtgttttgttgatctgaagatagacactagaagtgagggacggaaatccgcatcagtgggtcaaccgtgcggctgcacgacgagccggactcggtgatgcacgtcagcaaccagaaggcacgatatatagcatgtgcacgacagcaagctaggtgcactccttaagaaatacaattaaaaagttttttttaaaaaatatagattccaaaataaacataaaaataatatttggaataaaaatataatcccaataataaatatgtaaatcgtctttgctagatattcctttttatctatctatattattaagataacttagaaaaccatcatagtagttgaaatctttattattaagacaacggcttagtcgtcctatattttttctactataagttatcatgttaatcgaagaaaaaaaatctaagccattagattgtggtagaaccaaattataacggtgaagattgataacataaatattaatatatgtaatacaattgaattttttgaactaaacaaagttatataaaatacaataacatgcaagccactgggccaccgtcagcaccatgcaccttatgaccagaccaaattaagcacatagtagtagcatatattgagaacctagaaaaaatgaaataagagttcaattaggaatacaatttaaaaataaccaaatttcgaaataaaacataaatactattgaaagaaaagatcatctaaaacccatcacgagataaattgaaattcaaaataaaaataaaataaattcgtaaaatataaaataattataagagttaaagtaaggatacaatttataaataacaaaacatcggaatgaaaaatattgaattttcaaaaataaatccatctagaatacaacaatgataaatgataataaaaaggggaaagggc

SEQ ID NO: 13341 - DNA, 3358 bp, Oryza sativa
tctaaaaagtaaaaaaaaataaaatccaatgagacaataaattttaaaaactacaaggtattacatttgttttttaaaatcccaatgacaatgaagagggcagacagcgggcaggtcatagagaagtatggggcaaagccaaatgaaccccaatcataattacatttgatttttaaaatcccaatgacaatgaagaggggaggcaatgggcaggtcatagagaaggacggggcaaagccactggctgtttggcgggacttctagaaagtaaaaatatgaacacaaacgataattttgttcgattttgaaaatcccaatgacaataaaaagagaggaggcagtggacgagacttctaaaaattataaaaacgaaatccgatgagacaataaattttaaaactataaggtattgcatttgatttttaaaatcccaatgacaatgaagaggggaggcaacgggcaggtcatagagaagtatggggcaaagccgctggctgtttggcggaacttctagaaagtaaaaaaaatgaacccgaacaataattttgttcgattttgaaaattccaatgataataaaaagaggaggtagtggacgagacttctaaaaattataaaaacgaaatccgatgagacaataaattttaaaaactacaaggtacatcgaggaagtggtacatcgaagggtgcctaagaaataaggggtagcaactagcgtgacttttaaaaactataaaattagaaacacgtagatgataaggtttgacctttcaaagtcttgatacaacaaaatagctatttaacaattttttagtaaattcatattaaataatagataattttgtataagtgctagccgcgtaattgcgcgggccacctagctagttgatcttaaaacaaaccaaatgctatgaggtcccacttctcctccttctccctaggtatatatacgtaagtacatcttctttccttttttctttttctttttttcttcattttgccatttatataatggatatatttttttaaataatcataattttacaaacaaagaaactaccatcatacaactcacaggtaactaaattagctctataatttttaacataaaatttacaccattatatgttactcataaaattaataatgtaagataatttccaattaaaccggtgtactcattactttttactattattttcaaataatgcactattttaaaataaagtttacaccattatattgtgtacctatcaaataaacaatttaagatctatattaactaatttatacatgcacttaaaccaatggacccattatttaaatcatcgtatttattttttattatattggactattattctcaaataatgcactgtttcaaaataaagtctacaccattatattgtgtacccattgaattaacaatttaaaacctatattaactaatttacacttacactagaaccgatggacccattacttaaattatcggatctattgtttgctaataaataaagcgttcaaagttctctttcttggcccgctacacaatgcacgtctgtacctttgcctttgcacgcgtgacaaagcgtcgtgtctgaggcatctaaggtgatcacgaccaccgcagcgctaccgctttgccacatatcaagtcatatatggagatgattaattttgttaatatcatgaaaggaaaattaaaggtgtgatgccgtgagagaagaattaagcaccgtgggttgtattttttcacacttagctctgtctaagctgaaaccgagagttgattacagaataattataatgtactgtgtcatttcatatttggattttatactatttattcgtacaggtgaaagaaatcattatgttataaatgtgagcacaatattaacgaatatagaacttttaccaagacaagggtgttataagggagtttaaccctcttttttccccgattccgtagtttgggtttttgtttgcatgctttccatgtttctaaatggtgtcttttttaaacaacattttaactttttagaaatcaattcattcgtttataccctcaaatagctatcatataaatcagataattcataagtatattttttttcatgcgagtccagtgtgcaggtggcattcgatggctttcgttgcagacgctatgtttggatgggactccgaggtgaaagccttgctcggcttgccaatcctagcagcatgatgcccttggcgccgttcaccttctcgagggcattgctattggagcccttgttcaactccatatcaagggatttctctgggtgaaaaccatagattcgttaggatcgggtgatgtcgccgttctgtcgacgtgttcttctcgaagtcttcgttttaggtgcttttcccttgctggacggttgtacttaaattttaggttcactccgtcaatgccggggttttcgccggtttttcataaattaaccgggccgtagtaaggattttgggtccagttttctttataagttggataactctcttcttcttcttctattgtgaaattgcaggagctccctacccgttcccgcgaaaaaaataatgtaattatttttggagttatttttcccttactgtatagttctaatcgtcaaggtttccttctattctctacttcctatacgatgaaaataactatttttttaaaaaaataatatagtgattacctcaaaaatatagaaaataattttatttactcgtgaatattctacacttttctttactgtcttctatacattttacttcacacagtttcttatttcaacatcatcaactatgtttactttcgttgcatagaaaagttacttctattgtaaacttaggtggtgtttgaatgtgctgaagatgaagatgaaggccctgtttgggagagcttgtcccagctacaagttttcccaaaagctgcttctgctagaagctgccccaaacaatacacagcttctgagaatctgtatagatacagcttctgaaaaatgaactaagaagaagctgtgttttagagcttttccagattcttagaagttggctaccaaacagctgcttcttagaatctaaagctcctccaaacaggcctgaagattaagtgtttcacgcaaaacaaggttgtaataacatgtgattaattgatttttaattattccaaacttaaaaaatagattaatatgatattttagaacaactttcatatagaaagtttttgcacgaaacgcaccgtttagcagtttgaaaagcgtaccatgagtatctaaaatttaatccaacttttatggggtttaagtaaattacttttggatgtttaaacatattcaatattagact

SEQ ID NO: 13342 - DNA, 8801 bp, Oryza sativa
aaatccaaaaaagcggtctgtttgacaaaagaaaacaagtagacatgtttatgacacttccattttctagtaatcttgttctccaagaacattttctgataatctcgaaaaaaatctaaggcttgatgacatactgtatatgcacggatagtttaacctgccatatttcattatttgtattccacaaatttctaaagcagaagaagcatatctgcatatctcacctcatatatatttctgaatacacataggtaaaagagaaatgcattcttcagtctaggtgagaaaaaatgaatagttaggaagattagattcatttactatggacttaaccaaaaaaaatagtttattactacacagctttagtaccgctgataccatcgatccattttgtccattctcttcgctgttacagtattgctgcaaattactgaacagttgtgacaagaaaagttgtattttctcttagggatggcagttgaaaattataggaacatgagcatgccattctcaagtagtctatatgtactgatgtttggtcaaatttgttcaatctgaaaacatacatgtaactgaatatggcctaggattttgaaggtaacatgaataaaatagacaccatgccttttggcttggttacaacaaatagcactaaagataagaatacacactacagatggttgacatctagaaatgtagatggctgttgtagaattagcttattaatatatgcgatcaatggaggaacaatattgagagcaacttaccttgcctgtgggcaggattgatggactacgggggccgggtgaggcatcccgctgatcttgatcaatcaattgtgaagctggtgagcagacaaaagatcagtctgcaaatataaattaatatatcaatgatccaatttgtagtaatctgttgcaagcatacaaaaggtagaattttgctatggaataaatttagcacagtatccacctaaatgaaaaccaattcagcgagagcaaaaaaaaaaataccgctgacctcctaaatcagcatgaacacttatagcaaaacaaacttcattcagtttggatattttcacttgtaatttcacgagtctggacactaccataatgatctcatctacaatgtagagaagacatggtcagcacatcggtagtacctttctcccaaaattcaaggcagaaccagaattggacaacgataattaaaattttataccttacttggattgactcgtagcacatataaatagaaaggttaggccatgcaatttaggctactgttgattctataaagcaatgggggaaaatagttgataagggtcagggttgccatggaggtgatgccatggtgagacagcagttaaagtaatcagtaaagcatttttattgtatcgacggctgacatttaagatgcacaacaatccaacggctgctatatttctgatgatgtggcttcacatgatcccagctaatggtgattccgatagtagatggatataattgaatcacactcagtttcagcaaatacattatacacaaaatggcatgtatttccaaggttggccacagtaatcagaggaactttggattcgcaggcagtatagctgtatttgaaggtaagagtacagggtaaaaccaagcatcatgctatcagggttaactgcagctgttgtgccctctctagaacaaataaaacttacatatatcaaaaaatagattgactgtggcagagaacgagagcaagaactccttaccagccagggtcagctgcatgccgccatgcccgcatctgcacacccgtatggtattttgcctccatgccatcgcaatcgcagccacggcagcggaatccgccggtgcgaccacagttgacggggaacactgtcacgatcctaacttcttcccgaggaattgctagctaatcggaatcggagatagatttgaggagagaattggattcgagagagaagagcaaaagggaaagaacgaacagaggaggaagacgatagaagcagcagagagatttgaattgatttctgtttgtgtattacaaaagtacgtaatctctctctctctcgctgccggctttatagcaatgtgccaaaaagcctctctctctatctgtggacccagccaatctctactgagtccactcactcacagggaaacgcttgctgggctgacggagtcaaacgggccgctccttggtgcagcccaagttctcctggtctgaacctcttgcttaggggtggacaggaagctcgtggctcgttagctcgctcggctcgtgacaggctcggctcggctcggctcggctcgtttgagataacgagccagctcgagctggctcgcgagccgctcgcgagccttaacgagccagagcagatgaggcccaggcgcctagcccagcccaacagcccatcacctagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgccgacgccgccgcccccgcctctcctccccggcgctgacgccgccggccatggacgccgccgcccgcgccgctcctccccggcgccgccgcctcggctcctccccttgttcgctttctctcttgtccccaaagctcacgagcctaacgagctggctcgagctttcaaacgagccgagccgagctgggtttctagctcgttaggataacgagccgagccgagctagctcgttatcctaacgagccagaccgagccgagccagctcgacatccacccctactcttgctatccgaggtgttgccgccgccgtgacaaacacgcgggtgacccgacggctgacaggatgggggtgcggcgaggtcggcggatcccgtcgattcggcggcggcgcaggtgggcgcggcgctgtgcggcgaggtcggcggctcccgtcgacttggcggcggcgcagtggagatgctgccgtcggcgggtgagcagggtagggggaagccggaggaatggatgcgggatggaagggccgcgatgggtggggatgctggcggagggagcggtcggcgatagagggatctgcggggcggaggatgctagggtttggagtcggcgcgacgcggggagagggaggggcagaatgcggaggtggacgacggtggactcgatatcatgaaaggacggcgatgatggcggatgcggtttctgtgggatggggaatacggtgattccgcaagaggtgtgagtggtgcgcggtgggaggtgggagagctctggttcgtttgatctgacgcgttggatgatctggaccgttggatttgatgaatgagtaatgtaggtgtaagagtgagttgatgaattatagggtagataggtgtaagagtgagttgatgaattatagggtagatacggctgtccatgcgaagaaggatcatcctgttagccgtccagcagcggtgtttcaattaatgccaatcaaagaaagagcttgcatttgattggcccaccgagttggttcgtgcaaaggaaggacggctgcccgacaaagaaggcatgaaacgccgtcgccaacaatgaccatagttgatgcacggaacatggaagtaattccttcgtttctcttcaatccttttttctatatatagaaagtaaccaaacaaagccgtaagataagagtagaacgagtgctccctgcacctgagccggactcctctggcggtcactgcactctatctggcacgtcgctgtaatctatcaggcactagtttagctctagttgttactagttctgttgtaacaactcctagcttctaccattgacaaacaacctgtaagtacaacactaatgccaatattgaccgatactagcttatgtgggtgctacctttttcactagaaagaaaaatttcaaaaatcacataaatatgagttttggacatattgaagtgggttgggtgtgttcgttttgaaaaatctctttgtgactcgtgcggctaacttttgtcatttaatgtcaatattgaccgatattagcacacacatgggtgcgatgtttttcaccggaacgaaaaagttcaaaaaccaccaaaacatgaattatcattgttgctttcactctttcatggtagagcggtgcttccgtccagcacgtaataccgacgggtgttgaatcaaatccatccgtccatcgtgagggggtaggatcgggaaacgtcacgagcccatcgcgcagggcccaatctccttggcgctttttttctccctcacccaacaatccccatccctcagcgcaggatcaatgatgccatcagcacggcagtccgagtcccttatcccccctcgatggctccagcaagtacctgccctgctgctctccctcccttggtgcatgagcaatggagctgccgtcggcactgcctaggcccctaaccagtttagggtttcctcccaagtggtgctcaagatgtatgtgattttctagcacacaaaatactcagaaatcataccaaatctcatagtagtttgtttgattttagatgatttatgagtattttgtgtgtctttattttgatagatttggtatgggtgatgaaatgtgagacaacttagaagaacaagaggagtacaaaacgatgatttctatcagatgtatgagacttatgaagtgaatttaatttattttcagcaaagtagaagacgatgtatgagacctaagaagtgtttctttgcaccggtggaagttgaatcaggagttctttgcacttgtggaagtagaattttaatgtttgatttccatgtgtgggaagttgtgttgttggacagtcaattatatattgtttgcctctatcagactatgagacttatgagcgtgtgtcctgtagacacttatgctggtgcagtgcttttgtatggtctagttattttggaatgaactactcaatcaaccatgcttcttgtattgaatctgtgaaaagagcacaagcttatgatggacacattttgttgttgaatgggaaaatttgagcttattttggacagagcatgatcttctgtcatctttatgtctgtttgtgtgtttgttctggaaaatttggatatgtgcacctgaacttgtttgaaggttaacaaatttgttttctagcgaacctagaacctatcttgcaaggcttatggtaccacatagtacaatcaggcttggccctgaggagcatgagatgagcagccagcagccgaaatcaacaaacttgtctcctgttgcgatggcaactttatgcatcgagttaaaaatggatattgatattgtaagttggggaatatattgtgagttagcatggctaaatgatatctagaaataagattccaatatgattcaaataatttcatgagaaggagcacaactagaactattgttccaatgacccaattaattctaaaccaatttctaatatcatcagtctcctttttctgcttggacaacttcttctaaaagacggtcgtctttcagccatttcctgctttagcttcgtcctctcttgttccgcctttgttttttcaacataacaggtccactcaatacgtagcctacccaattggcacgttccagcaagtgccaaaactgctcgaacgtcttttatactcttggatgccactctggatctactcaaatcagagtgtcgcattactcatcctcctaaaaaaacaggactgttatattgacatgcatgactaaaataaaagaaaatttacctatactaaattaccactaaaaatgacatatgcttggaatgaaacttcaacgaaaaacttatgtaacaccactgcacatcggcaatctcctcgaccaccggcatcgctgcaacagcaaacggagagtcctacagcttcggaggacaactggagcaccgccactacaccgccatggctgccaagtcgccaacgccccagccacagcattgacgactccaggaccacctcgccgctacagctgccaaagtccccgccgtcgccgccacatcgtcggctccgacgactccacgaccacctcgacaccatgcccagtagcacctcgctccatgaccacctcgtcactgcaaccgccaaagcccctgccgctgccgccatatcgccggctctgacgactccatgaccacctcgacaccacacaccgcagccgccatggtcacccacgcaccagctgccgctgccgccaacaccacctcgtcatcacggtcgctgccacgttcgcccatggaccaaccatcgccgttaccactcatcggacagaggggattcaagtagtacctacaaatatagtattatctttccacccctctcaacactgtcggtaccacctcatgggcaaatatgtatctggcggtaccgcaccttgccaattgtccgattggacagaatgaagggctgagatttggtaccgggctacccgctgaacagaagaaaatgtcttcatggtatgagatacccactgatccagctatcatctgctcttccaccgcggcagatcctgccatggctgaccccaaacctactcccgctttcgcactcatttctaacatcaaaaaccacatcccccctcacactccaactctatacatggtgtaaacttctctttgttcttggccgtttcaatctcaaggcacacatcgatggctcacccaaaccagccaacgctcaattacaaacaaaaggctgtgggtgtcgtagcatgaagaaaaataccacggaagtctttaggaatcagctgctatgttacattaattcatacatggaaccagtaaatttcaacagttccaccttctcctccttagtcagcaggccctttgtaaagggctgctctacttcgtgcagcttcgggccgtccgatatgctcacgacctgcatggatgaaagagcgcgcgatccaccgatggatgacagctccgagcacgacttgagaatcaggcatttgacccgaagatttgtgcctagcggaatggactccatgttgttacaggcacgaaaatgcaggatgtcgagagaggtgaggctctgtaggtaggccgggaaatcaagcttacggcaattcacaatagagagtcgtcggagtgagggtggcaaaaccattccttgcggacacaccaatttgcagcgccatattttcatctcttgtaggtgttcgaatcccacgaaactatcgacatgtattgacagtcctagatggctggatttgttgatctctgtgcactcgatggatggcaagtattccggggacaagcacccatcaagattctgtagctgataacagttgacaagacgtatagtagtgagtcctctaaggcatgcagtgcagttgctgctactgctgcttgtatgcttcgtcttttcaccaccagttgaaccaccaagaattgttactgcttccatccgtaaatttgcttctagcattagccgttcgagagaaggtaacgatgcgatcgatagatttttcaagccatcacacttggaaagctccagactccttaaattcaacaggcattctggtctaaaccaactaggagaaaagctatcacccccaaaaccttggactttaaggcgtacaattcttggtggaggacgcaaggcttcgaccactccattctcactgctcttccctatctctttgccatgccctcgccagagtagaactagttcctggaggtattgtttttcaacaaggctagcctcagcggcttctttatcattcttaacattacaaataaactgatagttagcgttccactgagctgattcatgcccctcagctcaccaatttttcgcccatccccttttccaactctaaaatgttttaagttccatagacgagacaaatttccaagcctacttatctctgataactttggagagcaactcactggcaatgctagacgacgcaagttgattagctttatgacatccagactaattgctttcagactagaacgacttgcatcaacaacctgtaggctgtaaaggctacagaatttcttcggcaattcttgtacaccgctacgagaaatatcaagataacggagactgttcaactcgcctatgctctcaggtagcttgaccagcttacaaccctttaggctcaaatataggatgttggagagctgattgaaccaggtaatctcaacattgagtttgattccaaacctaagtgaatgcaatttgttcaaatcctgaatgcctctcattccgttcttcagggattcatcagccaccttcacggacatatggcgaactacatgtagcattctcctctcattccgagacctcaaatcttgcatcaagaggcattcatccacataaacggattgtgccatatcatggatcaagtcatgcattacatatctagtttgatcagggtacatgggatcggtttgaaaaagaaacctgctcctcaaatcatccaaatacctaattcccatatcttcaagacgcatgattcctcctgacgcaacaaagccctcggccacccaaatgtcaacgatctcatctcgttcaaagctataatcttttggaaacatggagcaaaatgcaaagcatctcttaag

SEQ ID NO: 13343 - DNA, 4218 bp, Oryza sativa
  unsure (1)..(4218): unsure at all n locations
tcctgcagccctagttttggcaactaaaggagacccacataacctagaggcaatgctccgaccaatatcttgtaattgaggatatgattctggacactcttctccgaatgcacacttgctaaagaactcccaaaatatatctctatccaagccttcgagttggataggcttacaattgttggtggcaacacgatcaacaacagttgtaaatcttgtagttactaagatcatactgcctttaggtccgttcttgaatggtgtataaaatgactcccactcgtcaatagcttcttgccaaatgtcatccaacaccaaaaggaacttttgcctctccagctgctccatcaattccacctgaagagcatctaaaccgcaaagtggcttatactcttccctattgaaagactcaatgatctcgtttgttactcttttcttgtcaaagaggtctgaaacacagacccataccctcctattgccaaagtgagcttgcacccttggatcattgtagatgaactgagccagggtagtcttccccaccccaccaatgccaaaaatcggcaagacgggaacattgtcgatgcatttggcctcagcaagtctgggtcttgccctagtatctcttttcagttgcttcgctctggatgatgctgatgtgttgccaatgaccggggctgctgctctctttcctttagcccgtgctcgtgcaacaccacttctggtgatcagtggcacacccagtaactcaatcacatgatctcgttgactgtcacatccaatcatcgaacacacacccagcttctcaatcactagatctcgttctttgtcacggccaaacacctgagacacacatatgactgaacttgtctctggcatgtgttgaactgcctcgatactaacacccactgaattaagcactccttctaaatcagccacagccttgtcgagcttctctcgggcctcctttatttttgttttgctaccacggatcaaaatttttgcaagatttagaatggaagaatagcgtttaccgaaccagttccggtcagcatcctccatcttttgccgcagcgcctgatcatcggactcgcggagaagatcctcggcgtcgtaggtggtgtccttgagctgtgacagaaggagcgccatgtccttgttcttgaacctgccccactcgccgcgattgatgaggaagcgagccttgggcaaggtggcctggaggcgggacagttcattgctcagctgggtcgcttcatggatgttgatcccggttgagatgatcgtttccacggcgtccatcgctgctgccgtagtcctcgattacttctccggatttgatcttgccctcgctacttcgatgagatcgaacgagcgtatcgattgagatcacaaggagattatggggtggagaagtaggagcaactaggtcaagtcaatggacctcctcggttatggacttcctgtagaatccaccaactccacaaggtgacgtggccaccttgacagccacgagctctccctaacaccccgaattaattaatcaatcaattaataaatatacttaacactaacacagctaacgaccccactaatctctccctctccctctcgtcgaaattccaattccactcgcctcgcctcgcctcccccaccttccgattcgctcgcgtattatattgcgccgtctcgagacttctagatccttccagtggaacccgccgccgcttctggatccttctcctgcccctcattttaagcgccacctcccccgcccccccacgccaccgaccgagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttcactttccattgcagaatatttcatttacatataaaacgattcattcctgacctgaacgtatttatctttacacttttgtttcatacagttcttacatgattttgctattgcctgaaaaaatataattgacttgaaaaagcattagcttcgttattgacctgtgatttaactctttgcagaatcaatgggtcatcatactatgactttcttgcaagttgtgcagttgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13344 - DNA, 18646 bp, Oryza sativa
  unsure (1)..(18646): unsure at all n locations
accgagaggaggagctgggtcactagagtagaatcacgaaacaaatataagggcatgtttggtttatttcaactcctagattcacctcaaatcaagctagagcccaccaaatagtctagctccaaaaaagaaaaatggaacggagcagactagatcgctccacaaaattgtactagcggcgtggagcagcattcccgtagctccacaactccaacttcaactcaatttcagaagtaacccgaaactggaaccaaaattacccgcaaatgcatgtaccgcttcccccacgaagaggagcgcacggtgcgggcgaaaaaagcggtacatcgcactactacaaaattgattttttatggcatcaccttattattttctctagcggttatatgtggaaaccgccagcgaaaatataacaagggatggggggttacaaaccgccagtgaaaataaatcttcactggtggcgagttaaaagagccgctagcaaaaacatagctattttcgctagcggactacttaaatagccgccagcaatttttgctagcaaatgtttaggaacgccgcctgagaaaataaattcaacatataaatacacccacctcagcctccctcctctctctctctctccgcctttctctggaaaacaagaattttcagaatataccaccgattacgcaccgttttcaggataggccactcaattcgcactacttttagaatatgccatttggatgcgaattttcttcgttccgtgacactcccgtccttccaccgtcacttcttaccggcgccagcaattccgtgacggagaaggaggagatgtcacctccggctcaccggccacctcctccgtagacacgcccgttcgccccaccggccattgccggtgagccccaccgtcgacggcggcggcttgtagccgagaggatctggtcgccgaggtcctccacgcgccgctccccgcacgcgcatctggagctcgctggcatgggggaggaggagcttgccgttgcatgaagaagctcgctggtgtgggggaggaggagctcgccggtgtgtgagaggaggagctcgctggtgtgggggagggggagcttgccggtgtgtgggaggaggagctcgccggtgtgtgggagggggagctcgccggtgtgggggaggaggagctcgccggcgtgggtgggggagttcaccgctgtgggggaggaggagcttgcccgcgtggggaacaggagctcgccgatgtgggggaggaggagctcgccagcaggggtacaagagctcgccggcggtgcccagatgagcgcttgaaaatggcgcaagaggaggaactgacgccacgccggttcgggagacggagtgtcacgaactgaagaaaatttgcgtccaaatgacatgttctgaaagtagtgcgaattgagtggcctatcctgaaaactatgcgtattcggtggcatattctgaaaattctcctctctccctactcctctctctccggccttcctctaccactgccggctgccgtggcttccatcgccgccgccgcatccgtcctagggaaagcaagggcgagggggatggatccgctgccggcggcacgcggggagcgcggggcagccactgcccgccgcagggtctcgtcgtcacggtcgtcgccgccgggccgctgggaggacggatccgccgccgtcgagccgcggggagcgcggatccagcgctgccgggccgcggggtggatggatccgccaccgttgacgccgggcaacggggtggatggatccgccgccgtcgagccacggagagcgcgggatccaccgccgccagcacacggggagagcggagccaccaccggccgtggggcctcgtcgttggctgcgtcgcggatctcgttgtcaccgtcgggctgtggggagcgcggatccgccgcccgggctgcgagcggtggtgctcggtcgacgacggcgacaacaggtggtagcggcttaaaatttatgtggatttgtgtttggatttctgtgaatttctatggactcgtgcaacgatccgatccggttagtgtgtttggagatgggaacggaaatttgtgtgattgtgaatggaaatttgtgactgtaaattggtgatgtaaatttatgtggatttgtggatcgatgagtggatttgggattaatttgaactggcgttgacggaggcggacggagcggtgttgctccgtcattttttttagcctcggcaagtattaacattggcagctggtatagtctaccgcctgtgaaaattcattttcactggtggctagcttacaaaaacagctagagaaaatggattggtgctggcggttggctaccgccagcgaaaacactgtattatcactggcctttactcactggcggtggcgttggccgtcagcaaaaactcattttggccgccagcaaaaatagtttttctagtagtgtcggcagcacagcggctgtagtgcaggttccttcccctctctttccctcttctttctcttctcccctcatgtctcttccctctcctgtccatgagattttgaccaccggtggctcttgctacagacaagggtgacggtggaggcgtgaggaagcaagcccccatccctccccccctcccccaagccccaaacggtgtcccctcctcaaacacctagaaatcccccaattttttctttcaaaggtgcatgatttctgtgggatggatttatttttcggggtacattgaatcacagcaggtgttttgttctctatttctctttcaaggtgagatgataatgtctgtaggtgggttgggttgtatgcttgatttattacaagttgtttccacggttctatgacattatttcagattgatgcatatacttgtatttaaggaaaacatgatgtatccaaggatgtattttgtgatgacctagtcgttcgtattacaggataatgtattttgtggtcctgctacccgttattatttctaaacatttttattattacatatatgtcatgcaacaactaaaattttatcaattttactttaatagaaaaaatacccatgtgttgcaacgggtaaaaatattttttcagtgatacaacaactattaagaattgagcaataaattgcatgcctctctttgacttagcccacaagtgaagccacaggcccagctcgcacatacggtgcgtagctcgcacatatggcatcttcaacctacgagagacaatcacgtgcccgtatgccagagccgatcctccctatcaaattgggctgaatctttctcgatattccaaaattggctgagggtgtttgatccgctcgatccctttttatattttttttctcaaaatcggagtaaatccataacactcgggataaaaatggttaggggaagtcaccggtcggccatcattggcgaattgagattaaatctgaataatttaaagtccaattgaaagggaaaacgcgaggaaaataatgaaagataagtgtggaatcgattttttaattaattgaaggagaaaacatacggtgatacaaaccgacgggacagcgggacggaaaaaataatacggcggtaaaaaaacaacgaaaaaatggcgatgagaaaaaccggaggaaggctgatcgggaaaccagcgacaaaaaaataatacgagacagaaaaaaaaacaaaagttttatgtattttttaattagttatatatagatatgaattataaaaaaccaactaaaaatcgactcagaaacggatgacgtacgaagatcctgataaaaatattttcaatttttataatagtagagattaaattttaaccttccatacttatagcgttcaaatcattaataacaataacaactattaatcctacatcaaataaatagaaaaataacaagggtagcattttccatcaccctgggctagccaaacacttttagggctcctttggcagcccgggatcccaccgggatcccagcccattccctgggagaaaggcccgcgggggaaattgtcacgggttttattccatgtccatttggaagcccacgaggcagggatttcccggcccaatccgctaggaaaccctagggaaaggtccccgacctccggaggtcaggaatttttcctctctcgatccgccgctgcttctcgctcgcgcaaccggagtcgcttctctctcgcgcgaacaacagcgggcgccgccgcgcctccttctccggcgagacggccaccgccgggactcctcctccggcgagaagggtaagcccttctccttattcccctcctctcctcctcctgggtttccattctcctcctcctctagggtttccgcctcctctagttagctcccaatctcgctctccggtctcagcgcttgcatcgcaggcaccgacgcgtgggcgcggcgggtggcaccacggcagccggtgcaacgacgacgaagcggcgagccgacagcgcgggcacacggctccaagcaggcggggacaggggggatccaaggcagcgcgactcaccagcagaggaggcgctgaggcgcagatccgcctcctcctcctcgctgcgcgacgcccgccggtggttgcccggctaggtttgtgcgtgcccttgtagctgctgcttgattcttgggggttcgttcagtacttcagttttcttggtgtatgtatggcatgtttcttgatttggtttgggagagttataatctgttctcctattctttctaatacattgtagtattgtaccctgcagtagcatttcattttgttatggaagcgattcagaaggggatatgggtgggcgtgtggtgctcttgttttagatcatgaatgagttttggtaagatgatgttctaatttgatggagtaggttgtgctctggttttttctgcagtgtaattatcatgcttagtgcagtctaaatatgtgagatcaatgtgccagtcccaagaaatgaggaattatcacacatgcagtgaggatcattcaactagtgaggtatatgagaaattttagtctgcaaaccagtaacagtttttttctagttaattagagatgcagttcttttagttagatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatgcatgttgggactaaataaatggtaacaatcatatttttgataggaactcatacttactacaaaataaagtcttttatgctctatacttatacattagtccaaactttagtttcatgtcatgtatcaccagcagaaaatgagcaaggtggcattgtgcattcaaaaaacacaagctttggcagcaacctatatacaaagacacgcacacacagatgtttcaatctcctctctctcactcgctgcacaatacactggccaaacaaagtgacctagtagtactgattaattaaaacaacaactactactactactttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgcgtttgatttaaaaataatggtgtgtatctgcatgtagggtgtttgataccaagagtttgtttacgctgatgtagctgacaattgcaatatgttggttgatgtgcatgcatttttttacctaagctagtatcaatggccgtccttcaaatttgattgctgaagtatcactattttatatttattacttaaatttcagattatctttttcatcctggcagatttattagaatatatgaagatttgttgaagagatgatgaagaagatagaagagataaagatttaaatggacccatgtctcattcttgatcaagacatttgtggatataaatatgatgtacagttctatatttgtggatgcaaggatgattccaaagattttaaattttgtatgatatggatgattctaaagtttaacttatgtcatgtcacgaagttggtttccacataaactcacctatatttctttgtatttttctgaatttctaatacttgttgattttttatgtttttatatttttttctggaatttttgtaggttgtttcctatttatatggattttctatattctttctatttttcttgaaatttctataatatttctagagacatattttgttgttcaaacactgtttagcagtttgcctgtctaaatcccccttcccccatcaaccccctcaccctactcccaaatggtatcagggaaaattcccctaacaggagtgattcccctggaggtggaaggggatcggttagtgcaggggaaaatctctgtacgggactttttcccgggggtttcctccccctgcatccaaaggagcccttagggataaagctagctcccactagagctagtgtttgaggggaattaactatttgccacttatccaaatggtatttttagatttgccttttttttttgcccttttaaggtgatggcttcttaacaattttaccacttttgtttacgtggcgtgccaacgtggcttgcaaccttaaaaagcagagcgggacccacaaatcagcctctcccctagctttatcttccttctcgttcatcctccagcttgccgacagggaggagctcgctcccaatccggcatccctccctgcctccctccgagcccagcaccggcgagctccctacccccctccaagcctggtgccaacaagctcccttcctccctccaagcctggctccggcgcgtcggaccagttgtgcaagtctacgaagatcgggaccgtcgggttcgtggctcatcgcgcggcggcccttggggcatgctgccatgaggttgcagagcgcggcgagcacgtggtccaccgccataggcgatggagaggttcgacggcgacaagcgacggcgctggcccgatggatagcaggtgtgacgcgcccgctggcgcgatggagaggttcaggagcgtgcgcagcggcgcagggcgtcgtgccgcgcttgctccgtcggcacggcctcgcccaccggagctacgcacgggtggccctccccttagcggcatatctcctcggtggcgggcgtgtggaggtgggcggccgtcctctcagcggcggtgccggagctcggggacaccgggcatggagcgggcttgtccccattggcaagctggaggatgagtgaggaggaagatgaagtgaaggggagagactggcttgtgggtcccactctgctttttaggttacaagtcacgttggcacgccacgtaggtaaaaatggcaaattgttaagaactcatcatcttataagggcaagaaaataagagcaaatttaagaggggtatttggataaatggcaaatgcaatagtgacaaatagttaaattcccaagagtttgaagctagaatttgagttcgagcccttccaaacatgctactccttccatcccaaaataagtgcagttttagcactgttcatgttcaacatttgaccgttcgtcttatttgaaaaacaattatgattagtatttttattattgttagatgataatacatgaatagtactttatgtgactaatatttttaattttttataaattttttaaataagacagatggtcaaaacgctggagacgaatatctatagctgcacttattttgggactggagatagtaggagctatctgaaggagactacgtcgagacagagacaaaacgattacgtaaagcttgatttccgccttcaggggtttctgaacgagagagagacagacggcggcgggcggcggcggcggcggcgagggagccgaagcctgagaggatggtgtttggccggagcaagtcgtcctcgtcgacggcgtctcctccccctgctgcggcggcttcctcggcggccgcggcggcgtgctcggagctgcgtgcggcgtaccacgagtgcttcaaccgctggtacgcggagaagttcgccaaggggcaatggcacaaggacgactgcgtcggcgagtggcacaagtaccgcgcctgcctcgaggtcactcccttctcgccgcctccgaattcgatcacagcatcactgatttattaccgatcccctcaatttgttgcaaagacgactgccctagggattgctcttgtgttttcgcagtttaggatggggtttcatttaagtaggtttttagtttatatggcaagaaatcgagttgttttctagtgtgttggttgctagatcaagttgataaagtggcttatgtaatggtgatggctaaagcctaaaggggattcttctttgaagaatcatctgatttggagctcctagttagacctctgtctgtttgttggtcatgattcaggctaggcggcgcatgcgctgcgctggcctgttgaattcctccgttacaaatgtgtgagattagtgctgcttgattcgctggtgctgattgttcatttttttcgcacttgaagtatggaaacacacacggatctttagggatttagtccaaatcgactatgcaactgtttgggtgagaagtggggctctttgacattcagacattcagagtggagttgtactatatggcagcatagtggctgcaatagagttttgagggaatcgcctttccgtcacttgacagcccttttgtagattgtctatactgtctctttgttatttgatctcataaatcttgatgaaattcatcaggtcaatctttgggctggcctgtcttaagaaaaaaattttgtgctgctgtgtgcaattagaaattcagaaacctttctgaaactagcaatacaggcatctattttccattcttgaacagaagttacacaacggtgtagttgtccttgcatttggtttattggtttatggaaaacagttggggaagaatattctggtattgttgtattgctaactggcatctgaatgctttccaaaccattttcctacatggtgaattcgcaccattgtatcagcttctagccaattgtagttagtgtattgctgactgagaatttgcactagggctagcccagtgtgttggaggttggcaacccagcctgaagatagcccatttgtagcaaaattcaatgttcttgatgagttttgtttcttatagtactaagttatcagaataacgtgaatattcatgttttggggattgagcgcatcaattttctgaaatctgacaaaagagtgatcatgttgtggtattcatcataacatatttgtctgagtatttcccaggatttcttcaatttaacataaatcatgcctcccatcaccattgtttcacttgtgacaggcctctgggtaaattatgttcctcctatgaatatgatgcttgtttttcgctaaacgaatctatggatgttccatgtttttattacttgcaggaacatctggaagacaagaatctcaggcaaatcctattggaatcagaaacatctgcctactatgcccagtttgatgctgattcttcttctcgaaaaggtggcacctcgacgaagtgacaacctagggctaaccacatatgatcaagtttcgcttgactcaacctggattaggagaccctcatagatgaacgaaaaaggtgtttgtattttacatattagatgcatgttcatgctgttgcatcgcgctgcagttcagcagctgagatgtaagcttttccaagatcatattgaactcaaacctacaactttgatgtaccctgaaatttgcagcagtttctcttcctgaatctgggagaacagcttcagctatatgtaaacttaaaaaatattctccaacccaccaattttgtgctgcatcgatgcaaattttcaatacctcctatatgccatcttccaaagtcctttgagcatagttctggtagcgtgacagtgacttgcagtcttggaggctcttgtgttgtccgaatcagatgccttgactttgttgtctattatgatggattcattcaacaaagcttattgtttgtcacataggcctgatcctctctgatgtggtggcaaacaagcagtgaaagctaccagtctaccactcactcagggaagcttcgtagcaaagcaaagcatcagccttcaccttgtccagagcccagagaaaagggatccccttcaagctgctgttcttcatggccaagaaaggcaagaacaactctaccagaagagcctctgcttcttcttcttcttcctctgccgcagccgatggcgatggatcgccatggctgcggctgacggccttcgccgtgctcaccctccactcggctttctctgcatatctggctagagatgacgcgaggctggtcgccctcgtcgtcgtcggctacctcctgatgctggtgctgctgttctatggcctggccgtgcctgtccaacagaagagagactaaggtgaggcttcagcaatcagtcctcaagcatgaacctgccttgtttttttttcctttttgctggtttggttttcttgcatggtttgatcttggtattgaactatggatgttatgtacaaccctgtacatgctgatcaaatgtgtatctgtatgtttaattattgatgttaccaaagaatcacatgtataatataagtaattcgaaagagccacacactatggagttcagtgtacacttgcacaactgcactgagctgttagagttattgtacatatactgatctagatcaatgcttttatttgaatacttgtaccatttgcaactttgatcaggattgtctgctcgagtttgtactttagcggttgcatatattggaggcgtgtgattgatcagaaatgtctagttttgtatacaaatacaagcacttgaacaagaaaatcctttgaagttcacgtcagggaaaaaaaaaagcaatcttcttcacatcaaacaaaaactccctggaaacagtgtaaaagacaatagcatgaaagtcggggatatgcttctgaccatcatcacaccggcagtaaaaaatatcagaaattttgtgttgtagattttcttagtatatgacaatgaagttttttttttttgaacgaaccattcagatgctacattgattattattttaaaaatattcccaccagatcctaaaaaatatgaaaattcaattaaacaaaccaatgatttttaaaaataatctctgaaatctcaattcaaatcaccgtccccatgttttaagcctcttgcaagcaaatatgtagttcttcatactgtaaaaactttgcgatcgaactaataatagttggaaatgggatgcgttaggattttaaaccaaaatacagtacatcgcagcaaatcatcataagttaaatcagatgcctgagatgatttggcgcaagctcgtcccattcaaaagacttgggctgtgtttagatccaaagtttggatccaaacttcagtccttttccatcacatcaacttgtcatacacacacaacttttcagtcacatcattttcaattttaaccaaaatccaaactttggatccaactaaacacagccttggtaacttcaacaatactgtccctagaataaaataaaatgatatgacactagaacagagaatagcttagtactaactacccggctcttaggataaatcgtattgactatacatgtttttcttacttttccaacaagtgctgacctaatcccaacagcaaactcactttcaggctttcagctattcccaaataaattttctgaataaagtcatagacatgacaagataacgttcacagatcaccacaaataaactttcatttcaaccaaaaagaatgcataaatcccatttgtatatgttaccatgaaagagaacataatgatagtactggtaacagatactatgattttgtatgaactgacatgcctcttctcttcagtgggcaatgtcagtcaggctgcaatggtcaacacagagaatcaatgatttgtggtcaatcacaaacaaagagaataatccaagaaccaaatcctaaatcctgcagctaaaactgaacttactagttattacaggtgtaattaagtttccaaagggccttgctgggacaatcatctcatcacagatcatctgtaaatcagaacatcctccttggttgaatagagctgcattagacatgttttcctttcccacaaaaatgttctgtcaagcaagcactatgaacagaaacaaactagtctgtcaggaaggatcaggatcatgcagcaaaagaccaaaagtagttattccggtgaaacagttgcttcggctattcagaacatttgcataagatgaacattagcgatgtaagatacaatgtgtctctcaacttacaaaaacgatatacgagaggttttatgacagtaataatgcccaattttaactattatagcgagttgactgtagtcaacccagccgagtcaacgtagaactcacgcaggatccacactttggcagccaacctttcttcttcctcttttcccctcctccatctctctaggccgggaggcaggcggcatgcctaatttagatgggtctaatttgggccgctaccattggtagagtccaaaaatataggtgggccggatttagtagtcgcgaagtaaattttagcgggcctacatggactaggcttggctagctatctgtctgatagattagatattttgctaggtgggtgctgacgtgttcacctttctctcaaccacacgatatctcatagtcttttactccgaaagttggaggttacacgtgtgctacaaaaaagtttcgagtcacctgtatgccatgacacaaattttcgtttacctatgtgtcattccatccaccttctgttagagaatgagctctgatatatgagacccacatatgaaaatgaccaaattacccttgaagcattttcatctctactactcctctcccgtgcaatgccctagcctagccgccgcctctcctcgccggcacgccaccgcctctctagccgccgccgccgccggtcgtcgccggcacgccgccggtcgcagccgccgccgatttctcttccaaatgttccaaatagagcaagggcaaaatagatctttcaaacctccgttagtctccgttagtgttattccatccaaagtggcgcacaggtaaacgaaagtttatgtaatggcatacagatgactcgaaacttttttgtggcacacgcgtaaccttcaattttattaatggcgtaggggtaaaagactcacgatctcaaattcccaatcgaacggcggacacgaaaccaacgatccagtttaccctcgccgtcgccgccgccgccgccgccggagattccgccggcgttcacgcgtggaagctgcggacctgctcctccgcccccatccgatttccctggagcgaccgccccctccagagtccagaagctcagcttcgccgcccgagctcgatcgccgttgcgcagcgtcgcagctcgagtgcccccccccccccccccccccgcctccgcttcgtcggcggcgaggggcgacgagctaccggatgcattaccagaatcagcagccaatcgagctcgccgtcgcccgcccacatccacaccagaatctgcagccagccatgtatcagaggtagtattatcttacctgcaatcctgcattatatttttgtatggttttcccgcacgatttgatctttggtactccctccgtttcacagtgtaagtcattctagcattttccacattcatattgatgttaaaagatctatccatctagatttattaacatcaatataaatataggaaatgttagaatgacttacatcgtgaaacggaggaagtatatgtgtagtaacaatcagtctgtatgctcataaaatggtgtgtttatatatatttatttattttaagaatcaaatgtataagcgattcgaaagaagctaacaaactatgaggttcaatatatacttgcacaactgcactaactgaataattaacaatttattgtacatatagcctttgtactcttcgcaacttttatcttcgtcgccttcttggatttatgcttcagcggctgcgtatgtaggaggtgtttgattgatcggaaacataattggtatgcaagcacttgaacaagacaatcctttgaagttcatggcaggaaaaaaaaaagcaaatcttcttcacaacaaaacaaaaactccctgcaaaaaattgtgcacaagacgtcaggaccttcagtggaaaggatatacttttgaaaatcgtcatacttgtagtaactagtaagtataaaaaaaatgcttgttctgaataccaaaaatatcagaaattttatgttctttgagatgatttttttcctgaactaaccgttcagatgctgcattgattaataaccttaaaacttctgcgtccgtgtttcaaaaaatatgaaaattttcaactgaataaaccatgggatataaacaagtgtttgtttgagaagtagattactgtcaaatggataagaaagaactagaaaagtaatctatgaatatgtgatgacttactagttacaattcaaatcactgttcccatattttcagcctcttgcaagcaaatatgttgttcttgatactgcagtaactttgcaaactgaaaataattggaaatgggatgcattagcatttaaaaaaaaagaaatatagcagtaatccatcatgagttagaccaataatacctgagatgctttgaggtcaagctcatcccattcaaaggatggatttgtaccttcaacaattccggcaccagcataaactaaagtgctatgaccctagaacaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcgtcttcattcctcattcttgcagctaactgagctgacaggtgttgtactcttggaagtttccgaagggccttgctgggatggacaaccacatcatcgcagatcatctgtaaaatataataaattccttggttgaataaaactgcactggccatgttttcccccaataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaataaatttataaaaacaatcaaggaattcaaagataattcaagatcatataaagaattcactaacacagtgcaagatcatgtggtttttttttctcttgaacacacgcaaaagttttgtgcttcatgataaaggagcaccagagaaaagtgtcttaaaccaatacacaaagcacttccaagtgagcatttatcccttctatttatttttcaggaagaaatcgccgtaaatttcttattaatccaactgaaatttatcaaaaaaattactagcaactagctgttcatttacttcttaaatttgctacgcatggttagtttctactattgtaatctctctatttttttaaaaaaagttaataacatcatatactaccccatcctaaaatataagtatttttattttttgaatagtgtaaatcaaacatttttaactttgactcttaatagcaaaagaataaaaagaaatatgttcaaaatcaataaacggagtatggtgagaaacgtccagggtctacagctaactctatagagtggtgagttagacaacctaagtttgaagcttcaccccttctaataatttgatattaggtcatttcctaatattcatgtctttttagtaggaacatatcctatgcatacaaactttttgtgcacactccgtgcacaataactagcaaatgtcacgaaaaattctataaaaaattgtacacatacttcaaacagtattacatctatatgtaaaattttatcttcaaatttattatattttagccgtaataaaaaatataaaattctgacagatttttacccttaaaactgtcagatttttcatcttttgttactgctaaaatttaatgaatttgaatacgaaactttgcatatatgtgtaatactaataggagtaaatgtctaattttttgtagaacttttcgtgaaatttgctagttagtgagcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13345 - DNA, 35079 bp, Oryza sativa
ccaattttcccacagaaggtctatgatctcgaacaaagcatacgcatccaaacacctttggtggaacaataaattcattacatccaaataccatctcatatggagccttcatcccaagtattctcgatggtgtacgattgataagatatgtagctgtcatgaccgccgcactccagaggaactttggtacattcatagtatacatgagtgaacgtgccacctccaagatatggcgattctttctctcagccaccccattctgcggtggtgtgtcaggacaagaagtttgatgtagtatcccttctatcgaaagaaaactaccaaattcgttgttcacatactctttcccattatcagttctgataattttgacacatgtgttgaattggtttctaacaaatgcgtagaagtccttgaagcattttagtactttatttttatgtttcataagatatatccaggtcattcgggagtaacaatcaataaaagtcacaaagtacttcattccactcaccgagacaataggggaagtccacacatcagagtggattaacataaagggtgatatgctccgaagtcctctgcttatatatgtagctcttgtatgctttccatattcacatgcatcacatactagtttgcttctgtccaccttactcatctcatcaggatatatcttcctcatagtttcaaaacacatatggcccaatcgacaatgctggagaaataatctagctttctcttcacttgtaccaactgccaatgcactacatagtgctttatttgttccgcttctatctaagtaccacaatccgttctgcctaatgccaatcccaagcttccttcctgttcttctctcttctattaggcaattttctcgatcaagagtaaccgacaatccatatggtcaaccaaagaacttattgataccaaattaactggaaaggagggagcatataacactgatgataatgtaatggatggagtgcactgtactcttcccacacctttgataggctgtgaagtaccatcggcagtctgaacagtttctttatatgtgggtggatatggagtaaatgacacaaactcacttggcatacctgttacatgtctagatgctccagagtctaatatccaggttgagtgaggtacctgcatctgcatgggatgcgcgaggttgacaaggttgccaagaactgttgttttctccctctccttccgtattctttcccttatttcttgtatttctacagccattttcgcaagcagttgttcaattccttgacttccctccattccttttttttttttttttttttacaaactcactctattctaacaccttgaagacaacgtcccctggttttctttcctcctgatcagggaactcgacacagcagcacccctctccctctctgtgactgccgaggcttggactgtgttctcgcatacacgaattttggttggttgcctgccaatctgaagcactaacttcacattcaccttgcacaacctgttgccttacttcttgacaataattaatttccaacaccaaagccgcttcttcccttctagatgaagctagctacagctttcctcacctgctattgctctctgcacctgtaatcttcagcacacacgacaccaccaacagatccagcagcaatactcccttctttttcttcctttctcaaccacacacagcagtacaatactcacaagctcacctccttgccgcagcacacacaagccacaccaatagcacaaccggcaaacaattcctctgctcgctcaacagcaacagcaacaacacacttaccaaatttgtgttccccttttcctttcagcagcaacagcacactaccaaatcctcagctcgatcttctctgcctcagcaacagaacagcaatagcagctcaccaaatcctcacaccagcaccagcagtgccgtcctcacaaccagcagctccctccgcgcgcggccgccgttggctctgcctgccgccgttgacgccgctgcgtcctcgccgggagctccagcaccagcgtttccttcctcacctggagctccacacgctcctgcgccgcgtacacgcgcagctctgccagcgcagctccctcagcacctctctgcacgcctcgacaagctccggcgaggctagggtttagccgtcgcccgtcgccagccaccagccgattggctctgataccatgaagttttgggaatttttctctagaagcttcactacttttttcatttctctaactctgctatatacatgtacatatgagtagtatatgggcctcatgggccaacacatacataactcaacattatccatacatgcaaaattcagcaacaaaatgataaattttgctatgatgaattgctgacccttttttttttgttgcaggaccagtttttattagatggatcctctgattctggcatgtggattgtccctattactttaggatgcaattcacatgatatgcagaaaagattcttactgaaacataaattcagcgacataaagggcatcaattcacagtacgatgaccaagaccgacagaatagtggaaacttctggattaagctgaatattgatgaaacaggattttatagagtcaaatatgatgatgaacttacaactgcacttcgaaatgcattgcagatgaagaagctctccctaatggacaaaatcggtagacacaaacacaacatggcacaattagtctcgattacaatttacagtgatttggtaactggtattataacactattattacaggcatcgtggaagatgcacatgctctttctattgctggcaagcaaacattgtcgtcgttactacatttactgtatgcttgccgtgacgaggatgatttcagtgttctttcacacataaattctgtatgtgtatttcatgaccaattgattattccacgatgtccggttattctttggcgcttatttgtctacatattttattttggcttgtcaggtaacttctagtgtagctaaaatatcaattgatgctactcctgaattggctggtgaaatcaaacaactttttatcaagcttcttctccctactgctgagtattttcctgccctttaactctcaatatattatttcccaagatacattccttttgtatgggtatgtttgtttagatatgcttcttgtatggccatgtttatttgcagaaaattagggtgggaccctaagaacagtgaaagccacctggatgcaatgcttagaccagtgctcttggttggcctagttcagcttgggcatgataagactataagtgagggagttaggcgtttccaaatcttctttgatgatcgcaatacttcccttcctccagatactagaaaggtactaccttttagccatattattttacctggtcttctgcccttttaatagactcatctatctgtagtttttgcattgatcaggctgcatacctctctgtgatgcataatgttagtagcacaaacagatctggctatgatgctcttctaaagatatatagggaatcaactgaagtggaggaaaggttaaatgtattaggttcgtacttttcaatcttcttaggttaacaaagaatgatattttgggtttcttccctgaaggttttgtgtccctttttataggcatactatcttcttgccaggataaggatattgttcttgaatcgttgaattttattttcacagatgaggtataagctattgattgtttcttctttcatgattccattggaaggtcatggacgaatttgtagttctatgctaactacctgtaagttatatacatatctcatttgcttatcttgcttgtcaggtgcgcaatcaagatgcatatcttgtccttcgaagtgttattattgacgcacgtgaaactgcatggtcctggttgaaggtatcagtgtgttgcattatatattattgttgatattataaatattaaagttttaactatatatattaaaatcagataaaaataaaagtccatgttagaaacaactttctaactattaatttcgaatttcagaaataaataaaaatcgagagtccaagataagtacagcttcgtatttattaattctaaattctggaaaaactagagagtccacaattttataagtgttcttatctaacatgaactctcctataatctagggttatgataataggatccacctaatcaatgaccgtctttttggttaacatagaagctcccttggaggctcagtgcccaatttagtataggggtagggatagatgtgttatcgccacataaaaattgtgacgtgattcacttaagaattttgcatgtttattcttctataaatcatcaaatattatgcatgcttctacattccaaattatagtaaatagctaaattcattgcgcacttcaatgctgaaataatactccatagatacgtacgctaaggtggtgattatatttgtaaaggaaaaaaaaatacttccctactatccgctgaagcacttaatttttgttctcatcaatttaccccccaaccacactagtagggaatatctactatctgctgaagtgcttcattatattgaatctctgtttgctctcttgttatacaagctaagtgaaattgtgtgtgccctcctctgatcataattacttgatattttggacaagatctggttaatatttatgtcaaaatatcgatgtcttcagaagtatttcataatctcgtaaacctattggattttaagaacttgttctgttacagaaaattgtggccaaagtcgtaactcaaataccgtgaaaaactcaaacttcaagtactttgaccagagggaatatgataatagatgatcgcttaccgtatgtatgaaatacttttgaaaaataaatcatgactttttaaaagtcagtcttagttactatgaaactatacgcaagttgcctcttaaagaaaaacctttgaatgaaaaatcgagtgggatgcccttgttcaggaattaaatttcacgttttgttaacctcgtgttctttctatttccttacaaagagctattatactataagccaacagtgggatattcaaaacattttgcttacatgccctattatgtgaatgcaggaaaactgggatcgtatcacgaagacatttgcagcaagcgcaatcttatcggattatgtcaaatctattgtcacattggtatcatacatctgcacttttctattccccaattccgtatatgttattctgatcgggccattgctgatccttgtttcttggcagttcacctctaaagagaaggaagcagagatctcccagttcttcgcaacccgcactaagcccgggtttaagagggcactaaagcagagcctggagaatgtgcggatcagcgcaaggtgggttgatggcatcaggggtgaagctgagcttgctcagactgtgcatgatcttctcatcaaactctgatttgatgcctccagaatttgatgcatttgctgtgatgccaactttcgccaaagcatacattgtcatagcagctcattgtgagaaaaacatgtaggagtatgccgtcagcttgagttcaaataattcctcctggatgcaaggttttcttaccatttattctttatcaataatggatgctaagtctttccttagtatcccacatgcttctttttttttttttgagaaaatcccacatgcttctttcaacatagcagctcattgttgccctgtttatgaagtcataattcaagaagtgtcgttatgtattgtcaatctctcgtatgtatgttcaggcatatgtacagacatttataattcttacaaagtcttggacacgcacacgcttccggtggtgttattttaatgtgatttgtagataagcattttttatttaattactatttcctttttaaatatatcgttaagtacaacttctttttgggcataaaaagttttatgctcaaatcagactctatcatatggattttatcataatctaaactaacaaggattgtttctgtagttacctttaaggctcctttggttttaaggaaacaacataggaattttataggattctaatcctataaacttttttctatatagtcatttgaaacaaatgattggatactattgaatcctatgaaatgtcttattccatgcaagtttcaaaagaaatttaacatgaggcccaacctcatggaaagtttcttttgagtcttcatctctccttaaatccctgtgttttttcttgccgtccaattaaaacgaccatttttgtatttttgtatgttttataataatttgttttacactgtattctattaaaattatgtgtttttcatataatcatattgtctgttttctcaattttgtgttttaaagaggacctaaagattctatatcaagagctaatccctctctttgtattgttgactgaaacaactgttaggtgtaaatcaccttgaatagtggtagagccaaaaggttcatacagcttgggtaagcataatatgcatgcaggctattccactgtttctagtggacatgagtgactacaagtgatggacactccattgttgcacccacgagtatctgcgagaatcctattcagcccgacgcgccagctccattgttagtgtctgcgcccacatgcgactttttttcacgagcccacacgcacttgattttttttgtgattttttgtaatttacaatttgaatttttcatttcaaattttaaaatattctattgaaaactttcaacttgatttttgagatgaaagtttctttaagttttagttgaaagttttgaattttgagttgaaagtttttgaattttgagtcgaatgttttaaattttgagattaaagctccgaatttgggttgaaagttttcaaatcttgactttatagttttcaagtctaaattgaaagttccaatgttaagttgaaagtttacaaatttgagttgaaaactttaaatcttgatttaaaagtttttaaatctgagttgaaagtttttatcagtgttaaagataaggcatagttcctatacatggatttatggaatacgtcaataccatatactatacgagtaggtatactttaattaaggaaatacgacaaataaagaaggaaattatcttcctggaatataaggtgttaaagtcctgttcaggaaagataaagtaacctggggcttgtatccggtcttatctctttgagatctacttgcagaagaagatgatctacgctataaatataagtcccccaccctcagtacaaggagggaggggcatcgagttgcaagtcggaaatccgagggagccaaagatagatctcgtcggacctttttctcaacagcgtctagtcaggtgagtccaatcttcttattccctattgtacctattgtactcttttgtgctattttcgtctataattcatataaactggactagggttattactcatcttgaaggctcaaaccggtataaatttgtctgttgtatcgtatataccttggttctaatgatccccatactctataaataccgtggtcgggatatccaccctcgacaatttcaaatctttgactagaaattttttaaatcaagttaaaattaaaagttctcaacgagagaaaagacagatcgaataagttccataggtatgtaagtgactttatctactagcgcacgcgcacgtgataagtttccccaagtgtctgccatcgtagggccctagtttgaagttcggccgctgcagttggataaaaccacctcacataacaagtgcaaaaaattcttatatatatgtgacaaatgaaaactagaagaatccaaacaagacgttaaagagagttggcgtggtgtcaccaaccaaaacttatctcctgaaaaacagctcggtataattattgctatactgtgcaagcaccagctgaaaaaaatgataattgttattcagttgataaattttgttggtgacaccacgccaaccaccatctgaccaacaaagtaattcctatcaataagccactatataaaaccaaatcatcacccctttttttacagtgttggattatactttgatgcctcgtattattactatctaattttttaaacccatactccctccgttaaaaaaaaaagataaatcctggatataaatcttgaaaatacattatgtccatatttatattcggggtttatctttttttttttggacggaggacgaattaagcacttcctaaaagccatgactttccatctacgtatcgcataaatttaccattaatatattaatcatgttccgcttcacttgatagcgaatgcgttgtacctagctgtttgccttccgtggctatagtgcatccgcaactagcagttgtaccacacagctaaacatgcccattatatgctctataataatacgcccaattacacaacagccaatgttttccctaaatttatttctgacaataaattactataactactgtcttccatgactgtggcgcatccgcagctagcagctgtatcaccccgccaaatatctataataaataaagcatccaatgccaccatagccaatgttttgtttccaagtttatttaagattaaaaatttccacaaacatcacaagggactaactcacaaaagggagaaaacattcaactgccccacccatttccactcgaaggaaagtaaaaaaaaaaaaaaaaaaaacaaatccacaaatccctcccaaatatacacgcggcgaccagatcagtccctgtagcccccaccgtcccgaatccacgggggcggattcaacattcgagactcgagcgagaggaagagcagaagagccgaagagagagagacggcctatttttagcaacccccacacgcggcggccacacgcccagtccgaggtctgcgcgcggagcagcagagcacacccagccgactcatccgccctgcctaccacatttcgatcccctcaccgtcgccgccgccgcccgtctccgccgcggaggtgagctcctcgtccctccccctcttcgtcgccgcggtagcgccgtttcggattttacggtttgggggtggggaattttgttttgggggaggggagggggattggatttgtagttcctcggtttggtttgatttggtgaggcgggcggtgtgcgcgtggtggtctgattccgatctgtactatgtttgtagggtttgtattttttttgtggtgttggtggtgatgggtggcgtggaaccgccgccgccaccggctccggcgccggcggggctggcggcgtggctggtggcgcgtggggtgaagcggagggcggtctccgccaagcgctcctggccccccctctgcggccgcttccccgccccgccgccgccgccgccgactgctcccgtggccggtgacgatggaagtaagggcgtcgagggcgttgtcgccaaccagggcggagcggagggggtggctgtctcacctgaccgttccgtgccgctatcaggcggcccaaccgccgcttcttcgctgccgccgccgccgccgtctatcatagcaggtaatgttggggataacagtgtcgagggcagaggagatgttggagataagggtgtccatggtgtcaccgagggcaatgaggaggagcaggttgcctcggctgtggtttcctcggccgcatgcattggtgccctctcgcacggcccgtctcagccggaggcagagaggatggaggtggatgagggagaggggcgggagaccggagaggcgcagctacctaatgatacagatgctcggttgtcagatgatcagggaatgggcgaggtgcttgatgtgatgcctttggcagtagctgcaccagttagttgtggtgctaatgtctctaacggttctgcggagaatgttagggatgtggccagtttgttgatggacagggagggaggcaagtggggctgtgaattcgagagaaaggaagttactagcgatcgggatggccgagagacggaaagtagagtaggtgttggtcaattagagaggacaaatgatgtacatgatggtggcagaaaaaagaggtggttgatgtcagttctgaatcctccacccaaaagaagggcgatctcagccatacgcaaatttccacgtgactgtgggagggctgcttctactcttgcggaaagtggtgcctctatggaggagttgcctttagaagcaacacctattagtgtagctaccggtggtgcctctatggaggattccttggcgagaacccctatttcagtccagggtgcttctttggtgtgcggtctagaccattctagtgaggcaatagatggcaagacaattgaagatgatgaatctagcaaggtagaaaataggatccaagagttccaagttgccacaaatgttgccctagatgattttgaaggagccaagaatggtagtacacacccaaatgattctattgccaaaccttctcctagccatggttttgttgagagggtgaatggaaagggatcacaacaagaaaagaagcttgtagcacgaagtgctggggatggcaagatggtaagcaaatatgaagagagattacaaaaaggtactcccgagactcgtatgagagatcttgtcgatgtaaaggcaaaaaagaagatattaaagagtgataagatgaatggggcattgcaaaatgacgctagatcctctggagatggtaagatgaaaacgaaggcttcaagcactcagagaggtgtggtgcgctcggatatgagcttgaagcaaggtgatattgctcgtaaggttgatgccacaggcaaatgcaagggcggcgtgaatagcctcataaaggaggctacatctgggaagcatgctacgactaatggaattgaagaaaatgatgatagagaccttgtcagtgacaggataattgtacaagcactaatggccccagacaaatgcccgtggacacgaagaaggaagtctattggtggttcctccgagtctcgtactcctaagcttaagaaaaagtttggtaggccaaggaaagaattgaaagatactactccaagggaagaagtttccccggaagttgcctcttgtaaagcgatcaagcatgaggccatagaggacaaggaggattcttactttgaggatgaaggcaactctaaggcttcttactcggatgttgaaggcaactctaaggagctagtgcgtggaggaaaggcactagttgtttgtggaggaaagaaggagttatgtgttacactccctccttcggctccttttggcacagatccccgaagcaaaataaggaatttactcataaaattccatgcggcatgccgaaagcttgtgcaagttgaggaacaacataaaggtaatattggaagaattgacatcgaggctggtaaagccctaaaacaaaacggttttattaagcccggacctattgttggcaatgttgcgggagttgaagttggagatgagtttaattttagaatcgaattgtcatttgttggactccatcgcccatatcaaggaggtattgacagtacaaaggtgaatggaatcctcgttgctataagtattgttgcttccggaggttatcatgatgaattgtctagctccgatgaactcatatatacgggttctggaggaaaggccatcgggaataaggcagctggagatcaaaagcttgagcgtggtaatctagctttgaagaattctattgaaactaagactccggtccgagtgattcatggattcaaaggtcatagtaaaggtgaagctagccattctaaatccaagcaaatctcaacatatatttatgatgggctgtacatggtggtggattattggaaagaaggcccagagggctcgatggtctacaagtacaagttgcaaaggatcccaggtcaacccgagttagcattacacataatcaaggcaacgaggaagtccaaagttcgcgaaggtgtttgtgtgcctgatatatctcaaggaagggagaggattcccatacctgcgatcaacacaattgacgatacgcagccaacagcatttaagtacactacggaagtcatatatccacattcctatgcaaaagaacctctgaaaggctgtgattgcacgaatggttgctcagactctaatagatgtgcctgtgcagtgaagaatggaggtgaaatccctttcaattccaatggtgctattgttgaggcaaaacctctcgtatatgagtgtggcccatcatgcaggtatgacgtgcaaaagcttagcaatccaaaataataacaataactaaataggagtaacatttgcatcatattctgataataccaaagtagattcacagaaccaggaaatatttctcattgcttctgaaatttttaccctttcaacaagggctgacatttggttgcagattcatttgtcagtgaaacaccctgcaacacacaaggaacataaaattgttggtggcatagtttaaaatttctcataaaaccaaccattttcaccttaagtctgtaggttttcacaccagaactattcatttacagcagatcattaggttgaagggaataataaaatatattctcaatcagagagctagacatattatcataacagcgaaattggttcattcaccttaaattggtaggtttgcatatcagaactactcattcacattgcacaattaggttaatttgaaactacaagttctgttccgatgctttgagctaactaatgctaatatgcattgtttgcctgaagttaattgtttttcgcgccagaattattattagattaaacccaaattgtaaattctgtttgaaagctgtgaaataccaaatgctcaaaccaacatattgattacagaagcaaccaattcacgtcaagttaattagtttttacaatagaatttatttgtttgtattggaatatcaagttaaaccggaagtagaagttctgttctaaagcagggagctaatctagctaatctaatgttcaaaactatgtgcaggtgccctccaacatgccacaacagggtgagtcagcatggtatcaaaattccgctggaaatattcaagacggggaacaaaggttggggtgtaagatctctgagctctatctcttcaggcagtttcgtatgtgagtatgcaggtgaggtgctgcaagaaaatggagatgaacatgtagagactgatgagtacctttttgatattggtcatcactatcatgatgaagtttgggaggatcctaaatttgaaggcattttgggtctagaatcttctacgtccaagacaacggaggatactgaaggcagtaaaacaacggaggatactgaaggcagtactatcgatgcatcaaagtgcagcaatgttggaagattcatcaaccacagctgctcgcctaatctgtatgctcaaaatgttctctgggatcatgatgacatgaagaaaccgcacatcatgttctttgccaccgagaacataccgccgctgcaagagcttacttacgattacaattacggtaaagtcgaggataagaatggcaaggagaaggttaaaccttgcttctgtggttcgcctgattgctctcgcaggctgtactgagatgctgttggttgatgatgatgatggcgacaatggtgcccatttttcagtggaacactgttctgtcgtgctattgatactttgttttacctcctttatttttttactcgttcatcttgcacagttgcagtcatgggtagcatgtaatgttctcttctttgtctttatctcctgaattgaactcttaccgcatcttttggagcaccgactaaattgcaatggaattgatgttaggccattcccatcccaatgactaggatagtgtccatagtattaaataagttgcgacctaggataaaaaatgatatggcaagtgaataaatgaggaaagagaagaaaaccatgtcttgccacctaggatgaaaaatgatatggcaagtgaataaatgaggaaagagaaggaaaacatatcttgcatgagatatgatttctacacaacatcgaagacattatgtgagataagtagcactaaatttaagtatggaatagtgatgtttgcattggaagagtagtgactagtactagtttattgatttggagtttatggaaactatattagtgttttgggttgggaatggtcacaacccacaagttccttcactgctggcaaagaacggatataaatttatttcgtattattcgtctattatacagtacaatgcagactacccctatgagcatcttcgaagactggaccgattgacgaagtcaccacgactggaagagtagtgactagtaagtttacggaaactatatctagtgttttgggttgggaatggtcacaacccgcgtgactacccctatgagcatctctacccctatgagcatcttcgaagactggaccgattgacgaagtcaccacgactggaagagtagtgactagtaagtttatggaaactatatctaatgttttgggttgggaatggtcacaaccttcgaagactggaccgattgacgaagtcaccacgactggaagagtagtgactagtaagtttatggaaactatatctaatgttttgggttgggaatggtcacaacccatatctaatgttttgggttgggaatggtcacaacccgcaagttccttcactgctggcaaagaacggatgtactgtgactacccctatgagcatctcttcgctgtcgatgggtacgtcgtctaccactgaaagcacaacgccgttaaatcctggaaaattcgctcccatggggagtcgaagccaggacctcaggtactactgagcctcttgtaaccactaggttacaggccctttcgctcaatcactatatatttattcgtctgtcatattcaatctacagtttttttttcatttgaccaacattttctgtgttttgcaataggctagtcctgatttgataaaagcaatttatatatatctatatttttcacaaatgaatggtacgccatttataactgaccggatgaaaagacaaaaaaaaccaaaaaaaaaaagaagtaaactgtattcatgggacatcaacttgatatactgtgcaatttagttcacttacaaagtgagcgtgctaatgcaataattaacttagcaaatggatatcttgcaaggtgatatgaatgcaattcacgaatttactaagcgagtaacgaagcgagtaacgtactgggtgaatgacttgcaaggtgatatgtgagtgcaatttagtttaagaacttacaaagtgagcgtgctaatacaataacttagttcaagaacttacaaagtgagcgtgctaatataataacttagcatgtggatgacttgcaaggtgggtacaattttggtatattgatacaacaacatattgtgtcaacacacttgcgcagatttatataagcatacttattttttaaaatatagtcactaaaagtcaattagattttaccatgtagaaaattgtgtatttctgttgagatatgagaatgtgaagataaattctaaaccggtgatgcaaattgattcaattctttatagatttaatccaagattgtagggtaatatttgcatgattgttacgtcgcattgacaatttgacatcatgagaaaactcatctagcactcgttaaccaaacaacatgtaactagtcaagttgttacacacattttcttgtactggaatatactcactaacttattatacttagacattcaatttctaaatttttttaactaaattacacctacataccaagtttttttttaccaggagtgtactttttacttaaaaaaagaatgttataactttggactctcaactacgaaacctagctaactttgaaaaccactcacattttatcatgggtcttatgttattcgatgaactggcgtctacatggagtcaacgtgattgaagagtaacgacagcaaaatacaatgaataataaatgtcaatcttgttttttttcctttgtcttttcccctaaccctatatataatttatttaaaattgctaactatgatgccacatgctgccaagtcatccagagccatccaaatttaggtcgaagaagatatttttagaagttccttttatagtaacaacaattttaacttttaaggcccttcatttttttttagataatgttaaggcccttcatttgaaggaaaaacataaaaaaattgtagaattccaatcttatatgatttttcacatatatgaccgtttgaaacaaatgattgaaaattatagaatcctatgaaattcctaagtaatgttgctatagaacccctttgattccaagaaaagttgtaggaattttggaggatttcatttctaaaggatttcctagatagccctttgaatcaaatgaatagacacaattaaatcttaagaaatttatgtggaatgtctcatgttatgcaaatttttgaggagatttaacatagggtagaaattcatgaaaagtttcctttgaatctttatctcttctcaaattcctatatttttttcgcggtctaatcaaacggttattcatatggttatcttgtgttttgcaatcatatacttgcattcctgtcagatcttgtctttttcctatttctacgcttcaaaggaacacgtggcaagttttgggtgtttttaacatgagtccaacctactggaaagtttactttgaatgtatcttcgtcattcaattcaattcatacgggtttttccgcggtccatcaaacgttcatttatgtattttttccaatgttttacaattctctattttatatttgtattattgtctaaatcttatatttttcttatttctctgttttctcaatctaatatttaggaaatcacaagtggatgtcttaagaaaagaaactagcggccactagttagcaatatcagcaggctatatacatgccatgtcagatctttggatgagttggaagataaagaagaggagagagaatcagagtgggcgactaaattagcgtcgacagcaggcgcacagtacgatgcagggtggaccccacctgcattctctcccaatcaatacatgaaagaaggagatggtgggcccaatatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggtcccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcagaggttggggacctccaggatcctcccctccggctccgggtagagcgccccggcgacgccgatgactgcgccgcctgctgctcccaggggcatattgttgctgctactgctgctgcttggtgatgctgctcatggacgagctcgaccttccgacgtgatgcccggtggcgctgcttatggaagcaaacacgttgtgtagtgccatgatgggactacgcctatttgctggagcggctgcttctgctgcgaggtttgaaatttgattagaatatgttgtcaagaaccaagggagaagaaatgccacaagcatttgaataccttgccagcgtccatggtggccttatgttggtgccctcacggtcgcagcagcttcagcctcctcggagccgaaacagtcccccatgggatcagctgggagcgaagctcgatcaaatcgagttgattattgttcgttacctcgctgcgtactgaaacttggcaagtaacacgcgagacgctagttgattctttcttgtcaatcagtagcagctctcgactcagcatcccgccaatgagagccgccgccgccgggttgggagcggtggagggcgcagcacccagggggacgcgtggccgagcgctggagtcgcctcccgtcaagcagagggagagcgaggcgacggcgagggcgaggccgtcgcctcgcccttgccggtggcaccgccgccgcgtccatctccccctccgctcctctccccgcccgtcgtcagccgcgctcctcagtccttccgcgcggccggttgccaagaagagagaggaagagaggtagagagagaaaaggaagtagtcattgacacgtgggtcccacgtgggccccacgctgactcatctgccacgtatgacaaaaccggggcaaaaaccgcctagggacctagagtgaccaggttttataagttaagggatgttatatatctggtttttaggttgagggatgattttataatttggtgataagatgagggacctctggtgtactttttcctataaatattgtgggtgcagacccaaacattaaagcccaaaactaaaagattgacggcccaagaactagcccagagaaaaattatggcccaaggcccacttctcatggccgctcatatctcctcgaccatcatctcccacctctctcatcggagctcctctcctcgcctccaatggcgctgctcttcccaccaccaccccacgcgctctcccccaaaccccccttcccctccactctccgctccacgaggtcactgcgtctccgccgcgccaccgccgccgccgccgccgccggggccggagtctcctcctcttccccctcgacctcctcgccggagaaggccccggcgctggacgtcgccagcgggaagaggggtggtaagaagaggaggtccctgaagccgagcttcgagaagcaggccatccgccgctggtccgcgagggcgccgtcccagcgcgcctccttcccctggcagcagcagcagcagcagcagcagccgggcggaggtgagggtgaggccgcgggcgatcaggaatccggttggagtgggagctccacgctgcagtccatcgtggattacttcgacttcgactacgattcctcggatggtgatggcgatggcgatggcgatggcgtcgtggtcggcggcgaagcggccgaggcccaggaggatgggccgcgtcccgagccgagcttccttctcgggagccggccggtgtcagcgccgtggatgcacggggaagaagagcccatgacgaaccaattggtttctgacgaggaagggttggatggggatggtgcttccgaggatgagatgggtttagttgatggagacggagacgaagacgaagatttggggagtgaggaggagacgctaagtgagagctcagacggggaattctccgaggattatgcagcaccggccgcaaattcttcttctatgatggattcggtactggaccatgtttcttcaggtggtgggttttatagaggtactaggcggagtagcgtaaattcaattgttaacacaatgaggaattcgatggaggaaagtagtagaaatgctgcgattgagtgtcccgagaccgaggattttgtccagaagctcggtcctgtgctcctcccatgggagagggagggggatgtcgataggccgagaaagcgcagcaacacggagctggctgagaggactatcccagagcacgagctgcggaggcttagagatgtggcattgaggatgaaggagaggatgagggttggtccaggaggggtcactcagctcattgtggagagcattcatcagaaatggagggtggaagaggtggtcaagctgagatttgaaggacctccaagcctgaacatgaagagaactcatgatatactagaggtgcggttaccttttgctgtctcatgttttgttcattcacaattttttcgtggcgtgaaatctgatagttactttgttatcttgctcttatctatcaggagaggactggaggaattgtaatatggaggtcagggagatcagttgttttatataggggaatgaactacaaccttcgatgtgtgcagtcgtatacacaaactacagaggttaattttgataaaagagttagtagtaatagtgttgaacctatccatgttgaacataaatttcagaagtcaggtgcagatggactgaatcgctcagcatatattgtcaattcctctgaaaaacctacagagacatttgatatcgatagcttcttggatcagttgggaccgcggtataaagattggtctggtcgtggccctattcctgtggatgctgacttgcttcctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagaggggggttccaaatacatgcaatgacagaatggcagaagaaatcagggtaaaagatcatgataactattatcagtagtttgcctgtttgcattcctgtctccacagtgttatgtatgtgttgaatcaaataaacatggcattgcttgataagtagctattttgctgccttaattagttcttttgcttaattcacactttttgaatccttgaaatgtcaaatttctgagaaagctgagagtaacaatctgacaaagaacgcttaagaaatccactaatggactttgctttcttctcctctgcacttccatactaatttacctcttcgcctgcttgttcttgtgacgtattgaatgccttcttttcttgattcgatgcatgactgatggttaaccttgaaatatgatcattgtattagtttctcttgcacactgcagcctatgcatgttttgaatctgtgtaacggaacacttgcagaaattaacaggaggagtgcttctatcgaggaacaaggagtacattgtcttctacaggggcaatgatttcataacacctaaagtaaggcaagtcttggtggagaagcaagagcaagcaatcacttggcaggatgaggaagaattggctcggcttaaagcatcagcctcgatcagtgtcaaacccaaagtatttaaaaatcccccagttgctggcactctcgcggaaactagagaggcaaaatctcgatggggagattccattaatgctgagctcaggaaaaaggagaagaatcacatgattcttacaaaacatacctctcttttgaggaacttgaagagaaaattgattttggtatgctcttcaaaatgcatctctagaaacaaaagtttagtattttaatttcattactcatttgtaagtagcattttagctactttttcctccattgcacaaagatatctttgtgattatttgtgtaatatctactcctgtgcaggcaaaaacaaaggtcataaaagcagaaaaggccttggctaaagttcaagaatttctctctccagcagagcttccaactgatttggaaactgttacagatgaggaacgcttcttacttcgcagaattggcctgaaaatgaaggcctttctaatgcttggtacaactggcacttctcacttaacagttgtgatataaaatgcatgtggtgttttatgacttgtctatatgcattaaaattttctcaggaagacgagaagtttttgatggaacagtacagaacatgcacttgcattggaagcatcgagaattagtcaaggttcttgtaaaggggaagagctttccacaagtaaaacatattgcaatatctctggaagctgaaagtggaggagtgctcatttcagttgataagacgacaaaaggatatgcaatcattttgtaccggggtaagaactacaagacgccccaaattttgaagcctcgaaacctattgtcaaggagaaaagcattggcacggtctatagagctccaaaggcgggaggtaattcaagtgcaaaatctgattttctttttccattattttattttttgaactctatgtaagttgtatatgtatttaatcaattacatggtctaaaataatctagggattaaatcatcatatctcaaatctgcgagacaagatctggaagctgaagtctcaacttgtaagtcatttatacacgagttctctatgacagtatgacttatattttcttatagtagtaaacatttcttgatgatgttctcttcctatgtcatgaccatcaggtacgaatgcaagttgctggggaaaaaccagatgcggagttacttcaaacagttgaggctgatttgtctaaagatgacgataaaatagaggtaatcatgcatgaaaaatgctgagttcaaaagcactgctgcaaattacattttgttaatacacacttatagctcgcggtgtttggtggtgttgtgatcaccttcaaatgccggcacatcgctagtggttgacaggtagcttctgttgttgcaggatgaaggagaggaggcctacctgcaaacttacatcagtgaggatgaagaggaacctgaggatgatcagaatgaatatctctgaatcttaactggcgaaacttcggtgagtccgggagaaaagtcagtagtaaagcattgcatgttcatattgtgaaatttctgcagtgttactcaagaggcaggcagttttaagattcatctatggattattgccaacacaaattgacctgcaacagcattagtggcctttgtccattgcgagatcaacgacaaaggatgtagcttgagtgtgtgtggattgtggtgcatggtctgcagttgctgccattcctttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaatcaggctcgtgtgagttcgtttcattttgcagaagctgtaattatatcatgccattttagaagaatcctccggtccacgttagattcatatttacaacatgaacatgtgaacctttcgttgatacggaattttgaacggttttctgcggaatctctcaaagctgagagcgcgattgctaatccgcgcgcgcacgtttccggcccgccgccggcgcgcgcctcccactcttttttttttcgtttttctttacccattttttttcgctttttccttttttctgattatttttttaatttttagcatgttttgagtttgaaagttttaaattttgagttgaaaattttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaaccaagaatttttttcggttttagattttttttaaatatttacataaataatctatcggccaaaaaaattacaaaaataaaccctgtcgcccacctctggggcggcaagctaacgtggcaaacgggggaggaacaggcgttgatggagggagggttttttgcaggaaaacccttgccgccctctggtggggcagcaaggggcccgaatgcaaaaaagccagtcggggctggccattctgcaggcggtcccttgccgccctctagccgggtggcaggcctcgctgcctataaaaggcttgccgcccagcccccagccctcattcctcccccctcaaatccagtgaaaaaaaaaagaagagaggggaggagaagagaagaaggggcgaagccctgtcggattcagacgccgatttcaggtaatattcatagatcctatatgtgactattgagataaatagtgtgtattttttaaaaatttgtttgaataaatgcattatatttttagggttttagttgtactaatctagaagtgcgtattgtagatatcggtaactacgtagatctactagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttttataaaaggatggttaatgaggggcttgagagttgatccacagacaagtgacataacaatcaatgttatagtaagtcgggcaactgagggtttttattgggaattaatgccaattcaaaactctcgagtgtggagatggtatttggaaaatgcattgcaacgcgggtggcctctagctttggttctgtttgttcacccgaaggatccaggtgtgcagatgaacatggatgatggcgagggaccaagtgctgaagtaaatgagacttctgtggaggaggtcaatgcacgagaggacgggggcgtagtagctccactgggcattcaaccaggtggagtggccgacgagggggaggctgtcggtgccattgtggatgaaatggagagggaggattctgacaatgagcgtgtagaggaaggtgattcgtcagacgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcattaccaagcatacatgttttctacctggtgttcagaaataccacaggaacattacatgtgcatttgttgcatgtgagatgtatgtgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcatagggcgttcttagctctacatgcatgcaagatgacattcgtgaactgtcgtcctgttctctgcattgatgggacattcttgacaggaaagtatcggggccagatactaacagcaataggggtagatgggaacaatcaggtattgcccttggtatttgcttttgttgagagtgagaataccgacagctggtactggttcctgaaattggttaaaacaaaagttgttggtatgagggcaaatgtgtgcctgatacatgataggcacgctggcattctgcaagcgatagaagagttgcagtttgggagtatggaatgaggataccctggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaatggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccatggactgccactagttggcatagtggagttcattttacatgggacatgcaggtattttagggatcggttctaggcagttcttccctctatgccgaacaacaacattttgtttggaactttcatgcagaaaaagctagaggagttgcgtaaaaaggccatgaaacatcgagctctagtgcaaagtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcagagtgtggcataccagatgcagtatatgtgtcacagtacttcagtaagcaagcaatatatcatacatggagcggcgagatttatgggttcggcatagctggggagttcacagagactaacgatgaagtactgtaacgccccgattttcgttcgggattaaaaatcattaaataatgcattttctaaaaattaaataaaagttaatcaatttaatcaagtgaattattgggaaaattaaaattttcccttaaaaatcattggccgagaatattttgtaatattctttttgccctaaaacactctccggatttttccatgaattttcggaactcaagaaataattttaaaagcacaaagttcattttaaccaattacataaaaagaaaaacaattaaaaatctcccctccttcactttgggccactttcggcccaaagccctccttctctcccttcctcggccggcctcccctctcctctcttgggccgtcggcccgtttccccttcccctcacgcaaagtttaaataaccccctaggttctcctccctctcttcctccccgacaggtgggcccggcgaccctacccgtcaggccctcctcctaccttcggcttcccaggccgaagccgccatggccggcggttgccgcccatgtcccgccaaatccggcgccctcccgctcgcgccctcgcgcccaaaccgagtaaaatcggttccccaccacctcctccaccaaatcccccacttttccccaatttttggcgtcaaatcgagccctactttgcccacgatgtcgcccacgttgccggccgttgccgcttcaaatccgccacgcccggccacgattcctcctccccgagcctataaaaagcaccctcgtgctctcctcttccgtttccccctcctccccgagctcctcgtgccctctcccgtgctccccacgccgctccgcgcgacgccgcccgccggcgaactccggctacacgccgccgtcgccgtagccaccgccacgccacgccacgccgttggttccttcggcttcgcctcgccctgccgcaccccggcctccgctccgtttccccatcccatcgctgcagccatcctcccaccgcgaacccgagccgccattgccatccgccggctccagccgccgcttctcgccgcttcagccaccgccgtgccgtgccgtcgccaccgtcggcatagccgcgccgagctccaccccgtcctacacctcttttccccaatctcgcaccgaaattccacctccactgtccacccgagccgcctcaactataccacctccagccgccacctctcgccgctctagccgtcgccgcgcagcgtcgccgcgctccaccgcaccctggctgccgctccactccgtccagaacctcacgggagccgcttttccaaaatcaaggtcttgccggccctcggccgcggcttcgttgtggtcgggcgtcgtcggaacgccgttcccgtcgcctcccgcgccggccgccgccatcctttccgccgccggtcgcctccctgtggttgtctcgccgccgcagccctcggtgagctctccctccgcctcctcctttttcccctcctccgccgctccgcgtgcccgctgtcgcgacgcgctgccgtcgccggcggtcgtctggccgcacgccgccacgcgccgtcgttcgatcgggtcggctttgtgtcgtgcccgtgtcccggctgcgccgcctcgtggccgcccgatcggctttgggccgatccgggccgtcggttcccgtggaccggcggtggaccacctcggtggtcccggtccacggtggaccgacgcccttgtgtcgctgaccgatggggcccacatgtcggcgccagccgccccttgctgacgtcagcgatgatcttttcctttgtaaaaataaataataattacacaataattcgttaataattctagaaattcatttaaatggctcaaaacttctaaaattcatatctaattcattagaactccgaattgagccattcaacttgcaaaattcatctaaaattgagctctacatgtttgtttagtttttatgtactgttttcttggtttttattagagtttttcctcgttttgcgtgccagcgtgtagaatccgtcgtttcggaagtccgcggtcgcgaggaaaagagttcggaagatcaaagtgaagaagcaaggcaagtaacacattccccttgagcatgttgatcccaatttataaatgttttactgtttgcaaataaatatgcatgttttgctaattacatggggtcagggttttacctatctgctcgcttgtgccatgtttacttgatatctgtcctttgtcaagtttgggttataaatcgactagctcgtgttacttatgtgacctagctagaactatatgcttagccatgcttaattaccactagctcagatgatgggataattacagtattagacctttttagtatcagaatgagctgcgtgcttgagacatctggccatgcttcatggtcgtaattatccaactaaaatgcgagtgaatggtgggctgtgggtgcatggttttgctagtcgctcccatggcaattaaggaccggttcacgggaaaccctgaaagaattcctcgtacttaccacaagccagcgtgggcaacggctgggcttgtagtgtagcttttctctagccgacgtacccaggcgagggtgggcgtgatggagttgggtcggccggggtgtccggttgatcggcttccggattcactgcggcacgaaaggggggctgcccgttgcctgctggggacgggggcgaaccctaaggtgtggtgcgatctgtagagggggttatgcgaagggtcctgtcacggcctctttccggtatgtcgtggtggcatatcggcgcacggaaacatgtcgtggggctgtgtcttgtgggtacagttgtacacctctgatcagagtaaaactattcgaatagccgtgcccgcggttatgggcggtcgactagattcaccgtgattagtcctaccttaataaatcgacccagtacactgtagttcaggtgggttggttgggcctgttcaacgtggtgtagcgttgatcagtggagatttaatgttactttaattactcaacagttttactgttttgctcaataaaatgttttgcaaccgcctttatgcaaatagccacaaaccatccttgtatccccttgcacgtctgcatcgttggtgtggcttgctgagtacggtggttgtactcagctttgctattattcccccttttcagaagtgtagtgcttctgagctgaagacgaagttagaagaccaaggctcagaccccagttgagttttgcctgtggagtggagctgaagccccgctaggatcgtctttttccgctgctgctgctttcgtttcggtgcgaggactaagtgcttcttctgtaagtattttacgctttatttacgtttggaactgtatattacttgtcgttttgtgtaccctggctggtcatggacagggatttaatacacaaaatagtctagaaatttgggctaaatttatgggcgtgacaagtactcaatattcctgaccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctatgtggtgtagttcttatgttctatgttggcatgtggctttgcttgtaattcgtttcgaacttatcgatgtgtttatgtttcgtcgtgtaatgtcagacttcggcatgtcatgtctttaggtctcgtgatgtaacatcagactaaggcgcctaacatctttaggtatgctgatgtatgttggacttcgacacgtaatgttatgttatattatcgaactctacatatatgttaaattgcacgtcatcgttatgtaccattagtaacgtttgctatatttaaatagcctgtactcttgttgtacataattattctcatgattttattaatatttcataattttgcaagttatcttttgttttatattactactttttgaattgttctaacacgaaacactatatttttcagagatggcacgtcaggatacacctcagttgttggacccggcgatagatcaccgacaccggtctcaccttactgcggtgcagggggctcagcttgggacgttccaggcactgcgcccaggacttcgctcgtgctgtgagtaccttgcatcgcatcattcctttatgttttcatgtctttctcttcgtgaaattttacgaatatgtacgaacaaattaaccatgcaggtcgacgacatcaaccgggtcgtcgttgacggttcaacgacaatccaacgtttaggcgcggggattccggtacccgtagtgcagttctggcagtacaccgggacttcgtcacaggcacccggcatgtcgagtcagggtccaccactggaccatgctaggaccttatcggaccgcttgctgccttccaccttgctcttcgacatcactgacttcgacttcgcttcaggctcgacagaggacgtcatcggcccctcacagctgggaggcgcaccgccggtgcatacgcaggaccaggcgcaggcctctcctccgccagacactcgtgctacccgtgctgtgccaccggatcgtttcacctactcccaggaccacgtgcgagcacaggcccggaggaccaagcgtggtcgcggcgcggggcagggccagtagagcagtcttctctttttttatttgcttcactttccagtactgtatacttgtgtaatgactacgttgttgttatatgtgcacgatacctttcggcgcatgcacgactactttctgccgcaccgatgcagcctcctttattcgcgtgcgatacgagtatttgcccgccatttggcgcatacgaccaatgtaactttcggcgccgatcaggctgtaactttcggcgccaatcaggcgtacccaccataccccaccatgttcacatgtcaggggtatcactcgattttttgcgcctatataagtcgccttaacgagtgaggcctcacaatctttcagaactcagtcacattcagtactctcttccccacttgcttcattacaaatcctaccggcttttgtcaatggctagacgtcggggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccattctcgacctaaccacttgtttacaagaaggtcgctggtatttcgcatccgaaaatactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtctaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaattactagagcaatatagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatttaaccacaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttacatctgggtccctattggggcggcaagggatccagatgcaaaaagtacggccgcaagctctttatgggcggccaaaattgcga
